United States Patent 11,098,302 (IDENTIFICATION OF POLYNUCLEOTIDES ASSOCIATED WITH A SAMPLE) - sequence listing, part 69

SEQ ID NO: 236979 - DNA, 622 bp, Homo sapiens
  misc_feature: GYAE6OF01CYCS7.5.24.C02.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccggtctccgtggacngtcagtcaccatctcctgcactgcaaccngcagtgacgttggtgttcgaagtntgtctctgtaccaacaacacccgacaacgccccaaactcatctattttgagtcactacgccgacctcgacgggtccctgactccgtcttctcgtcggctccgaacgtcgtcggacaaacgccggtccctcccgtcgtacccgtcgtacgtcgggtcctccgaggctaggacggtagtcggaggtcgtagtactttagttactgtcacgtctacgtagtactcgacgtaacggccgtaacgccgaacgccgtaccgttcccctaggttcgtacggtacgttccgggttaccggggaccggggaaccgtacggtccgtacggtacccgtacgtacggtaccacggacccgacggtccgtcccgtacccccgg

SEQ ID NO: 236980 - DNA, 621 bp, Homo sapiens
  misc_feature: GYAE6OF01AJZSD.5.24.C02.1.454.CMB.1.raw
  modified_base (253)..(253): a, c, t, g, unknown or other
  misc_feature (253)..(253): n is a, c, g, or t
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccggtctcctggacagtcagtccaccatctcctgcactgccaaccagcagtgacgttggtgttcgaatntgtctctggtaccaacaaccacccgacaaacgaccccaactcatctattttgagtcactacgctaccctcgacgggtcccngactcgcttcnctgctcagtcngacacncgcctccngcctctcgtcggcctccgacggctaggngagtggacggtcgtagtaatttacgttactgactacgtctactatagtcgacgtacggcgtacgcgacgtacctaccgtccccaagttcggtcgtaacgttcccggggttacgggggacccgggggtaacctaacgggtaccggttacccggtaccccggttaccggtaacgggtacccgaaccgggtaccccgacgggttccccgtcccgttcccccccggg

SEQ ID NO: 236981 - DNA, 667 bp, Homo sapiens
  misc_feature: GYAE6OF01C6U20.5.24.C02.1.454.CMB.1.raw
  modified_base (239)..(239): a, c, t, g, unknown or other
  misc_feature (239)..(239): n is a, c, g, or t
  modified_base (266)..(266): a, c, t, g, unknown or other
  misc_feature (266)..(266): n is a, c, g, or t
  modified_base (393)..(393): a, c, t, g, unknown or other
  misc_feature (393)..(393): n is a, c, g, or t
  modified_base (463)..(463): a, c, t, g, unknown or other
  misc_feature (463)..(463): n is a, c, g, or t
  modified_base (511)..(511): a, c, t, g, unknown or other
  misc_feature (511)..(511): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctcgccctgacctcacgccctccctccgcgttccgggtctccgtggacagtcagtccaccatcctcctgcactcgacaaccngtcagtgtacgttggtggttacaagtntgtctccgtacggtaaccaacaaccaccccgaacaaaccgaccccctaaactcaacttaccttagtttttgaacggttaccaccgtacgcccgtacccgtcgtaccgggtcctgactccgtctttcncgtcgtacctaccgtaacggtctacgaccaaaccgccggtacctcccgtacgccgtcgtcgtcggctcgngcgtgagatgagtcttagtatttactagtcacgacgtctagtacttgngcgagacacgcgtacgaccgtaccgtacctagtcggttcgtacgttccgggaccggggtaccggggaaacctacgggtacccgttacgggaccccggttacggtaccggtaccggtaaccgaccccggtaacggtcccgtaccccggtacccccgg

SEQ ID NO: 236982 - DNA, 659 bp, Homo sapiens
  misc_feature: GYAE6OF01DYJNK.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaaccaacaaccaccccgaacaaacgacccccaaactcatctattttgagtcactacgccgacctcgacgggtcctgactcgtcttctctcggctcaagtctggacaacgcggcctccctgacccgtctcgtcgggcctccgaggctggaggtagtggacggtctagtaatttattactgacacgtctactattagtcgacgaggacgacgaccgtacgaccgtaccgtaccccgtagttcggtacgtacgttccgggttaccgggggacccgggggggtaaacccgtaacgggtacccggttacccgggtaaccccggttacccggttaaccgggttacccggaacccggtaacccccggtaaaccgggtccccgtccccggtaccccccccggg

SEQ ID NO: 236983 - DNA, 614 bp, Homo sapiens
  misc_feature: GYAE6OF01C6KIL.5.24.C02.1.454.CMB.1.raw
  modified_base (255)..(255): a, c, t, g, unknown or other
  misc_feature (255)..(255): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctcctgcactgcaaccagcagtgacgtttggtggttcgaagtntgtctctggtaccaacaacacccgaacaaacgcccccaaactcatctatttttgagtcactacgccgaccctcgacggggtccctgactcgcttctctcggctccaagtctggcaacgacggcctccctgtaccgtctcgtcgggccttccgaggtctggaggtatggacggtcttagtaatttacttacgtgacctagtctactaatacgtcgacgtacggcgacgcgacgaccgtaccgtcccctagtcgttagtacgttccgggttcggggaccgggggtacctaacggtccggtaccgacccggttaccgtacggtacgtaccggacccgtaacggccgttcccggtccccccgg

SEQ ID NO: 236984 - DNA, 527 bp, Homo sapiens
  misc_feature: GYAE6OF01A5MHY.5.24.C02.1.454.CMB.1.raw
  modified_base (253)..(253): a, c, t, g, unknown or other
  misc_feature (253)..(253): n is a, c, g, or t
  modified_base (437)..(437): a, c, t, g, unknown or other
  misc_feature (437)..(437): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtntgtctcctggtaccaacaacaccccgacaaacgcccccaaactcatcatttttgaggtcactacgcgaccctcaggggtcccctgatcgcttctctggctccaagtctggcaacacggcctccctgacccgtctcgtgggcctccgaggctgaggatgaggctgatttattactgcagctcatntgcgaggcagcagccacgtccccatgtgatccgttcggcggggaccagcgtcgaccgtccgtacggtcacgacccaggcctcgtcccccg

SEQ ID NO: 236985 - DNA, 720 bp, Homo sapiens
  misc_feature: GYAE6OF01DR7O1.5.24.C02.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccgggtctcctggacngtcagtcaccatcctcctgcactgcaacngcagtgacgttggtggttcgaagtntgtctccgtggtaaccaacaaccaccccgaacaaaccgacccccaaactcatcttatttttgaggtcactacgccgaccctcggacgggtccctgatccgtcttctcgtcggtcctaccaagttccgtaggacaaccgcgccctccgcgtacccgtctcgtcgggtctccgaggtccgtaggacggtagtggtaacggtctaggttaactttaacgtttaccgtggtaccaacgtcccttacgtaagttacgtacggacgaacgggaccgacgacgtaccgaaccgtacccgttaccccgagttccggtaggttaccggttcccgggttaccggggggaacccgggggtaacccgtaaggttcccggttaacccgggttaaccccgggttacggtaacccgggtaccgtaacccgggtaaccccggtaaacccgggtccccgtttacccccgggtccccccccggg

SEQ ID NO: 236986 - DNA, 759 bp, Homo sapiens
  misc_feature: GYAE6OF01BNM5J.5.24.C02.1.454.CMB.1.raw
  modified_base (258)..(258): a, c, t, g, unknown or other
  misc_feature (258)..(258): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcagccctccctccgcgtccgggtctccgtggacagtcagtcaccatcctcctgcactgacaaccagcagtgacgttggtggttcgaagtntgtctctaggtaccaacaacacccgaacaaacgaccccaactcatctattttgagtcactacgcgacctcgacgggtcctgtactcgtcttctctcggtcctaccgtaacgtctacggacgaaccgaccggtaccctcccgtacgtacccgttcgtccgtcgggtcctacccggacggtccgtagggtaacgggtacgtacggtacgggtaccgttaggtaaacttttaacgttttaccgtacgggaccttaagggtacccttacggtaaacgttacggttacggacccggtaacgggtaccaacggccgtaacggtaccgtacccggttacccccgtaagttcgggttaacggtaccgtttcccggggttacccgggggaaccggggggtaacctaacgggtacccggttacggtaaccccggttacccggttaaccgggtacccgaacccgggtaaccccggtaaccggggtccccgttccccgggtaaccccccccgg

SEQ ID NO: 236987 - DNA, 845 bp, Homo sapiens
  misc_feature: GYAE6OF01BUD8L.5.24.C02.1.454.CMB.1.raw
  modified_base (229)..(229): a, c, t, g, unknown or other
  misc_feature (229)..(229): n is a, c, g, or t
  modified_base (256)..(256): a, c, t, g, unknown or other
  misc_feature (256)..(256): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctctcactcagggcacagggtcctgggcccaggctgccctgactcagccctccctccgcgtccggtctcctggacagtcagtcactatcctcctgcactgacaaccngcagtgacgttggtcggttacgaagtntcgtctctacggtaaccaacaaccacccgaacaaaccgaccccaactctatctattttgacgtacactacgcgtaccgtcgacgggtcctagtactccgtcttcgtcgtcggtcctacgtaacgtcgtacggaccaacgacccggtccttacccgtacgtacccgttcgtaccggtcgggtcctaccgggacggtccgttagggaacgggtacgtcgggtaacggtcgttaacgttaatttacggtttaaccgtacggtaccgtaacggttccttaacgtaacgtttacggttaccgaacggtaaccgggaaccgtaacgggaaccgtaacccgtacccgggttaacccgtaaccccgtaggtttaaccggtaaccggttaacccgggttttacccggggggttaaccccgggggggaaccggggggttaaaaccccgtaaccggggttaccccggtttaaacccggggtaaccccccggggtttaaccccggttaaccggggtaaaccccgggtaaaccccccgggttaaaccccgggtaaacccggggtttcccccggttccccccgggtttaaaccccccccgggg

SEQ ID NO: 236988 - DNA, 796 bp, Homo sapiens
  misc_feature: GYAE6OF01D33QA.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcagcctccctccgcgtccgggtctcctggacagtcagtcaccatcctcctgcactgcaaccagcagtgacggttggtggttacgaagtatgtctccgtacggtaccaacaacccaccccgaacaaaccgaccccccaaactcctacttcttaacgtttttaggacggttaccaacgtaccggaccgaccctcggacgggtccctagactccgtcttctcgtcggtacctaccgagtcgtcggaccaaaccgtacccgggtccccttacccgtccggtacccgttcttaccggtcggggtacctaccgacggtcgttacgggaagggtagttacgggaacgggtccgttagggttaactttaacgttaccgtagaccgtagtccttacgtaattacgtcgacgtaacggcgtacggaccgtaacgacccgttaaccgttaccccgtaggttacggtacggttaccggttttccccgggttaacccggggggggaacccggggggtaaaccgtaaacccgggtacccggttaaccgggtaaccccggttacccggttaaaccggggttaccccgaaaccggggtacccccggtaaaccgggttccccgtcccccgggttacccccccggg

SEQ ID NO: 236989 - DNA, 719 bp, Homo sapiens
  misc_feature: GYAE6OF01CQI2W.5.24.C02.1.454.CMB.1.raw
  modified_base (225)..(225): a, c, t, g, unknown or other
  misc_feature (225)..(225): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacagtcagtcacatctcctgcactgcaacngcagtgacgttggtgttacgaagtatgtctcctggtaccaacaaccacccgaacaaacgaccccaaactcatctattttgagtcactacgcgacctcgacgggtcctgactcgtcttctcgtcggtcctccgtaacgtcgtcggacctaaaccgaccggccttccccgtacgtacccgttcgttccgttcgggccttaccgacgggtcgttaggacgggtagtacgggacggtacgtagttaaactttacgttaacgttcgtccgtaacgtacttacgtaatttaacgtcgaccgtagggaccacggtaccgaacgtaccgaacccgttaccccctagttacggtacggtaaccggttcccgggtttaccggggaccggggggtaaacccgtaaacgggtccgttaacccgggtaccccggttacccggttaacgggtacccgtaaccggtacccccgtaaacgggtccccgttacccgggttaccccccccgg

SEQ ID NO: 236990 - DNA, 575 bp, Homo sapiens
  misc_feature: GYAE6OF01AF70M.5.24.C02.1.454.CMB.1.raw
  modified_base (382)..(382): a, c, t, g, unknown or other
  misc_feature (382)..(382): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccgggtctccgtggacagtcagtcaccatctcctgcactgccaaccagcagtgacgtttggtggttacgaagttatgtctcctggtaccaacaaccaccccgacaaacgcccccaaactcatctatttttgatgtcactaccgcgaccctcgacgggtccctgactcgtcttctctcggcctccaagtctggcaaccnccggtccctccctcgaccgttcctcgtcgggcctccgaggcgtggaggatggaggtctgtaatttacttacgtgactagcctacatagtcgcaggcagcacgcacgtcccagtgtgtacgtcggtccgggcggggtaccgaggtccgtacggacccgttcgtacggtccgaacgccctagggccgtaccccgg

SEQ ID NO: 236991 - DNA, 558 bp, Homo sapiens
  misc_feature: GYAE6OF01B2MJB.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtgttacgaagtntgtctcctggtaccaacaaccacccgacaaacgccccaaactcatctatttttgagtcactacgcgaccctcgacgggtccctgactcgcttctctcggctccaagtctggcaacgcggccctccctgacccgtctcgtgggctccgagctgaggatgagtctgtatttatactgcagtctactatatcgcgaggcagcagccacgtcccgattcgtgtacttccggttcgggaccgggggtaccaggtccgtcggacccgttacgtacggtccgacgtacccgaacggtcctccggtcccccgg

SEQ ID NO: 236992 - DNA, 672 bp, Homo sapiens
  misc_feature: GYAE6OF01C9VBO.5.24.C02.1.454.CMB.1.raw
  modified_base (218)..(219): a, c, t, g, unknown or other
  misc_feature (218)..(219): n is a, c, g, or t
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (520)..(520): a, c, t, g, unknown or other
  misc_feature (520)..(520): n is a, c, g, or t
  modified_base (534)..(534): a, c, t, g, unknown or other
  misc_feature (534)..(534): n is a, c, g, or t
  modified_base (620)..(620): a, c, t, g, unknown or other
  misc_feature (620)..(620): n is a, c, g, or t
tcagatcagacacgcacgaccggtgctcgatttagtacagatcgttagggaaaggggggggtcgtcaggaggcagcactctcaggacgtcaccaccatggcctggctctgctcctcctcaccctcctcactcgaggcacagggtcctgggcccaggctgccctgactcagccctccctccgcgtccgggtctcctggacagtcagtcaccatcctccnncactgaccaaccngcagtgacggttggngttcaagtntgtctccgtggtaaccaaccaaccaccccgaacaaaccgacccccaaactacacttcttaagttttgacggtctactaccgccgaccctcggacgggtcctgactcgtccttcgtctcggccttaccgaacgttcgtcggaccaaaccgtaccggtccctcccgtcgtaccccgttcttccggtcggccgttaccgacgggtcgtaggacggtagtcggacgtcgtagttaatttactacgtgacgtacgcttatagtagtcgngaacgcacgtccgngacctccgttacccagttcgtaacgttcggtcccggttaccggggggaccgggtaaaccgacgttccggtaacgttaccccgggtntaaccgggtaccgacccgaaccggtaccggcccgttccccggtacccccggg

SEQ ID NO: 236993 - DNA, 608 bp, Homo sapiens
  misc_feature: GYAE6OF01DP7BX.5.24.C02.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggnggttcaagtntgtctcctggtaccaacaaccacccgacaaacgccccaaatcatctatttttgaggtcactacgcgaccctcacgggtccctgactcgcttctctcggctccaagtctggacaacgcggccctcctcgacccgtctcgtcgggcttccgaggtctggaggtactggaggtctaggtattacttacgtgtacagtcttctaattacgtgacgaggcagtacgagcctacgtccctagtcggtcgtacgttccggttacggggaccggggtaacctaaggtccgttaccggtacccggttaccgtaacgggtaccgaccggtaccccgtaacgggtcccgtcccggttaccccccggg

SEQ ID NO: 236994 - DNA, 556 bp, Homo sapiens
  misc_feature: GYAE6OF01ET5D7.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacacccgacaaacgcccccaaactcatcattttgaggtcactacgcgaccctcacgggtccctgatcgcttctctgctccaagtctggcaacacggcctccctcgaccgtctcgtgggcctccgaggctgaggatggaggcgtgtattattactgcagctcatatgcgaggcagactacgctacgtccccagtcgtgtacgtcggttccgggccgggggaccgaaggtccgtcgtacccgtccgtacggtaccgacggaccccgaacggtccgtccgtccccccg

SEQ ID NO: 236995 - DNA, 698 bp, Homo sapiens
  misc_feature: GYAE6OF01B6DQW.5.24.C02.1.454.CMB.1.raw
  modified_base (255)..(255): a, c, t, g, unknown or other
  misc_feature (255)..(255): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctcctgcactgcaaccagcagtgacgttggtggttcgaagttntgtctcctggtaccaacaaccacccgacaaacgcccccaactcatcattttgagtcactacgcgaccctcacgggtccctgactcgcctttctctcggcttccgaacgtctcggactaaccgaccggtccctcccgtcggacccgtcgttccgtcgggtcctaccgacgggccttggaacgggtagtagggacggtcgtacgtaacttttacgttacgtcgtacgacgtccgtactaacgttatcgacgtaacgggtactaacggaccgtaaggtacccgaaccgttacccccgtaagttcggttacggttaacgttcccgggttaccggggggacccgggggggtaaaccctagggtcccggtaccggtacccggttacccggttaacggtaccggaaccgtaccccggaaacgggtccccgtcccggttaccccccccggg

SEQ ID NO: 236996 - DNA, 649 bp, Homo sapiens
  misc_feature: GYAE6OF01ENRRV.5.24.C02.1.454.CMB.1.raw
  modified_base (256)..(256): a, c, t, g, unknown or other
  misc_feature (256)..(256): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcagcctccctccgcgtccgggtctcctggacagtcagtccaccatcctcctgcactgcaaccagcagtgacgttggtgttacgaagtntgtctcctggtaccaacaaccacccgacaaacgccccaaactcatctattttgagtcactacgcgaccctcgacgggtcctgactcgtcttctcgtggcctccgaagtcgtggacaaccgaccggtccctcccgtacgacccgtcgtacgtcgggtcctaccgacggtctaggaaggtagtggacggtctagtaagtttacttacgtcgtacgacgtcctacgtaattcgtcgacgtaacggacacggaccgtacgaccgttaaccggtacccctagttcggtacgtacgttccgggttaccgggggaccgggggtaacctaagggtccgtaccggtaccccgtacgtaacggtccaaccggaccccgtaacggcccgtcccgtaccccccgg

SEQ ID NO: 236997 - DNA, 773 bp, Homo sapiens
  misc_feature: GYAE6OF01AEXDO.5.24.C02.1.454.CMB.1.raw
  modified_base (238)..(238): a, c, t, g, unknown or other
  misc_feature (238)..(238): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcacgccctccctccgcgtcccgggtctccgtggacagtcacgtcaccatcctcctgccactgaccaaaccngcagtgtacggtttggtggttacgaagttatgtcctcctacggtaaccaaccaaccaaccccgaacaaacccgaccccctaaactctactacttagtttttacggaacgtcctaactaccgccgtacccgtcggaccggggttccctcgtacgtcgtccttcctcgtcgtcctaccgtaacgtccgtacggacctaaccgacccggtcccttccccgtacgtacccgttccgtcggtccggtcccgtacccgtagggtccgtagggtacggtacgtcgggaggttacgttagttaagttttaacgttaccgtagtaccgtacgtctacgtaagtacgtcggtacgacggtaccgagaccgtaccgtacctacccgtacccgtagttaccggttacggtccggttacccggggtaccggggggtaaccggggtaccctaacgggttcccgtaacccggggtaccccgtttaccggtaccgggtaccgaccccggtaaacccgggtcccggttcccgtcccccggttaccccccggg

SEQ ID NO: 236998 - DNA, 588 bp, Homo sapiens
  misc_feature: GYAE6OF01AZK68.5.24.C02.1.454.CMB.1.raw
  modified_base (254)..(254): a, c, t, g, unknown or other
  misc_feature (254)..(254): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctcctgcactgcaaccagcagtcgacgttggcggttcaagttntgtctcctggtaccaacaacacccgacaaacgccccaaactcactctattttgaggtcactacgcgaccctcgacgggtccctgatcgcttctctgctcaagtctgcaacgacgcctcctcgacccgtctcgtgggcctccgacggtctcggaggtactggacggtctgtaattacttaactgctacgctctatatcgcgacgcacgcacgcgaccgtccccgagtcgtgtacgttcgttaccgggggaccggggtaaccgaacggtccgtcggtacccgtaccgttacggttaccgaccggtacccgaacgggtcccgtcccggtacccccgg

SEQ ID NO: 236999 - DNA, 771 bp, Homo sapiens
  misc_feature: GYAE6OF01BFJTG.5.24.C02.1.454.CMB.1.raw
  modified_base (260)..(260): a, c, t, g, unknown or other
  misc_feature (260)..(260): n is a, c, g, or t
  modified_base (305)..(305): a, c, t, g, unknown or other
  misc_feature (305)..(305): n is a, c, g, or t
  modified_base (383)..(383): a, c, t, g, unknown or other
  misc_feature (383)..(383): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcacgccctcctccgcgtccgggtctcctggacagtcagtcaccatcctcctgacactgaccaccagtcagtgtacgttggtggttacgaagttntggtctcctaggtaccaacaaccacccgaacaaacgaccccaacncatctattttgacgtcactacgccacctcgacgggtccctgtactccgtcttctcgtcggtcctaccgtaacgttcgnggtaccaacgtaccggtccctaccgtcgtacccgttgtccgtacgggccttccgacggtcgtacggacgtacgtagggtacggtacgtacggtattttaacgttacgttaggtcctaacggtccttacccgtaatttaggtccgacggttaacgggaaccctaggacccggtaacggttaccctacccggttaaccccccgttaagttcggggtttaacccgtaaccggttttcccggggttaacccggggggtacccggggggaaaccgtaaaccgggttcccgggtacccgggtacccccggtttaacccggtttccgggtaaacccccggacccggttaacccccggtaaacgggtcccccggttaaccccgggttccccccggg

SEQ ID NO: 237000 - DNA, 619 bp, Homo sapiens
  misc_feature: GYAE6OF01EI9LL.5.24.C02.1.454.CMB.1.raw
  modified_base (199)..(199): a, c, t, g, unknown or other
  misc_feature (199)..(199): n is a, c, g, or t
  modified_base (254)..(254): a, c, t, g, unknown or other
  misc_feature (254)..(254): n is a, c, g, or t
tcagatcagacacgcacgaccggtgctcgatttagtacagatcgttagggaaaggggggggtctcaggaggcagcgctctcagaacgtcaccaccatggcctgggctctgctcctcctcaccctcctcactcagggcacagggtcctgggcccaggctgccctgactcagcctccctccgcgtccgggtctcctggacngtcagtcaccatcctcctgcactgcaaccagcagtgacgttggtgttacgaagtntgtctctgtaccaacaaccacccgacaaacgccccaaactcatctatttttgacggtcactacgccgaccctcgacgggtccctgactcgtcttctctcggtctccaagtctcggacaacgaccggtccctccctcgaccgtctcgtcgggtcctccgacggtctaggacggtatggacggtctagtatttacttactgcagtctactatagtgacgagcagcgacgctaccgtcccagttcggtagtacgttcgggttaccggggaccgggggtaacctaagggtccgttccgggtacccgttacccggtaacggttaccgaaccggaccccggtaacggtcccgtccccggtacccccccggg

SEQ ID NO: 237001 - DNA, 554 bp, Homo sapiens
  misc_feature: GYAE6OF01EX6YK.5.24.C02.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (440)..(440): a, c, t, g, unknown or other
  misc_feature (440)..(440): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctcctgcactgcaaccngcagtgacgttggtgttcgaagtntgtctcctggtaccaacaacacccgacaaacgccccaaactcatctattttgaggtcactacgccgaccctcgacgggtccctgactcgcttctctggctcagtctggcaacgacgcctcctcgaccgtctcgtcggcctccgagctggaggtatggaggctagtatttacgtactgacgagtctanatactgacgagcagcacgctacgtcccagtcgtgtacttcggtaccggggacgggtaccaggtccgtcggacccgtcgtacggtccgacgaccgacgggtcctcccggtccccg

SEQ ID NO: 237002 - DNA, 671 bp, Homo sapiens
  misc_feature: GYAE6OF01DDX7D.5.24.C02.1.454.CMB.1.raw
  modified_base (255)..(255): a, c, t, g, unknown or other
  misc_feature (255)..(255): n is a, c, g, or t
  modified_base (281)..(281): a, c, t, g, unknown or other
  misc_feature (281)..(281): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcagccctcccgtccgcgtccggtctccgtggacagtcagtcaccatctcctgcactgacaaccagcagtgacgttggtgtcgaagtntgtctctggtaccaacaccacccganaaccgccccaatcatctattttgagtcactacgccaccctcgacgggtccctgactcgtcttctcgtggcctccgaacgtcgtacggaccaacgcccggccttaccccgtggtacccgttcctacggtcggggtaccttccggaggtaccgtcgggaacggtacgtacgggacggtcgtacgttaatttacgttaccgtaggtacgtacgtccgttaacgtaacgttacgtacggaccggtaagggtaccgaacggtccgaaccggaccgtacccgttaccccgtagtacgggttcgtaacgttccgggttaccgggggaccggggtaactacggtcgtaccggtaccgtcgtacggtccgacgcccgtacggtccgtcccggtaccccg

SEQ ID NO: 237003 - DNA, 698 bp, Homo sapiens
  misc_feature: GYAE6OF01DFA9Z.5.24.C02.1.454.CMB.1.raw
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctcaccctcctcactcgagggcacgagggtcctgggcccaggcctgccctgactcacgccctccctccgcgtccgggtctccgtggacngtcagtcaccatctctgcactgaccaacngacagtcgtacggttggtggttacaagtatcgtctacgtcgtaaccaaccaaccacccgaacaaccgaccccaaactcacttcttattttcgacgtccacgtacgaccgtaccgtcgtacgggtcctgtactccgtcttctcgtcgcctaccgtagtcgtacggacaacgtccgtccttccgtcgtaccgtcgtcgtcggcctcgacgtcgtggagtagtggacgtcttagtaacgtttactacgtgtactcgtactacgtactagacgtacggacgacgacgtcgacgtccgtaccgttaccctaggttcgtacggttaccggttaccggggtacccggggggaacgggtaaacccgtacgggtccggttacccgggttaaccccggttcccgggttaacgggtacccgggtaacccggtaacccgggtaaccggttccccgttacccccgggtacccccgg

SEQ ID NO: 237004 - DNA, 604 bp, Homo sapiens
  misc_feature: GYAE6OF01BGQGI.5.24.C02.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (335)..(335): a, c, t, g, unknown or other
  misc_feature (335)..(335): n is a, c, g, or t
  modified_base (411)..(411): a, c, t, g, unknown or other
  misc_feature (411)..(411): n is a, c, g, or t
  modified_base (581)..(581): a, c, t, g, unknown or other
  misc_feature (581)..(581): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcagcctccctcgcgtccgggtctcctggacngtcagtcaccatctctgcactgcaaccngcagtgacgttggtgttacgaattntgtctcctaggtaccaacaaccacccgaacaaacgaccccaaatcatctattttgagtcactacgccgacctcgacgggtccngtactcgtcttctctcggctaccgaatcgtacgtcaacgccggtcctcccgtgaccgtctcgtcgggtcctaccgnggctaggacgtagtgacggtcttagtaactttagttacgtgaccgtactactacagttatcgacgtacgggcaacgcgtaacgtcctacgtcccgatcgtgtacgttcggtccggggacgggaccgtaaggtccgtaccggtaccgtccgtacggtacccacggaacccncggtcccgtccggtaccccccgg

SEQ ID NO: 237005 - DNA, 615 bp, Homo sapiens
  misc_feature: GYAE6OF01E43XF.5.24.C02.1.454.CMB.1.raw
  modified_base (228)..(228): a, c, t, g, unknown or other
  misc_feature (228)..(228): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttacgaagttatgtctccgtggtaccaacaaccaccccgaacaaacgcccccaaactcatctattttgacgtcactacgcgtaccctcgacgggtccctgactccgtcttctcgtcggcctccgaagtctggaccaacgccggtccctcccgtcgtacccgtcgtcgtcggccttccgaggctggaggactggagctagtaatttactactcgctagtcctcgtaatactgacgagacgtacgcctacgacctaccgtcccagtcggtagtacgttccggtaccgggggaccgggggtaccctaaggcccgtcggtaacccgtcgtaccgggtaccaccggacccgaacggtcccgtcccggtccccccgg

SEQ ID NO: 237006 - DNA, 606 bp, Homo sapiens
  misc_feature: GYAE6OF01C6J6W.5.24.C02.1.454.CMB.1.raw
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcagcctccctccgcgtccgggtctcctggacagtcagtcaccatcctcctgcactgccaaccngcagtgacggttggngttcgaagtatgtctctggtaccaacaacacccgaacaaacgcccccaaatcatctattttgagtcactacgccgaccctcgacgggtcctgactcgcttctctcgctaccaagtctgacaacgaccggcctcccgtgtaccgtcgtcgtcgggaccttccgaggcgtgagtagtggaggtcgtagtaattacttacgtcgactagctactatacgtgacgtacggcgacgacgtacgacctaccgtacccctagtcgttcgtacgttccggttcgggggaccgggggtaccaacggtaccgtcggtacccgttacgtacggtacaaccggtacccgaaccggtcctcccggtacccccg

SEQ ID NO: 237007 - DNA, 734 bp, Homo sapiens
  misc_feature: GYAE6OF01DX5LA.5.24.C02.1.454.CMB.1.raw
  modified_base (240)..(240): a, c, t, g, unknown or other
  misc_feature (240)..(240): n is a, c, g, or t
  modified_base (485)..(485): a, c, t, g, unknown or other
  misc_feature (485)..(485): n is a, c, g, or t
  modified_base (533)..(533): a, c, t, g, unknown or other
  misc_feature (533)..(533): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacgagggtcctgggcccaggctcgccctgactcacgccctcccgtccgcgtccgggtctccgtggacagtcagtccaccatcctcctgcactgaccaaaccngcaggtcgtacggttggtcggttacgaagttcttgtcctaccgtaggtaacccaaacaacccaaccccgaacaaaaccgacccccaaactcaattcttaagtttttgacggttacaaccgtacgacccgacccgtacggaccgggtccctagtacgtccgtcttcctcgtcggtacctacgtaacgtccgtaggacaaaccgtccggccttacccgtacgaccgttcgtacgtccgggctaccgngtacgtaggacggagtaggagtcttaaggttaatttaacgtttaccgngtaccgtacgtacttactaatagtaccggagtacgaacgacggacctaacggcccgttaaccgtaccccgttaggtaccggttagtacccggtttccggttaccggggggaaccggggtaacctaaggtccggtaaccggtaccccgtacggtaaccggtccgaaccgacccggaacggtcccgtccccgggttacccccg

SEQ ID NO: 237008 - DNA, 676 bp, Homo sapiens
  misc_feature: GYAE6OF01ENK7W.5.24.C02.1.454.CMB.1.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
tcagatcagacacgcacgaccggtgctcgatttagtacagatcgttagggaaagggggggtctcaggaggcagcgctctcaggacgtcaccaccatggcctggctctgctcctcctcaccctcctcactcagggcacagggtcctgggcccaggctgccctgactcagcctcctccgcgtccggtctcctggacagtcagtcaccatctcctgcactgcaaccngcagtgacgttggtgttcgaatntgtcnctcggtaccaacaaccacccgacaaacgccccaaactcacttcatttttgagttacactacgcgacctcgacgggtccctgactcgtcttctcgtggctcgaagtctggacaacgacggcctccgtacgaccgtctacgtcgggctccgaggtcctaggacggtacgtcggtacgtcgtacgtaatttacgttacgttacgactaacgtccgtaccaagttaactcggacgaagggaccgtaacggccgaacggtacccgtaaccggtacccccgtaagttccggtagttaaccgtcccgttacccggggggacccggggggtaaacccgtaagggtcccggttaccggaacccgggtttcccggtaacggttccgaacccggaccccgttaaacggggtcccgtaccccggtacccccccggg

SEQ ID NO: 237009 - DNA, 641 bp, Homo sapiens
  misc_feature: GYAE6OF01EP5T2.5.24.C02.1.454.CMB.1.raw
  modified_base (229)..(229): a, c, t, g, unknown or other
  misc_feature (229)..(229): n is a, c, g, or t
  modified_base (451)..(451): a, c, t, g, unknown or other
  misc_feature (451)..(451): n is a, c, g, or t
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
  modified_base (526)..(526): a, c, t, g, unknown or other
  misc_feature (526)..(526): n is a, c, g, or t
tcagatcagacacgcacgaccggtgctcgatttagtacagatcgttagggaaaggggggggtctcaggaggcagcgctctcaggacgtcaccaccatggcctggctctgctcctcctcaccctcctcactcgaggcacgagggtcctgggcccaggctcgccctgactcactcctccctccgcgtccggtctcgtgacagtcagtcaccatctcctgcactgacaaccngcagtgtacggttggtaggttacgaagttatctccgtcgtacgtaaccaacaaccgacccgaacaaaccgaccccaaactctaagttcttagttttgacgtaccacgtaccgccgtaacccgtcggacggttcccgagtacgttccgtccttacgtcgtcgacctacgtacgtcgtacggaccaacgtacccgtcctccgtcgtaccgtcgtcgtcggtccncgtaggctggacgtagtggagtacgtagtaacgttactcgngcgactntacagttcgagtacgagtaccagaccngtaacccgctacccgtagtcgtacggtacgttccggggtacggggacccggtaacgacgtcggtaacccgtacgtcgtaacggccgtacgaaccgtcggcccttcccggtacccg

SEQ ID NO: 237010 - DNA, 629 bp, Homo sapiens
  misc_feature: GYAE6OF01EKN31.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctcgcgtccgggtctcctggacagtcagtccaccatctcctgcactgcaaccagcagtgacgttggtggttacgaagttatgtctcctggtaccaacaaccaccccgaacaaacgccccaaactcatctattttgaggtcactacgcgaccctcgacgggtccctgactcgcttctctcggctccaagtctcgacaacgacggtccctcctcgaccgtctcgtcggcctccgaggctggaggtcgtggacggtctagtatttaactttacgtcgaccgtagtccttactaattacgtcgacgtaaggaccacggaccgacgacctaccgtcccctaagtcgtgtaacgttccgggttaccggggaccgggggtaacctacggtaccgtccgggtacccgttacccggtacggttaccgaaccggaccccgtaagggcccgtcccggtccccccg

SEQ ID NO: 237011 - DNA, 798 bp, Homo sapiens
  misc_feature: GYAE6OF01BSPVN.5.24.C02.1.454.CMB.1.raw
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (270)..(270): a, c, t, g, unknown or other
  misc_feature (270)..(270): n is a, c, g, or t
tcagatcagacacgcacgaccggtgctcgatttagtacagatcgttagggaaaggggggggtctcaggaggcagcgctctcaggacgtcaccacatggcctgggctctgctcctcctcaccctctcactcgagggcacgagggtcctgggcccaggctcgccctgactcacgccctcccgtccgcggtccggtctccgtaggacagtcagtcaccntctccngcactgaccaactggctaggtgtacggtttgggtcggttacgaagttntcgttcttccgtacggtaaccaacaaccgaaccccgaacaaaccgacccccaaactcaacttctaagtttttgacggttcacgtaccgaccgtaacccgtcggtaccggggtcctacgtacgtccgtctttccgtcgttcggtacctacctaaacggtcgtacggaccaaccgaccggtccctacccgtcgtacccggttcgtccgtcgggtccctaccggtacggtccgtaggtacgggacggttacggtacgggtacgtttaggttaactttacgttaaccgtcgggtaacctacgttaccttaccgtaaagttcgtaccggacgtaaccgggacgaacccgtacggaaccgtaccgtaacccggtaccctaacgttcggtaaacgttccggttacccgggggttaccggggggaacccggggttaaccgaaccggtccgggttaacccggtacccgggttacccgtaacgggttcccgaacccggttaccccggagggttacccctccccggggttaaccccccg

SEQ ID NO: 237012 - DNA, 585 bp, Homo sapiens
  misc_feature: GYAE6OF01DOQND.5.24.C02.1.454.CMB.1.raw
  modified_base (255)..(255): a, c, t, g, unknown or other
  misc_feature (255)..(255): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctcctgcactgacaaccagcagtgacgttggtggttcgaagtntgtctcctggtaccaacaaccacccgaacaaacgcccccaaatcatctattttgaggtcactacgccgaccctcgacgggtccctgactcgtcttctctggcctccaagtctacggacaacgccggtccctcccgtcgtaccgtctcgtcggcctccgaggtctggacgtgtgaggtctagtatttacttacgtgctagtctctatatgcgagcgagcgagcctacgtccctagtgtcgtacgttccggtccggggaccggggtaaccaggtccgtcggacccgttccgtaacggtccgacgtcccgaacgggtccttcccggtcccccg

SEQ ID NO: 237013 - DNA, 607 bp, Homo sapiens
  misc_feature: GYAE6OF01A2DKE.5.24.C02.1.454.CMB.1.raw
  modified_base (229)..(229): a, c, t, g, unknown or other
  misc_feature (229)..(229): n is a, c, g, or t
  modified_base (349)..(349): a, c, t, g, unknown or other
  misc_feature (349)..(349): n is a, c, g, or t
  modified_base (390)..(390): a, c, t, g, unknown or other
  misc_feature (390)..(390): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctcaccctctcactcagggcacagggtcctgggcccaggctgccctgactcacgcccccctcgcgtccgggtctcctggacagtcagtcaccatctcctgcactgccaaccngcagtgacgttggtggttcgaagtatgtctcctggtaccaacaacacccgacaaacgcccccaaactcatcatttttgaggtcactacgcgaccctcgaggggtccctggactcgcttcnctcggctccaagtctggcaacacggccctcctcgacccgtntcctgggcctccaggctgaggagtggacggtctgtatttaacttactcgacgtagctctatagtgcgtagcacgcacgtcaccgttcccagtcgtgacgttcgggttaccggggaccgggggtaccgtaaggtcccgtaccggtaacccggttacccgtagggttacccgaacggaccccggtaacgggccccgttcccgtccccccggttacccgg

SEQ ID NO: 237014 - DNA, 588 bp, Homo sapiens
  misc_feature: GYAE6OF01AZL8U.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (365)..(365): a, c, t, g, unknown or other
  misc_feature (365)..(365): n is a, c, g, or t
  modified_base (443)..(443): a, c, t, g, unknown or other
  misc_feature (443)..(443): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagtntgtctcctggtaccaacaaccacccgacaaacgaccccaaactcatctattttgagtcactacgcacctcgacgggtcctgactcgtcttctcgtgctcaagtctggacacncgcctcctcgaccgtctcgtcggctccgaggctcggaggtagtggaggctagtattacgttactgcagtctctaagtntcgcgacggacacgtcgacgtccgtaccgtcccgtagtcgtagcgttccggtcggggaccgggggtaactacggccgtaccggtacccggttaccgtacggtaccgaccggaacccggaaccgggtcccgtcccggtccccccgg

SEQ ID NO: 237015 - DNA, 671 bp, Homo sapiens
  misc_feature: GYAE6OF01B9PAO.5.24.C02.1.454.CMB.1.raw
  modified_base (215)..(215): a, c, t, g, unknown or other
  misc_feature (215)..(215): n is a, c, g, or t
  modified_base (262)..(262): a, c, t, g, unknown or other
  misc_feature (262)..(262): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctcaccctcctcactcagggcacgagggtcctgggcccaggctgccctgactcacgccctccctccgcggtccggtctccgtggacagtcagtcaccntctctgcactgacaaccagcagtgtacggttggtaggttcgaagttntcgtctccgtacggtaaccaacaaccacccgaacaaacccgaccccaaactcactacttagttttcggacgtccaacgtaccgccgtacccgtcggaccgggtcctagactcgtcttccgtcgtcgtcctaccgagtcgtacggacaaccgccggcctccgtacgtacccgtctcgtcgggacctacgacggtctaggacggtatgggagtcgttagtaactttacgtacgtgtaccacgtcctactacgttagtcgacgaacggacaacggcgtacgaccgtaccgtacccgtagtcggtacgtacggttccgggtaccgggggaaccgggtaccgaacggtcgtaaccggtacccgttacggtacggtaccgaccggtacccgacggtcccgtcccggtacccccgg

SEQ ID NO: 237016 - DNA, 664 bp, Homo sapiens
  misc_feature: GYAE6OF01BZ8U6.5.24.C02.1.454.CMB.1.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcagccctcctccgcgtccgggtctcctggacagtcagtcaccatcctcctgcactgccaacngcagtgacgttggtggttcaagtntgtctcctcggtaccaacaaccaccccgaacaaacgcccccaatcatctattttgagtcactacgcaccctcgacgggtcctgactcgtcttctctcggtctacacgtctcggcaaccgccggtccctcccgtcgtaccgtcgtcgttcgggcctccgaggtccgtaggacggtacgtgggacggtacgttacggtaatttaactttaccgtgacgtacgtccttaacattacgtgacgacggtacaggaccacggactacccggtcccttagtccgtacggtacgttccgggttacccgggggacgggggtaaccctaacggggtccgttaccgggaccccggttaccggttaccggtacccggaacccggaccccggtaccggtcccggttccccgggtcccccccgg

SEQ ID NO: 237017 - DNA, 598 bp, Homo sapiens
  misc_feature: GYAE6OF01CEJ10.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagtntgtctccgtggtaccaacaaccacccgacaaacgcccccaaatcatctagttttgagtcactaccgcgaccctcgacgggtccctgactcgtcttctcgtcgctccagttctcggaccaacgaccggtccctcccgtgtacccgtcgtccgtcgggcctccgacggtcgtaggaggtagtacggaggtctggtaatttattacgtgctagtctacatgtacgcgtaggcagcgacgcctaccgtcccagtcggtacgtacgttccggtacggggaccggggacctaggccgtcggacccgtccgtacggtccgacgtacccgacggtcccgtcccggtacccccg

SEQ ID NO: 237018 - DNA, 797 bp, Homo sapiens
  misc_feature: GYAE6OF01BZ9XJ.5.24.C02.1.454.CMB.1.raw
  modified_base (461)..(461): a, c, t, g, unknown or other
  misc_feature (461)..(461): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctccaccctcctcactcgagggcacgagggtcctcgggcccaggctcgccctgactcacgccctccctccggccggtcccgggtctccgtcggacagtcacgtccacctactcctcctgccacgtcgaccaaccacgacgtacggttcggtacgggtttgggttacggttacgtaagttcgttcgttaccgttaccgtaccggtaaaccaaaaccgaaacccgaaccccggaaaccaaaacccgaccccctaaaactcctaacttacttttagtttttacgaacggtacctaacgacccgtaccgtaccgtccggtacgggtcccctagtaccttcgtccttcncggttccgactaccgtaacgtcgacgacctaaccgtaccggtccctaccggtccgttaccgtccgttacggtcggacccgttaccggacggtcgtacgggtaacggtacggtaggtacggtacttaacgttaaacgtttacgtacgtacgtcgtaacgtacctagtaacgttacgtaccgacggaacggtacgacgaccgacgtaccgtacccgtaccgtatccggtacggttaccggtcgggtaccggggaccggacgtacccggtacgtccggtacccgttacgaacccggtaccgaccggtaacccgtcggtacccggtccccggtaccccgg

SEQ ID NO: 237019 - DNA, 707 bp, Homo sapiens
  misc_feature: GYAE6OF01DL44L.5.24.C02.1.454.CMB.1.raw
  modified_base (227)..(227): a, c, t, g, unknown or other
  misc_feature (227)..(227): n is a, c, g, or t
  modified_base (254)..(254): a, c, t, g, unknown or other
  misc_feature (254)..(254): n is a, c, g, or t
  modified_base (555)..(555): a, c, t, g, unknown or other
  misc_feature (555)..(555): n is a, c, g, or t
  modified_base (655)..(655): a, c, t, g, unknown or other
  misc_feature (655)..(655): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctccaccctcctcactcgagggcacgagggtcctgggcccaggctcgccctgacctcacgtccctcccgtccgcggtcccgggtcctccgtggactacgtcagtccaccntcctcctagccacgtcgaccaaaccgngtactaggtcgtacgggttggtcgggttacgaagttctcgtccgttaccgttacggaaaccaaaccgaaaccgaacccccgaaacaaaacccgaccccctaaactctaacttactttaagttttcggacgttaccaaccgtaccgccgtaccgtcggtacgggttcctagcttccggtcttccgtcgtcgtccgtacgtaagtcgtacgaccgaaccgtccgtccctccgtacgtccgtcgtacgtcggtccaccggcggcgttaggacgtgtacggacgtactagttacttagttaccgngactacgtctacgttaatcgcgaacggtcgaccacgggtaccaccgaccgttacccgtcgtagtggttccgtaccggtccggggtacggggacgtaaccnggtaccgtccgacgttccggtacgcgaccggtaccgcgtcccgcccgtcccg

SEQ ID NO: 237020 - DNA, 784 bp, Homo sapiens
  misc_feature: GYAE6OF01DPR2Z.5.24.C02.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (523)..(523): a, c, t, g, unknown or other
  misc_feature (523)..(523): n is a, c, g, or t
  modified_base (562)..(562): a, c, t, g, unknown or other
  misc_feature (562)..(562): n is a, c, g, or t
tcagatcagacacgcacgaccggtgctcgatttagtacagatcgttagggaaaggggggggtctcaggaggcagcgctctcaggacgtcaccaccatggcctggctctgctcctcctcaccctcctcactcgagggcacgagggtcctgggcccaggctgccctgactcacgcctccctccgcgtccggtctccgtggacngtcagtccaaccntcctcctgcactgaccaaccngccagtgtacggtttgggtaggttacaagttattcgttccgtaccgtacggtaacccaaaccgaaacccaaccccgaaacaaaaccgaccccccaaatccaatcctttagtttttacggaacggttaccaacgtaaccgcccgtaacccgtcggtaccggggtccctaggtactccgtcttactcgttcgccttactaacgtcgtacggacaaaccgcccggtcccttacccgtacggtacccgttccgttacgtccgggaccttccggaggtaccgtggtaacgggngtacgggacgttcgttaacgttaacgtttacttaccgtntaccgtacgtcgttaccgtaagttacgcgacgtaacggtaccaggtaccgacgtctacccgtaccgtagtacggttaccgtacgggttccgggtcccgggggaaccgggggtaacctaacggtcccggttaacccggggaaccccgtttacgggtaaaccgggttacccgtaaacccggaccccgggttaaacgttccccggtacccccggttaacccccgg

SEQ ID NO: 237021 - DNA, 653 bp, Homo sapiens
  misc_feature: GYAE6OF01DKNY8.5.24.C02.1.454.CMB.1.raw
  modified_base (259)..(259): a, c, t, g, unknown or other
  misc_feature (259)..(259): n is a, c, g, or t
  modified_base (472)..(472): a, c, t, g, unknown or other
  misc_feature (472)..(472): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacgagggtcctgggcccaggctgccctgactcacgcctccctccgcgtccgggtctcctggacagtcagtcaccatcctcctgcactgaccaacagcagtgtacgttggtggttcgaagtntgtctcctcggtaccaacaaccacccgaacaaaccgaccccaaactcatctattttgacggtcactacgccgaccctcgacgggtcctgactcgtcttctctcggctactaacgtctacggcaacgaccggtcctacccgtcgtacccgttcttcggtacgggtcctccgaggtcgtaggacggtaagtggacgtcgtagtacttacgttacngtacgtacgtctacgtatagtcggacgtacggcgagtacgacgaccgtaccgtacccctagttacggtcgttacgttccggggttaccggggaccgggggtaacctacgggtcgtaccggtacccgtcggttaaccggtaccgtaaccggacccgtaacggtccgttccccggtaccccgg

SEQ ID NO: 237022 - DNA, 620 bp, Homo sapiens
  misc_feature: GYAE6OF01BN7EP.5.24.C02.1.454.CMB.1.raw
  modified_base (200)..(200): a, c, t, g, unknown or other
  misc_feature (200)..(200): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcatcctctcactcagggcacagggtcctgggcccaggctgccctgactcacgccctccctccgcgtccgggtctcctggacngtcagtccaccatctcctgcactgcaaccagccagtgacgttgggtgtcgaagtatgtctcctgtaccaacaaccacccgacaaacgaccccaaactcatctattttgacgtcactacgccacctcgacgggtccctgactcgcttctctcgctcagtctagcaacacggccctccctacgaccgtctcgtcgggcctccgaggtctagaggtacgtgacggtcgtagtaactttacgttacgtagtaccgtacgtccttacgaattacgttcgacgaacggtcgacggaccgacgtacccgtacccgtacccgtagttcggtacgtacgttccgggttcggggaccggggtaaccaacggtccgtaccgggtacccgttccgtacggtaccaacggcccccgtaggcccgttcccccgg

SEQ ID NO: 237023 - DNA, 810 bp, Homo sapiens
  misc_feature: GYAE6OF01CYG3Z.5.24.C02.1.454.CMB.1.raw
tcagatcagacacgcacgaccggtgctcgatttagtacagatcgttaggggaaagggggggggtctcaggaggcagcgctttcaggacgtcaccaccatggcctgggctctgctcctcctcaccctcctcactcagggcacgagggtcctcgggcccaggctcgccctgactcacgccctccctccggccggtccgggtctccgtggacagtcagtccaccatcctcctgccactcgaccaaccagccgtaggtcggtacggtttgggtcgggttacgaagttagtgttccttccgtacggtaacccaaaccaaaccgaaccccgaaccaaaacccgacccccaaaactacctacttaccttagtttttacggacgttacaaccgttaccgacccgtaccccgtccgggtaacggggttccctaggtaccgttccgtccgttccgtaccgtcggtacctaccgtaacgtccgtacggacccgtaaaccgcccggtcccctcccgtaccggtacccgtcgttccggtcggtccctacggcggtacgtaggaggtagtcggacggttacgttagtaactttacgttcgtcgtaccgtgtacctcgtaattcggacgtacggacgacgacgaccgtacgtccgtaccgttaccctaggttcggtaagttaccgggttaccgggtaccggggggaaccggggttaaccgaacggttcccgggtaacgggttcccggttaaccggtaccggggacccgtacccgggtaaccccggttaccgggtaccccggtcccccggtacccggttaccccgg

SEQ ID NO: 237024 - DNA, 738 bp, Homo sapiens
  misc_feature: GYAE6OF01DZ9J8.5.24.C02.1.454.CMB.1.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (251)..(251): a, c, t, g, unknown or other
  misc_feature (251)..(251): n is a, c, g, or t
  modified_base (288)..(288): a, c, t, g, unknown or other
  misc_feature (288)..(288): n is a, c, g, or t
  modified_base (345)..(345): a, c, t, g, unknown or other
  misc_feature (345)..(345): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacgagggtcctcgggcccaggccttcgccctgacctcacgccctcccgtccgcggtcccggtctcgtggacncgtcacgtcacctntcctccgtgactacgtcgaccaaccgngcgtaggtcgtacggtttgggtacggttacgaagttntcgtaccgtcgtacggtaaccaaccaaacccgacccgaaacaacccgaaccccaacnctaacttcttagttttacgacgtaccaccgtccgacccggtacctcggtaccgggtcctgtacgtccgtcttccgtacgttcggacctacgtaacgtcgaccggaccaaccgtccgtcctcccgtacgtccgtcgtacggtccggtcctacggtacggtcgtaggaggttacgtgggacggttactaggttaacttttacgtacgtcgtaaccgtccgtaacttacgtattacggtaccggacgacggacacggtcctaacggaccttcccggtacctgttacgtcggttaccgggtccggggtccggaaacggggaccctaaggccgttacccggtacccgtacgagggttaccccacggtacccgtaccggttccgcccccggttaccccg

SEQ ID NO: 237025 - DNA, 801 bp, Homo sapiens
  misc_feature: GYAE6OF01CE5LL.5.24.C02.1.454.CMB.1.raw
  modified_base (245)..(245): a, c, t, g, unknown or other
  misc_feature (245)..(245): n is a, c, g, or t
  modified_base (287)..(287): a, c, t, g, unknown or other
  misc_feature (287)..(287): n is a, c, g, or t
  modified_base (626)..(626): a, c, t, g, unknown or other
  misc_feature (626)..(626): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcaacgagggtcctgggcccaggctgccctgactcagtccctccctccgcgtccggtctcctggactagtcagtcaccgtatccgtcctgacctacgtcgaccaaaccnggactaggtcggtaccggtttgggtacggttacgaaaggttnttcgttccttcccgtacggtaacccaaaccaaccgaaccccgaacaaaccgaccccctaaactcctactccttaacgtttttcggacggttacctaccgtaccggtacccgtacccttccgggtaaccggggttacccttcgtaccgttccggtacctttcctccgttaccggtccttacccgtaaacggttcccggttacggaccctaaacccggtccggtaccccttaccccgtcggtaccccgttccgtcggttccgggtccctacccgggaacggtccgtagggaaccgggtaagtcgggtaacgtcgttacgtaacgtttacttacgtcgtacncgtacttcgtaatacgtcgacgacggtacacggtcaacgtccgtacctcccgtagtcggtacgtacggttccgggtcgggggaaccggggtaccgaaggttccgtccggtacccgttaccggtaaccggtcggaacccggacccgttaaccgggtcccgtacccgggtcccccgg

SEQ ID NO: 237026 - DNA, 840 bp, Homo sapiens
  misc_feature: GYAE6OF01A7OW3.5.24.C02.1.454.CMB.1.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctcgccctgactcagcctccctccgcgtccgggtctctggacngtcagtcaccatcctcctgcactgaccaaccngcagtgtacggttgggtggttacgaagttatgtcctccgttacggtaacccaaaccaaaccgaccccgaacaaaaccgacccccctaaaactctaacttcttatttttacggacggttaccaaccgtaccggacccgtaccccgtcggtaccggggtcccctagacttccggtcctttccttcgtcgtccctaccgtaacggttccgtacggacctaaacccggtcccgggtaccccttaccccgttaccgggtaccccgtttccgtccggttccggggtacccttacccgggtacgggttaccgtagggaacgggtacgttacgggaacgggttaccgttaggttaaacttttaacgtttaaccggtcggtacccgtaacgttccctaacgttaagtttacgtacggcgtacgggaccgtacggaccgtacgtaccgtaacccgttacccaaggttcggttaccgtacggtttcccggggtaaccggggggtaacccggggaacccgtaagggtacccggttacccgggtacccggttacccggtaccgggttacccgaaccggtaaccccgggtaaccggtccccggttaaccccggttacccccgg

SEQ ID NO: 237027 - DNA, 735 bp, Homo sapiens
  misc_feature: GYAE6OF01CP3FX.5.24.C02.1.454.CMB.1.raw
  modified_base (80)..(80): a, c, t, g, unknown or other
  misc_feature (80)..(80): n is a, c, g, or t
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
tcagatcagacacgcacgaccggtgctcgatttagtacagatcgttagggaaaggggggggtctcaggaggcagcgctcncaggacgtcaccaccatggcctgggctctgctcctcctcaccctctcactcgagggcacgaggtcctgggcccaggctgccctgactcagccctccctccgcgtccggtctcctggacagtcagtcacatctcctgcactgacaaccngctagtgtacgttggngttacgaagtntgtctcgtaggtaaccaacaaccaccccgaacaaaccgacccccaaaacttcaacttccttaattttggacgtccaacgtaccgccgaacctcggacgggtccctagactccgtcttcgtctcggactacgaagtctacggacaaaccgccggtcctcccgtacgtacccgttcgtcgtcgggcctccgacggtcgtaggaacggtagtacggaggtcgttagtaacgtttacttacgtacgacgtacgcgttactaacgttaacgtcggtaccgtaaggaccgtacggaaccgtacggtaccgtaacccgtaccccgtaaggttccgttacgggtaaccgtttacccggggttaccggggggaacccgggggtaaaccgtaacgggtacccggttaccggtaacccggttacccggttacgggttacccgaccggtaaccccggtaaccgggtacccgttccccgggttaccccccggg

SEQ ID NO: 237028 - DNA, 821 bp, Homo sapiens
  misc_feature: GYAE6OF01EH265.5.24.C02.1.454.CMB.1.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
tcagatcagacacgcacgaccggtgctcgatttagtacagatcgttaggggaaaggggggggggtctcaggaggcagcgctctcaggacgtcaccaccatggcctgggctctgctcctcctcaccctcctcactcgagggcacgagggtcctgggcccaggctcgccctgactcacgccctccctccgcggtccggtctccgtggacngtcacgtcaacctntcctcctgccactcgaccaaccagcaggtgtacggttgggtggttacgaagttntgtcctcgtacggtaaccaaaccaaccgaaccccgaacaaaacccgaccccctaaaactctaacttactttacgttttacggacggttacctaaccgtaccggaccgtaacccgtccggtaaccggggttccctaggacttccggtcctttccgtcgtcggtacctaccgtaaggtccgtacggacctaaccggtccggtaccctcccgtacggtacccgttcgtccggtcggcccgtaccgtacggtccgtagggacggtacgtacggtaggtcgttaagttacgtttacgtaccgtacgaccgttacgtacgttaccttaacgtacgtcggaccggtacggtacctaacggtaccggtaaccgtaccgtaacccgttaccccggtaagttccgggtacgggttaccggtttcccgggggtaaccggggggtaccgggggtaaacctaacgggttcccggtaaccggtacccgggttaccggtaaccgggttacccgaacccgggtacccggtacccgggtccccgttaccccgggtcccccgg

SEQ ID NO: 237029 - DNA, 790 bp, Homo sapiens
  misc_feature: GYAE6OF01BYCZ1.5.24.C02.1.454.CMB.1.raw
tcagatcagacacgcacgaccggtgctcgatttagtacagatcgttaggggaaaggggggggtctcaggaggcagcgctctcaggacgtcaccaccatggcctgggctctgctcctcctcaccctcctcactcgagggcacgagggtcctgggcccaggctcgccctgactcacgcctccctccgcgtccgggtctccgtggacagtcagtcaccatctcctgcactcgacaaccagcaggttgtacggttgggtaggttacgaagttgtcgtctccgtacggtaaccaaacaaccaacccgaacaaaccgacccccaaactctaacttctagtttttcgacggtcacgtaccgcgtacccgtcggtacgggtccctagtacttcgtcctttcgtcgtcggtacctaccgtaacgttcgtacggtaccgaaaccgtaccggtaccccttacccgttacggaccccgtttcgttaccggtcgggtcccgttaccggaacgggtccgtaggtaacgggtacggtacgggtaacggtacgttacggttaaacttttacggttaaccgtacgtaacggtaccggttaccttaccgtaagttacggtacggaccgtaacgggaccgaaccggtaccaacggtacccgttaaccggttacccctaggttacggtaccgttacggttcccgggtaacgggggtaccggggtaaccacgggtaccggttaccgggacccgttaccggtacgggtaccaaccggtaccccggaggttccccggccccggttacccccgg

SEQ ID NO: 237030 - DNA, 620 bp, Homo sapiens
  misc_feature: GYAE6OF01AWPXF.5.24.C02.1.454.CMB.1.raw
  modified_base (252)..(252): a, c, t, g, unknown or other
  misc_feature (252)..(252): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcacgcctccctccgcgtccgggtctcctggacagtcagtcacatctctgcactgcaacagcagtgacggttggtggttcgaagtntgtctctagtaccaacaaccacccgaacaacgaccccaactcactctagttttgacgtcactacgccgaccctcgacgggtcctgtactccgtcttctctcggtcctacacgtcgtcgaccaacgaccggtccctccgtcgtacccgttcgtcgtcggcctccggagcgtggaggtagtcggacgtctacgtatttacgtactcgacgacgtctactagtacgtcgacgacggacacgtaccgacgacctaccgtaccctagttcggtacgtagttcccgggtcggggaccggggtaacctaggtaccgtcggtacccggttacggtaccggtaccgaccggtaccgacggtcccgtccgtcccccgg

SEQ ID NO: 237031 - DNA, 654 bp, Homo sapiens
  misc_feature: GYAE6OF01BIIHO.5.24.C02.1.454.CMB.1.raw
  modified_base (209)..(209): a, c, t, g, unknown or other
  misc_feature (209)..(209): n is a, c, g, or t
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (278)..(278): a, c, t, g, unknown or other
  misc_feature (278)..(278): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcaggcacagggtcctgggcccaggcctgccctgactcagcctccctccgcgtccgggtctccgtgacagtcagtcacntcctctgcactcgacaaccngctagtgtacgttggtgtcaagtntgtctctgtaccaacaccacccganaacgaccccaatcactactattttgacgtcactacgcgacctcgacgggtcctgactcgtcttctcgtgctacgaacgtctggacacgaccggtccctcccgtcgaccgtctcggtggtccctacgtacggctacggaggacgtagtacggtcttaggtatttaacgttacgtggaaccgtacgtacctacgttaacgtgtaccggcgaacgcgacggtaccgtacggtaccctaacccgggtttcccaggttcggttacggtaaccggtcgggtttccggggggaccggggtaccgtaacggtccggttaccggtacccgggttaccgtacgggtcccaacggttacccgacggtcccgtcccggtaccccccgg

SEQ ID NO: 237032 - DNA, 646 bp, Homo sapiens
  misc_feature: GYAE6OF01DGWAJ.5.24.C02.1.454.CMB.1.raw
  modified_base (365)..(365): a, c, t, g, unknown or other
  misc_feature (365)..(365): n is a, c, g, or t
  modified_base (397)..(397): a, c, t, g, unknown or other
  misc_feature (397)..(397): n is a, c, g, or t
tcagatcagacacgcacgaccggtgctcgatttagtacagatcgttagggaaaggggggggtctcaggaggcagcgctctcaggacgtcaccaccatggcctgggctctgctccctcctccaccctcctcactcgagggcacgagggtcctgggcccaggctgccctgactcacgccctccctccgcgtccgggtctccgtggacagtcaagtcaccatcctcctgcactgacaaccagcaggtgacggttggtggttacaagtatgtctcctggtaaccaacaacaccccgaacaaacgacccccaaatcatctaattttgacgtcacgtacgcgaccctcgacgggtccctgactcgacttcnctcggctcaagtctgacaacgaccggcctccngaccgtctcgcgggcctccgaggtctggaacgtagacggacggtcttagtaatttaacttacgtgacgagtacctactaatactagcgtaaggcctaagaccaagaccgtacgtaccccgtagttcggtacgtacgtccgggtttaccgggggacccggggggtaaaccaaacggtccggttaacggaccccggttaccgtaacggtaccaacggtaccccggaaggtccccgtccggtaaccccccgg

SEQ ID NO: 237033 - DNA, 788 bp, Homo sapiens
  misc_feature: GYAE6OF01EWH88.5.24.C02.1.454.CMB.1.raw
  modified_base (230)..(230): a, c, t, g, unknown or other
  misc_feature (230)..(230): n is a, c, g, or t
  modified_base (394)..(394): a, c, t, g, unknown or other
  misc_feature (394)..(394): n is a, c, g, or t
tcagatcagacacgcacgaccggtgctcgatttagtacagatcgttagggaaaggggggggtctcaggaggcagcgctctcaggacgtcaccaccatggcctggctctgctcctcctcaccctcctcactcgagggcacgagggtcctgggcccaggctgccctgactcagcctccctccgcgtccggtctcctggacagtcagtcaccatcctcctgcactgccaaccngctaggtgacggtttggtcggttacgaagttctcgtaccttccgtacggtaacccaaacaacccaaccccgaacaaaacccgacccccaaactacctacgttacttaagtttttcggacggttacctacctaccgacccgtaacccctcggtacgggttccccnggtactccgtcctttacgtcgtacggtccttaccgtaacgtccgtacggacctaaacccgtacccggtccccgttacccttacggtaccccgttcgtccgtccgggtacccttcccgaggtcccgtaggaacggtatcgggagtaccgttagtaactttacgttacgtcgacgtaacgtctacgtaacttacggtctaaccggcggtaccacggtaccgtacgtacccgtaccgttccccagttcggttacggtaccggttcccgggtaaccggggggacccgggggtaacctaaggttacccggttaccgggtaaaccccgtttaccgggtacggtacccggtaacccggtaccccggtaacgggttccccgttaaacccggttcccccccgg

SEQ ID NO: 237034 - DNA, 722 bp, Homo sapiens
  misc_feature: GYAE6OF01CLNEZ.5.24.C02.1.454.CMB.1.raw
  modified_base (244)..(244): a, c, t, g, unknown or other
  misc_feature (244)..(244): n is a, c, g, or t
  modified_base (564)..(564): a, c, t, g, unknown or other
  misc_feature (564)..(564): n is a, c, g, or t
  modified_base (600)..(600): a, c, t, g, unknown or other
  misc_feature (600)..(600): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacgagggtcctgggcccaggctcgcctgactcacgcctccctccgcggtccgggtctccgtggactagtcacgtcaccattcctcctgcctactcgaccaaaccgngcacggttcggtacggtttgggtcggttacgtaagttcgtcgttccgttaccgtacgggtaaccaaaccaacccgaaaccccgaaacaaacccgaaccccctaaactacctactactttacgttttcggacggtcctaaccgtaccgacccgacccgtcggacgggtccctagtcgtccgtcttctcgtcggtctacgtacgtcgcggacaccgaccgtccttaccgcgtaccgtcgtacgtcggtcctcggacgtcgtaggagtctagggacgtcgttagttaacttacgttacgcgttacgacgtcctaatagttacngtacgacggacacggacctacggaccttaccgtacncgtacgtcggttacggtcccgggttaccgggggaaccggggtaccgtaggtacccggttacgtacccggttacgggtaccctaccggacgtacccggtacggtcccgtccccgtaccccggg

SEQ ID NO: 237035 - DNA, 771 bp, Homo sapiens
  misc_feature: GYAE6OF01A3MML.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctggcccaggctgccctgactcagcctccctccgcgtccgggtctcctggacagtcagtcaccatctcctgcactgacaaccngcagtgacgttggtgttcgaagttntgtctcctggtaccaacaaccacccgacaaacgccccaaactcatctattttgacgtccacgtacgccgaccctcgacgggtccctgacgtccgtctttctcgtcggacctaccgaacgtcgtcggacaaccgaccggtccctccctgacccgttccgtcgtcgggtccttccgacggtccgttaggacggtagtacgggtacggtaccgttaggttaacgttttaactttaaccgtacggtaccgtaaccgttaccttaccgttaacttacgttaccgggtaccgtaaacgggccgtaacggtaccgtaaccggtacccggttaacccgtaccccccgttaggttaccggttacgttaaccggtttcccggggttaacccggggggtacccggggggtaacccgtaacccggggttacccggttccgggtaaccccgggtttacccggtaacgggttacccggtaaccggtaacccccggtaaaccggtccccggttccccggttaccccccccggg

SEQ ID NO: 237036 - DNA, 730 bp, Homo sapiens
  misc_feature: GYAE6OF01BZW78.5.24.C02.1.454.CMB.1.raw
  modified_base (268)..(268): a, c, t, g, unknown or other
  misc_feature (268)..(268): n is a, c, g, or t
  modified_base (352)..(352): a, c, t, g, unknown or other
  misc_feature (352)..(352): n is a, c, g, or t
tcagatcagacacgcacgaccggtgctcgatttagtacagatcgttagggaaaggggggtctcaggaggcagcgctctcaggacgtcaccaccatggcctgggctctgctcctcctcaccctctcactcaggcacaggtcctgggcccaggctcgccctgactcagccctcctccgcgtccgggtctccgtggacagtcagtccaacctatcctccgtgctaactcggaccaaacctagcaagtgtacgttgggtagttacgaagttntgtctccgtcggaaccaaacaaccacccgacaaacgaccccaactcatctattttcgagttcactacgccacctcgacggtccngactccgtcttctctgcctacaagtctacggacaacgccgcctacctcgtaccgtcgtcgtcgggtctaccgaggccgtaggagtacgtaggtacggtacctaaggtaccttttaataacgtcgaacgtacgtctacgtaacgttagtacgaccggtaacgacgacggaaccgtaccggaccgtaaccggttaccccgtaagtttggttacggtaaacggtttccccggggttaacggggggtaaccccgggggaaaccgttaaccgggaccggtttaacccgggtaaccccggtttacccgtttaaaccggggaccccttaacccgggaacccccggtaaagggttcccccggttaccccgggttaacccccccggg

SEQ ID NO: 237037 - DNA, 946 bp, Homo sapiens
  misc_feature: GYAE6OF01BH1HV.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctctcactcgagggcacgagggtcctcgggcccaggctcgccctgactcacgccctccccgtcgtccggtccggtcctcgtacggactcgtctacgtccaacctctcctccgtcacctacgtaccgaaccaccgtacgacgtacgggttaccggttacgggtttgggttacggttaacgtaacggtttcgttccggtttacccgttaccggttaaacccggtaaacccaaaacccgaaacccccggtaaacccgaaaaccaaacccccgaacccctaactaccttacgtttaacgtttttacggtttaaccgggtacgttaacccgaccggttacccggtacccggtaccccggtacggggttaccggggtaccttagttacccgttccgtttacccttccggtaccggtaccgttaccctacgttaaccggttacggaccgaaacctccccgggttaccctccccgttaccggtacccgggttacctttcggccggttccggtaccggcggtacggtgtaccggaggtacgtacgggagttcgttaacgttactttaacggtcgtacgtaccgtacgtaccttacgtacgtacggtacggacggacgtaaccggtacgaaccggttaccggacccggtttaccgtaaccggtttaggttaaccggtccgtttaaccgggggtccgggggtttacccggggggaaccgggttaacccgtacgggtaacccgggttccccgggtaacccggtttacccggaaccggggtacccggaaccccggggtaacctacccgggttccccgggttcccccggtaccccggg

SEQ ID NO: 237038 - DNA, 831 bp, Homo sapiens
  misc_feature: GYAE6OF01B2VA8.5.24.C02.1.454.CMB.1.raw
  modified_base (237)..(237): a, c, t, g, unknown or other
  misc_feature (237)..(237): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcacgcctccctccgcgtccgggtctccgtggacagtcagtcaccatcctcctgcacgtcgaccaaaccngcaggtgtacggtttggtcggttacgaagttgtcgtctccgtacggtaacccaaaccaacccgaaccccgaacaaaacccgaccccctaaaactcctaacttcttagtttttacggaacggttacctaaccgttaaccggaccgtaaccccgtcggtaccggggttaccctagtaccgttcgtcctttcgtcgtaccggtacctaccgtaacgttccgtacggaaccgtaaacccgacccgggttcccttaccccgtacggtacccgttccgttccggttccgggtaccctaccggtacggtccgtacgggaacgggtacggttacgggacggttacgttaacgttaacgtttaacgttaccggttacgaccgtaacgtaccttacgtaacgttacggtacggtacgacggtacgaacggtaccgacgtacccgtacccgtaccccgtagttacgggtacggtaccggttccggggttaacccgggggaaccggggtaaccgtaaccggtccggttacccgggtaacccggttaccggtaccggtaccggaacccggtacccggtaaccggtcccgtaccccggttacccccgg

SEQ ID NO: 237039 - DNA, 732 bp, Homo sapiens
  misc_feature: GYAE6OF01DL7BP.5.24.C02.1.454.CMB.1.raw
tcagatcagacacgcacgaccggtgctcgatttagtacagatcgttagggaaaggggggggtctcaggaggcagcgctctcaggacgtcaccaccatggcctggctctgctcctcctcaccctcctcactcagggcacgagggtcctgggcccaggcctgccctgactcagccctccctccgcgtccgggtctccgtggacagtcagtcaccatcctcctgccactgaccaaccagccagttcgacggttggtcggttacgaagttctgtctccgtaggtaaccaaccaaccacccgaacaaaccgacccccaaactccattcttagttttcggagtctaaccgtacgcccgaccctcggaccgggttccctgactccgtcttcgtcgtggtcctaccgtaacggttcgacggtaccctaaccggacccggtccccgtttccccgtacggttaccccggttccgttaccggttccgggtcccttacccggtaacgggttaccgttaccgggaagggtacgttagggaccggtaccgtaggttaacgttttaccttacgtcgtacgtacgtccttaacgtacgtagtcgacgaagccgacgacgtaccgaccgtaccgtacccgagttcggtacgtacgttaccgggtcgggggaccgggtaacacggttaccgtcggtacccgttcgaaccggtacgtacccggaccgtacggtcccgtccccggtccccgg

SEQ ID NO: 237040 - DNA, 558 bp, Homo sapiens
  misc_feature: GYAE6OF01BQNTC.5.24.C02.1.454.CMB.1.raw
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (436)..(436): a, c, t, g, unknown or other
  misc_feature (436)..(436): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctggcccaggctgccctgactcagcctccctccgcgtccgggtctcctggacagtcagtcaccatcctcctgcactgaccaaccagctagtgtacggttggtcggttcgaagttctgtctccgtaggtaccaacaaccacccgaacaaaccgacccccaaatcatctattttgagtccacgtacgccacctcgtacgggtccctagactcgcttctctgctacagtctgcaacncgcctccngcctcgcgtcggctccgagtctaggcgagtagaggctagtattacttcngtacacgtctatactagcgcagcacgctacgctaccgtacccagtcgtacgtcgttcggtccggggacgggacacggtcgtcgccgtacgcgtaccgacgaccgacgtccgtcccgtccccg

SEQ ID NO: 237041 - DNA, 838 bp, Homo sapiens
  misc_feature: GYAE6OF01DUIVR.5.24.C02.1.454.CMB.1.raw
  modified_base (239)..(239): a, c, t, g, unknown or other
  misc_feature (239)..(239): n is a, c, g, or t
  modified_base (273)..(273): a, c, t, g, unknown or other
  misc_feature (273)..(273): n is a, c, g, or t
tcagatcagacacgcacgaccggtgctcgatttagtacagatcgttagggaaaggggggggtctcaggaggcagcgctctcaggacgtcaccaccatggcctggctctgctcctcctccaccctcctcactcgagggcacgagggtcctgggcccaggctcgccctgactcacgccctccctcgcgtccggtctccgtggacagtcacgtcaccattcctcctcgccactgaccaaccngctagtcgtacggttggtacggttacgaaagttnttcgttcctacctacggtaaacccaaaccaaacccaaccccgaaacgaaaaccacccccctaaaactacactttactttaagttttacggacggtcctaacgttaccggacccgtaccctacgggtaccggggttaccctacggtacttcccggtcctttctacgtcggtaccttaaccgtaacgttccgtacgggaacctaaccgtacccggtcccgttacccgtcgggtacccttccgttcgggtaccgggtacccttccggtaacggtccgtacggtaacgggtagtacgggtacggtaccgtaagttaacgttttacgtttaacgtacggtaccgtacgtaccgttacgttaacgttaacgttcggaaccggtacggtaaccgacggtaacctacggacccggttaccgtaccccgttagttacggttacggtaccgtttacccggggttacgggggacccggggtaaaccgtaacggtccggtaccgtacccggttaccggtaaccggtacccggtaacccggacccgtaacccgggttcccgtccccggttacccccgg

SEQ ID NO: 237042 - DNA, 904 bp, Homo sapiens
  misc_feature: GYAE6OF01C1JUQ.5.24.C02.1.454.CMB.1.raw
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (265)..(265): a, c, t, g, unknown or other
  misc_feature (265)..(265): n is a, c, g, or t
tcagatcagacacgcacgaccggtgctcgatttagtacagatcgttaggggaaaggggggggtctcaggaggcagcgctctcaggacgtcaccaccatggcctgggctctgcctcctcctccaccctcctcactcagggcacgagggtcctcgggcccagggctgccctgactcagccctccctccgcgtccgggtctcctggacagtcagtcaccatcctctncactgaccaaccngcagtgacgtttggtcggttacgaagtntgttccttccgtacggtaacccaaaaccaacccgaaccccgaaaccaaaccgaaccccccctaaaactcctaacttaccgtttaagttttttacggaacggttacctaaccgtaacccggtcccgtaaccccgttacgggaaccgggggtttacccctacggtaaacgttcccggtaccttttcccgtcgttccgggtaccctaccggttaacgttcggttaccggaccgtaaccgacccggccccgttacccgtaccgtacccgttccgtaccgggttccgggacccttaccgggacgggttccgtagggtacggtaaggttcgggaacgttcgttaggttaaacttttcgttaccgtacgtaccgtagtaccgtaccttaagtacgtacggtaccggtaaccggtaacgtaacgggaccgtaaccggtacccgtaccccgttaacccgttagttacgggttaacccgttcggggttacccgggggttacccggggggaaccgggggttaaacccgggtaaccggttccgggtttaaccccggtaaccccggggtttaccgtacccgggttacccggaaaccgggtccccccgggttaaaccgggttcccccggttccccccgggttacccccccggg

SEQ ID NO: 237043 - DNA, 655 bp, Homo sapiens
  misc_feature: GYAE6OF01CEVW2.5.24.C02.1.454.CMB.1.raw
  modified_base (198)..(198): a, c, t, g, unknown or other
  misc_feature (198)..(198): n is a, c, g, or t
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
  modified_base (384)..(384): a, c, t, g, unknown or other
  misc_feature (384)..(384): n is a, c, g, or t
  modified_base (432)..(432): a, c, t, g, unknown or other
  misc_feature (432)..(432): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacngtcagtcacatcctcctgcactgaccaaccngcaggtgtacgttggtggtcgaagtntgttcctcgtacggtaaccaacaaccgaacccgaacaaaccgacccccaaactcactcttagttttagacggtcacgtaccgccgacctcgacgggtcctagctcgtcttctcgtcgctcgtaacgtcnggacctaacgccgtcctcccgtcgtaccgttctccgtcggcctaccgngtctggaggtgtggacggtctaggttaatttacgtacgtcgctaacgtctactagttaacgtcgtcggacggaccgacggtacgacggaccctaccgtccctagttcggtacgtacgggttccgggttaccggggaccggggaacctacggtccggttaccggtacccggttaccgtacgggttaccgacccggtacccgccggtcccggtcccgtcccccgg

SEQ ID NO: 237044 - DNA, 787 bp, Homo sapiens
  misc_feature: GYAE6OF01DXRZF.5.24.C02.1.454.CMB.1.raw
  modified_base (240)..(240): a, c, t, g, unknown or other
  misc_feature (240)..(240): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcagggcacgagggtcctgggcccaggcctgccctgactcacgccctccctccgccgtccgggtctcctggacagtcagtcaccatcctcctgccactcgaccaaaccngctaggtcgtacggttgggtaggttacgaagtacttcgtcctccgtacggtaaccaaaccaacccgaaccccgaacaaacccgacccccctaaactaccacttcttaagtttttacggacggttacctaccgtaccggcccgtaccctaccgggtaccgggttccctagtaccgttccgtccttacctcgtccggtacttacccgtaagttcgacggtaccaaaccggtacccgcccttacccgtacgtacccgtcgtccggtcgggacccttccggacggtaccgtagggtaacggtacggtacgggtacggtacgttaggtttaactttaacgtttacgtacggaccgtacggtcttaacgttactacgtacggtcggaacggtaccgacggacctacgtacccggtacccgtacccgtgttaccggtcgttacggttaccgggtccgggggaaccggggtaaccctacggtccggtaccggtacccggtaccggtaaccggtaccgaacccgtacccggtaccggtcccgtccccggtccccgg

SEQ ID NO: 237045 - DNA, 828 bp, Homo sapiens
  misc_feature: GYAE6OF01C9DBI.5.24.C02.1.454.CMB.1.raw
  modified_base (239)..(239): a, c, t, g, unknown or other
  misc_feature (239)..(239): n is a, c, g, or t
  modified_base (715)..(715): a, c, t, g, unknown or other
  misc_feature (715)..(715): n is a, c, g, or t
tcagatcagacacgcacgaccggtgctcgatttagtacagatcgttagggaaaggggggggtctcaggaggcagcgctctcaggacgtcaccaccatggcctgggctctgctcctcctccaccctcctcactcagggcacgacgggtcctcgggcccaggtctcgcccctgactcagcctccctccgcgtccggtctcctggacagtcagtccaccatccgtcctgccactgacaaccngcagtcgacggtttggtggttacgaagtatcgttctacccgtaggtaacccaaaccaaacccgaaccccgaaaccgaaaaccgaccccccctaaaactaccacgttacgttaacgttttttacggacggttaacccgtaacgttacccggacccgtaccccgttacgggaaccgggggttccccttagtaacgtcccggtacctttcccgtaccgttcggtaccttaacccgtaacggttccgtacggtaaccgaaaccggtaaccccggcccctttccccgtacgggtttaaccctcccgttaaccgggttccgggtacccttcccggtaacgggtccgttacgggacggtaacggtttacgggacgggttacctttacgtttaaacgtttacgtttacgacgggttccctaacggtacttaaccgttgtaacgttagccgaaggccacgaccgacgttccgacccttaaccgtntacggttaaccgtgttcccgggtacggggtaccggggacctaggttccgtaaccgggtccctacgttaacggtcccacggttacccgaaccgggtccgtcccggtacccccgg

SEQ ID NO: 237046 - DNA, 762 bp, Homo sapiens
  misc_feature: GYAE6OF01C7WJN.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacgagggtcctcgggcccaggctcgccctgactcacgccctccctccgcggtcccgggtctccgtggacagtcagtccaccattcctcctcgccacgtcgaccaaaccgagaccgaggtcggtacggttgggtaggttacgaagttagtcgtcctccgtacggtaaccaaaccgaaccgaaccccgaaaccaaacccgaaccccaaacgtctacttacttagttttacgacgtacaccgtaccgccgtaccgtcggtaccgggtcctagtactccgtcttctcgcgtctacgagtcacggaccaccgaccggtcctaccgtcgtacccgttcgtccggtcgggacctaccggacgggtcgtacgggtacggtagttacgggacgtacgttagttaacgtttactacgtcgaccgtaagtcctagtaactcgtacggacgtaggacgacgaccgtaactacccggtaccgttaacccgtgttacggtacggtacccggttaccggggttccgggggaacccgggtaacgtaccggtaccggttacccggtaccccggtaccggtaaccgggtacccgaaacccgggtaccccggtacccgggtcccgtttccccgggacccccgg

SEQ ID NO: 237047 - DNA, 637 bp, Homo sapiens
  misc_feature: GYAE6OF01CS1XD.5.24.C02.1.454.CMB.1.raw
  modified_base (250)..(250): a, c, t, g, unknown or other
  misc_feature (250)..(250): n is a, c, g, or t
  modified_base (500)..(500): a, c, t, g, unknown or other
  misc_feature (500)..(500): n is a, c, g, or t
  modified_base (506)..(506): a, c, t, g, unknown or other
  misc_feature (506)..(506): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcagcctccctcgcgtccgggtctccgtggacagtcagtccaccatcctcctgccactgaccaaccagcagtgacggtttggnggttacgaagtatcgtcgtcctaggtaaccaaaccaaccaccccgaaccaaaccgacccccaaactccatacttagtttttagacgtctacgtaccgccgacccgtcgacgggtccctgactccgtcttcgtcgtcggcctacgtaacgtctcggacaactccggccctcccgtcgtaccgtcgtcggtcggccttaccgacgtcgtaggaggatggacgtcgtagtatttactcgtcgacgtacgcctnaagttntacgcgtacggcacgcgacgccgacgtccccgtagtcgtacgtacggttccggtaccggggtacgggggaacctacggccgtaccgtcccgtacgtacgacgaccgaccgtacggccgtcccgtaccccgg

SEQ ID NO: 237048 - DNA, 726 bp, Homo sapiens
  misc_feature: GYAE6OF01C6SWC.5.24.C02.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctctcactcaggcacgagggtcctgggcccaggctgccctgactcagcctccctccgcgtccgggtctccgtggacngtcagtcaccatctcctgcactgaccaaccngcagtcgacggttggtgttacgagtntgtctctgtaacaacaaccacccgaacaaaccaccccaactcactattagttttagacggtacacctaccgaccgtacccgtacgaccggggtcctagtacgtcgtcctttcgtcgtcgtcctacctaacgtcgtacggacaaaccgtccgacccttcccgtacgtacccgttccgttcggtccgggtcctaccgaggtccgtaggaacgggtgtagggtacgtcgttaacgttaatttaaccgttagtcgtacgtacgtacgttactacgttacgtggacgtagggtacccgtaacgtcgtaaccgtacgtaccggttaccccgtagttcggtacggtccggttacccgggttccggggggaaccgggtaaccggtacggttaccggtaacccggttccccggtttaaccggacggttacccggaaccggtccccgtaaaccgggtccccgtcccccgggttaccccgg

SEQ ID NO: 237049 - DNA, 841 bp, Homo sapiens
  misc_feature: GYAE6OF01DVLDT.5.24.C02.1.454.CMB.1.raw
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
tcagatcagacacgcacgaccggtgctcgatttagtacagatcgttaggggaaaggggggggtctcaggaggcagcgctctcaggacgtcaccaaccatggcctgggctctgctcctcctcaccctcctcactcgagggcacgagggtcctgggcccaggctgccctgactcacgtccctccctccggcggtccgggtctaccgtggacngtcagtcaccatcctcctgccactcgacaaaccgngcaagttggacggttgggttacggttacgtaagtatcgttccgtaccgtacggtaaaccaaaccaacccgaaccccgaaacaaaacccgaccccctaaaactctaactttacgttaagtttttacggaacggttaccaccgttaaccggacccgtacccgttaccggacggggttaccttagggtaactccgtcctttcgtaccgtcggtacctaaccgtaaggtcgtacggaccgaaaccggtccggtcccccttacccggtaccggtaacccggttccgtaccgggttacggggtaccctaccggtaacggggtaccgttagggaaacggtacggtacgggtaacggtcgttaaacggttaattttaaccggttaacgtcggttaaccaacggtaccctttaactaggtttaaccgcgggtaacggtaacggaccgaacggaccgtaacgaaccgttacccgtaacccgtagttcggttacggtaaccgttccggggtaaccgggggaccggggaacctacgggtcctaccgggaccgttaccgtaccgggtaccaaccgggtacccgtaacggtccccgtccggtacccccgg

SEQ ID NO: 237050 - DNA, 628 bp, Homo sapiens
  misc_feature: GYAE6OF01A30HV.5.24.C02.1.454.CMB.1.raw
  modified_base (199)..(199): a, c, t, g, unknown or other
  misc_feature (199)..(199): n is a, c, g, or t
  modified_base (255)..(255): a, c, t, g, unknown or other
  misc_feature (255)..(255): n is a, c, g, or t
  modified_base (343)..(343): a, c, t, g, unknown or other
  misc_feature (343)..(343): n is a, c, g, or t
tcagatcagacacgcacgaccggtgctcgatttagtacagatcgttagggaaaggggggggtctcaggaggcagcgctctcaggacgtcaccaccatcggcctgggctctgctcctcctcaccctcctcactcagggcacgagggtcctgggcccaggctgccctgactcagcctccctcgcgtccggtctcgtggacngtcagtccacatctctgcatgcaaccagctagtcgacgtttggtcgttacaagttntgtctcgtacggtaccaacaaccgacccgaacaaaccgacccccaaactcatctattttcgagtcactacgctacctcgacgggtccngactcgtcttctcgtcggcctaccgaagtctgaccaacgacggtcctccgtcgaccgttctcgtcgggtcctacgacggtcgtaggacggtagtcggtacggtacttagttaactttacttaccgtcgtaccgtacggtcttacgtagttaacggtccgcgtacggactacggtaacaccggtacctaccgaccgtagtcgtacgtccgttcgggtaccgggacggggactacgtccgtacgtacccgtctaccggtcaccgtaccgacgtcccgtccgtacccg

SEQ ID NO: 237051 - DNA, 594 bp, Homo sapiens
  misc_feature: GYAE6OF01ARZA7.5.24.C02.1.454.CMB.1.raw
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (426)..(426): a, c, t, g, unknown or other
  misc_feature (426)..(426): n is a, c, g, or t
  modified_base (447)..(447): a, c, t, g, unknown or other
  misc_feature (447)..(447): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcagcctccctcgcgtccgggtctcctggacagtcagtcacatctctgcactgcaaccngcagtcgacgttggtgttacgaagtntgtctctgtacaacacacccgacaacgacccaactcatctattttgagtcactacgcgacctcgacgggtcctgtactcgtcttctcgtggctacgagtctgacaacgaccgcctccgtcgaccgtctcgtcggctccgagcgtagagtagtgaggtctgtaacttagttacgngcagtctacgtatatcgacgnggactacgacgtacgaccgtacgtaccctagtcgtacggtacgttaccgggtaccggggacggggtacctacggtccggttacggtacccggttaccgtacgggtaccgaccggtaacccgacggtcccgtcccgggttacccccgg

SEQ ID NO: 237052 - DNA, 714 bp, Homo sapiens
  misc_feature: GYAE6OF01CPRI1.5.24.C02.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacagggtcctgggcccaggctgccctgactcacgcctcctccgcgtccgggtctcctggacngtcagtcaccatctcctgcactgacaacngcagtgacgttggtgtcaagtatgtctctggtaaccaactaaccacccgaacaaacgaccccaaactcatactattttagacggtcaacgtacgaccgtaccctcgtacggggtccctaggaactccgtctttaccgtctcggctaccaaagttcgtcggaccaaaccgaccggtcccttccgtacggtacccgttcttcgtcgggaccttccgacggtccgtaggaacgggtactagggacggtcgtaaggtaactttacttaaccgtgtacaagtcctaataacgtacttacggcgaacggacaacggtaccgaaggtaccctaccgtaccccgtaagttcggttaacggtacggttccgggtttccgggggaacccggggggtaaacctacggaccggtaccgggttaaccccggttaccgttaaaccgggtccgaaaccggaccccggaaacggttcccgtaccccggttaaccccccggg

SEQ ID NO: 237053 - DNA, 627 bp, Homo sapiens
  misc_feature: GYAE6OF01B1ZCN.5.24.C02.1.454.CMB.1.raw
  modified_base (211)..(211): a, c, t, g, unknown or other
  misc_feature (211)..(211): n is a, c, g, or t
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (461)..(461): a, c, t, g, unknown or other
  misc_feature (461)..(461): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctccgtggacagtcagtcaccntctcngcactgcaacngcagtgacgttggtgttcgaagttntgtctcctggtaccaacaaccacccgaacaaaccgacccccaaactcactctattttgacgtcactacgcgacctcgacgggtcctgctcgtctctctcgctcagtcgtgacaacgccgcctcctcgtaccgtcgtcgtcgggcctacgtacggtcgtaggacggtacgtaggacggtccgttagttaactttacgttaccgtcgtacncgtcttacaattcgtgacgacgacgtacgcgacgtacctaccgtccctagtcggtacgtacggttccgggtaccgggggtaccgggaccgtaggtacggtaccggtacccgttacgtaccgggtaccacccggtacccggaacggttcccgtcccggtacccccgg

SEQ ID NO: 237054 - DNA, 734 bp, Homo sapiens
  misc_feature: GYAE6OF01CRHP5.5.24.C02.1.454.CMB.1.raw
  modified_base (143)..(143): a, c, t, g, unknown or other
  misc_feature (143)..(143): n is a, c, g, or t
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (268)..(268): a, c, t, g, unknown or other
  misc_feature (268)..(268): n is a, c, g, or t
  modified_base (552)..(552): a, c, t, g, unknown or other
  misc_feature (552)..(552): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctcaccctcctcactcgagggcacgngggtcctcgggcccaggctcgccctgacctcacgccctccctccgccgtccgggtctccgtgggactagtcagtcacctntctccngctactnaccaacngcagtcgaggttggtgtacgaagtntcggttcctcgtacggtaccaaaccaaccaccccgtaacaaacccgtacccccaaactcacttacgtttacgttttacgacgttccaaccgtaccgccgtaacccgttcggaccgggtccctgactccggtcttcgtactcggtaccttaccaagttccgtacggaccgtaaaccgtcccggtccctacccgtacgtaccggttcgtccggttcgggaccctccggaggtccgtaggacggtacgtggacgttcgtaatactttatacgtcgactacgtacttnaaagttcgacggtaccgaaggccaaggttcccaaaggtccccggactacccgtaggtgtaccggttccggtcgggtaccggggtaccggggaactacgtccccgggttaacgcccccgggtttacgacgggtaacccgaccggtaccccggtaacggtccccggtccccgttaccccccggg

SEQ ID NO: 237055 - DNA, 625 bp, Homo sapiens
  misc_feature: GYAE6OF01AUZGE.5.24.C02.1.454.CMB.1.raw
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacagtcacgtcaccatctcctgcactgacaaccagcagtgacgttggtggtacgagtatgtctctgtaccaacaacacccgacaacgaccccaaactcatctagttttcgacgtcacgttaccgcgtaccctcgacgggtctcgtgtactcgtcttctcgtgtctacgaagtctgaccaacnccgtccctcctcgaccgttcncgtcggtcctaccgtgcgtgaggtgtgacggtctagtaatttacgttacgtgacgtagtacctactagttaagtcgtacgtacgggcgtaaccggactaccggactacccgtaaccctagttacgttcgtaaccggttccgggttacgggggccgggtaaccacggtcccgttacggtacccgttacccgtaggtacccgacggaccccgtaggtcccgttccccgg

SEQ ID NO: 237056 - DNA, 770 bp, Homo sapiens
  misc_feature: GYAE6OF01D71XU.5.24.C02.1.454.CMB.1.raw
  modified_base (199)..(199): a, c, t, g, unknown or other
  misc_feature (199)..(199): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccggtctccgtgacngtcagtcacatctcctgcactgccaaacctgcctagttgacgtttgggtaggtttcgaaagttatggtctccgtaggtaccaacaaccacccgaacaaacgacccccaaactcacttctattttgagtcactacgccgtaccctcgacgggtccctgactcgtcttcgtctcggctccgtaagtcgtcggaccaaaccgtccggtcccttcccgtacgtaccccgttctcggtcgggtacctccgtacggtcctagggaacgggtgttacgggacggtccttaaggtaactttaactttaccgtaggtacccgtacgtaccttacgtaacttaacgttcggacggtaacggacccggaaaggtccgaacggtacccgtaacccggttaccccctaaggttacggttaccgggttacgtttcccgggttaaccggggggtacccggggggtaaacccgtaaacgggttcccggttaacccggaaaccccgggttttacccgttaaacgggggtcccctaaaccgggtacccccgtaaacggggttccccgttcccccgggttacccccccgg

SEQ ID NO: 237057 - DNA, 740 bp, Homo sapiens
  misc_feature: GYAE6OF01BTVTN.5.24.C02.1.454.CMB.1.raw
  modified_base (246)..(246): a, c, t, g, unknown or other
  misc_feature (246)..(246): n is a, c, g, or t
  modified_base (608)..(608): a, c, t, g, unknown or other
  misc_feature (608)..(608): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacgacgggtcctcgggcccaggctcgccctgacctcacgccctccctccgccgtcccgggtctccgtggacagtcagtccacctatcctcctgccactcgaccaaccngcctaggtcggtacggttgggttcggttacgaagttcgtcgttcctaccgttacggtaacccaaaaccaaccccgaaccccgaaaccaaaaccccgaccccccaaaactcctaactttaccgtttaagtttttaggacggttaccaacccgtaaccggacccgtaccccgtacggtaccggggttccctgtacttccgtctttccgtccgtcggtaccctaccgtacgtcgtacggacctaaccgcccgtccctacccgtcgtacccgtcgtccggtccggtacctacggtacggtcgtaggacggtacgtgggacggtcttaaggtaactttacgttacggcagtcgtacctagagtacgngacgacgacacgcgtacgtaccgtaccgtccagttcgacgtacggttccgggacgggggaccgtagaccggtcgtaccggtaccgtacgtaccgtaccgacccgtaccggacccgtccgtcccggtaccccg

SEQ ID NO: 237058 - DNA, 737 bp, Homo sapiens
  misc_feature: GYAE6OF01DN5HG.5.24.C02.1.454.CMB.1.raw
  modified_base (252)..(252): a, c, t, g, unknown or other
  misc_feature (252)..(252): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctctcactcgagggcacgaggtcctcgggcccaggctcgccctagacctcgacgcccttcccgtccgccggtccggtctccgtaggacagtcgacgtccaccactcctcgtcgacaacgtgaaccaacgngcgtagtcggtcgttggtacgttacaagttcgtcgtccgtaccgtacggaacccaaaccaaccgaaccccgaaaccgaaacccgaccccctaacgtacctattaccgtttaagttttacggacgttaccaaccgtaccgtaccgtaccgtacggtaccggtcctagctccgtactcggtctacggcctacgtagtcgtacgactaccgaccgtcccaccgtacgtcccgtattccggtacgtccgtacgtacggcgtaggtacgagtcggtacgtacctttaggtactttaacgcgtcgacgtctacgttaggtactacggtacgaacgtcggaacgtacgtaccgttacgacccgtaccgttaccgtagtaccggtacttaccggggaccgggttaccgggacggtaaccgtgtacccggttacggacccgtaaccgggtcgtaacccggacccgacggtacccgttccggccccgttacccgg

SEQ ID NO: 237059 - DNA, 692 bp, Homo sapiens
  misc_feature: GYAE6OF01D6PYH.5.24.C02.1.454.CMB.1.raw
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacagggtcctgggcccaggctgccctgactcagcctcctccgcgtccgggtctcctggacagtcagtcaccntcctcctgcactgcaaccngcagtgacgttggtggttcaagtntgtctctcgtaccaacaaccacccgacaaacgccccaaactcacttactattttcgaggtcactaccgcctaacccgtcgtacgggtcctgactcgtcttctctcggtctaccgtagtcgtcgacgaaccgaccgtcctccctcgtacccgttcgtaccgtcggtacctccgacggtcgtcgtacggtagtacggaggtcgttacgtaatttacgttacgtcgtaccgagttacttaccgtaacgttactggtaccgtaacggacgtacggaccgtaaccgtacgtaccggttacccctagttacggtacgttaaccggttccggttaccgggggtacccgggggtaacccggtaaacgtacccggttaccgggacccgttacccggtacgggttaccggtacccgacccggtaaccggtcccgtcccggtacccccgg

SEQ ID NO: 237060 - DNA, 704 bp, Homo sapiens
  misc_feature: GYAE6OF01D6F6G.5.24.C02.1.454.CMB.1.raw
tcagatcagacacgcacgaccggtgctcgatttagtacagatcgttaggggaaaggggggggtctcaggaggcagcgctctcaggacgtcaccaccatggcctgggctctgctcctcctcaccctcctcactcgagggcacgagggtcctcgggcccaggctcgccctgactcacgccctcccgtccgcgtccggtctccgtggacagtcacgtccacctatcctcctgcactgaccaaccagcaggtcggtacggttgggtaggttacgaagttattcgtccgttaccgtacggtaacccaaaccaaacccgaaccccgaaacaaaaccgaccccctaaacgtacaacgttacttacgttttacggacgttaccgtaccgtaccgaccgtacccgtcggtacgggttcctagacttcgtcttcgtcgtcggtactaccgtaagtcgtacggacaaccgtccgtccctaccgtcgtacccgtcgtcgtcggtcctacggacggtctaggtaggtacgtacggtacgtagttagtaacttacgtacgtacggactacgtactacgtaatacgtcgacgaggacaggtacgactaccgtaccggtaccaggttcgacgtacggttcgggtacggggacggtaacgtaccgtcggtaccgaccggtacacggtacgaccgtaccgaccggcccgtcccggtaccccg

SEQ ID NO: 237061 - DNA, 692 bp, Homo sapiens
  misc_feature: GYAE6OF01BG3KC.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcacgcctccctccgcgtccgggtctccgtggacagtcacgtccacctatcctcctgcactcgaccaaccagccaggtcgtacggttgggttggttacgaacgttgtcgttcctaccgttcggtaaacccaaccaacccgaaccccgaaaccaaacccgacccccaaactcctatcttagttttcggacgttacaaccgtcgaccgtacccgtacggacgggtccctagtactccgtcttctccgtggtcctacgacgtctacggaccaacgccggtccctcccgcgtccgtcgtcgtcggacctccgacgtcgtacgagtacgtaggcgtcgtagtattacgttacgtgcacgtcgtactagtagtacgcgtacggacacgacgacgtacgtaccgtaccgtacgtacgtcggttaccgttccggggtaccggggaccggggtaccggtacgtacggtcccggtaccgttacccggtaacggtacccgaccggacccgtcccggtcccgtaccccggtccccgg

SEQ ID NO: 237062 - DNA, 794 bp, Homo sapiens
  misc_feature: GYAE6OF01CY8MM.5.24.C02.1.454.CMB.1.raw
  modified_base (218)..(218): a, c, t, g, unknown or other
  misc_feature (218)..(218): n is a, c, g, or t
  modified_base (641)..(641): a, c, t, g, unknown or other
  misc_feature (641)..(641): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctcaccctctcactcgaggcacgacgggtctcgggccaggctcgccctgactcacgtcctccctcgtcggtccggtctccgtaggacagtcagtcaacctntctctcgactacgtcgaaccaaacgcgacgtaacggtggtaccggttgggttacggttacgtaaagttcgtcgttcccgttaccgttaacgggaaacccaaaaccaaaacccgaaccccgaaaaccaaaaccccggaacccccaaactcaacttactttaagttttcggaaacggttccaacgtacccggtcccgtaacccgtcggtaacgggttccctagtctccgtcttctcgcgtacctacgtaacgtcaacgtcgaaacccgtcccggtccctacccggtcgaccgttccggtcgttccggtccctacggtacggtccgtagggtcggaacgtacgggtacggtccgttaagttacgtttaacgttcgtcggtaaccttacgtcttacgttaagttacaccggtacgaacggtagaccncgggtaccgaccgtaccgtacccttggtacgtacggtaccggtccggggttacccggggaaccgggtaaccgtacgggtcccgttacccggacccgtttacgggccgtaaccggtacccggacccgcggtacccccgttcccggtacccccgg

SEQ ID NO: 237063 - DNA, 834 bp, Homo sapiens
  misc_feature: GYAE6OF01CRIYN.5.24.C02.1.454.CMB.1.raw
  modified_base (250)..(250): a, c, t, g, unknown or other
  misc_feature (250)..(250): n is a, c, g, or t
  modified_base (289)..(289): a, c, t, g, unknown or other
  misc_feature (289)..(289): n is a, c, g, or t
  modified_base (660)..(660): a, c, t, g, unknown or other
  misc_feature (660)..(660): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctccaccctcctcactcgagggcacgacgggtcctgggcccaggcctcgccctgactcacgccctccctccgcgtccggtctccgtggacacgtcacgtccacctactcctcctgctacctcgaccaaaccgngaccaggttcggtacggtttgggtacggttacgaagttnttcgttcctccggtacggtaacccaaaccgaaacccgtaaccccggaaacaaacccgacccccctaaaacgtcctaacttacctttaagttttttacggaacggtaccctaaccgtaacccgtaccccgtaaccccgttacggaaccggggtttccccgtaggtaaccgttccgttccgtttacctcgttcggtacccgtaccgtaaggtccgtacggacccaaccgtaccgggtccccttacccggtccgtaccggtttcctccgggtccggtaccgttcccggaacggtccgtaggtaagggtgttacgggacggttacttaaggttaactttacgttaccgtcggtaacgtctacgtttactaacgtntacgggtacgacgtacgacgacgggacttacccgacgtacccgtgtaacggtaccgttcggttaccgggttccgggggaccggggtaacctagggtcccgttaccggtacccgggttccgttaccgggacctaaccggacccgggaacgtcccccggttacccggttcccccgg

SEQ ID NO: 237064 - DNA, 659 bp, Homo sapiens
  misc_feature: GYAE6OF01A5J2J.5.24.C02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcacgcctccctccgcgtccgggtctccgtggacngtcagtcaccatcctcctgcctactgaccaaccagcagtcgacgttgggtcggtacgaatntgtctcgtacgtacaacaaccacccaacaaccgaccccaactcactctattttggacgtcactaccgcgtacctcggtacggtcctgtatccgtacttcgtcgtgctacaagtcacgacaacgccgtcctaccgtcgaccgtctacgtcggcctaccgacggtctaggagtagtggagtcgtaggtaactttagtacgtacgtacgtctacgtacaagttgacggtacaggacctaggacctacgtaccgtaccgtaccctaggttaaggtaccgtacgtttccggggtaaccggggtaccggggaaaccttacgggaccgtaccgggtaccccggtaacggtaccggtacccgtaacggaacccggtaacgggtcccgtccccggtaacccccggg

SEQ ID NO: 237065 - DNA, 772 bp, Homo sapiens
  misc_feature: GYAE6OF01CDEBN.5.24.C02.1.454.CMB.1.raw
  modified_base (285)..(285): a, c, t, g, unknown or other
  misc_feature (285)..(285): n is a, c, g, or t
  modified_base (631)..(631): a, c, t, g, unknown or other
  misc_feature (631)..(631): n is a, c, g, or t
tcagatcagacacgcacgaccggtgctcgatttagtacagatcgttagggaaaggggggggtctcaggaggcagcgctctcaggacgtcaccaccatggcctggctctgctcctcctcaccctcctcactcgacgggcacgtagggtcctgggcccaggcctcgccctagactcacgccctcccgtccgcggtccgggtctccgtaggactagtcacgtccaccattcctcctgaccactcgaccaaccagtcaggttcggtggtttcgggtcgttacgaaagtnttcgttcctaccgtacggtaacccaaaccgtaacccgaaccccgaaaccgaaaaccctacccccaaacttacctaacttactttacgtttttacggaaccggttaccaaccgtacccggtaccgtacccgtacgggtaccgggttccctacgacgttccgtctttcctcgtaccggtcctaaccgtacgtccggtacgtacgaacccggtcccggtcccgtcccgtacgggaccttccggtacgtccgggtaccctcggtggtacgtcgggtaacgtcgtagggacgtattacggttaattaccgttgacgtacgaacttcgtaatacggtctcgggacgacggtnaaccgctacgtaccgtacccttacgtagtcgtacggtccggtccgggtacggggccggtaaaccgtcggaccggttaccgggacccgttacggaccggtacgaccccggtaccgaccgggttccccgtcccgggtaccccg

SEQ ID NO: 237066 - DNA, 650 bp, Homo sapiens
  misc_feature: GYAE6OF01AKTNE.5.24.C02.1.454.CMB.1.raw
  modified_base (199)..(199): a, c, t, g, unknown or other
  misc_feature (199)..(199): n is a, c, g, or t
  modified_base (217)..(217): a, c, t, g, unknown or other
  misc_feature (217)..(217): n is a, c, g, or t
  modified_base (255)..(255): a, c, t, g, unknown or other
  misc_feature (255)..(255): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacngtcagtcacatctctgcnctgcaaccagccagtcgacgttggtggttacgaagttntgtctctggtaccaacaaccacccgacaagacccccaactcactctattttcgacgtctactacgcgacctcgacgggtccctgactcgtcttcgtacttcggccttaccgaacgtcgttacgggaccaaaccgtacccgggcccttacccgtacgtacccggttcgttcggtcggacccttccgacggtcgtacggaggtacgtcggacggtcgttacgtactttaatccgtacgtgtacgtcgtactacgttagtacgaccgtaaggccgaagaccgtacgcccgtaccgtacccctaagttcgtagtaccgttcgggttaccgggacggggtaccgacggtcgccgtaccgtccgtacggtacgcggaacccggtacgcccgtccgtccccg

SEQ ID NO: 237067 - DNA, 697 bp, Homo sapiens
  misc_feature: GYAE6OF01BPRR1.5.24.C02.1.454.CMB.1.raw
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
tcagatcagacacgcacgaccggtgctcgatttagtacagatcgttaggggaaaggggggggtctcaggaggcagcgctctcaggacgtcaccacatggcctgggctctgctcctcctcaccctcctcactcgaggcacgtagggtcctgggcccaggctcgccctgactcacgccctccctccgcggtccggtctccgtggacngtcagtcacctntcctctagctacgtcgaccaaccgagctacggtggtacggtttgggttagttacgtaagtgtcgtctaccgttacggtaacccaaacaacccgaacccgaacaaacccgaccccctaaatctaacttcttagttttcggaccggtacacgtaccgccgtaccgtcggtaccggtcctggactcggtcttacgtcgtcggtcctacgtaagcgtacggactaaccgccggtccctccgtcgtaccgtcgtacggtcggcctaccggacggtcgtagggacgtcgtcggtaacggctttaggttaactttacggtccgaccgtcgtacgccttaacgtcgttaagccgacgtacgcgtacgcgtacgctaccggtccaaggttctaacggtccgttaccgggtggggacccggttaagccgttacgacgggtcccttaggaccgtccgacccgttaccggacgttccccgccggttccccgg

SEQ ID NO: 237068 - DNA, 822 bp, Homo sapiens
  misc_feature: GYAE6OF01AQDO0.5.24.C02.1.454.CMB.1.raw
  modified_base (202)..(202): a, c, t, g, unknown or other
  misc_feature (202)..(202): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctcgccctgactcacgcctccctccgcgtccgggtctcctggacngtcagtccaccatctcctgcactgccaaccagcagtcgtacggttgggtcggttacgaagtattcgtccttccgtacggtaacccaaaccaacccgaaccccgaaccaaaaccgacccccaaactccacttacttagttttcgaacggtcctaaccgttaccggccgtacccgtcggtaaccgggttccctagtacgtccgtctttccgtcgtcggtccctaccgtaacggttccgtacggacctaacccggtccgtccccgttacccgtccggtaacccgttccgttccggtacgggtcccgttaccgtacgggtcgtacgggaaggttacggtacgggtaacggttccgttaacggttaacgtttttaaaccgtcgtacgtaccggtacttccgtaaccgttaagttacgtccggtaaccggtaacgaccgttaaccggaactacccgggaacctaccccgttccgtaacggttcggtacgttaaccggttcccggggtaacccgggggtaaaccggggtaaccctacgggggtaccccgtacccggttaacccggtaccggtaacccgggacgtaccccggtaaccggtcccggtccccggtcccccggtaccccgg

SEQ ID NO: 237069 - DNA, 743 bp, Homo sapiens
  misc_feature: GYAE6OF01D56XR.5.24.C02.1.454.CMB.1.raw
  modified_base (204)..(204): a, c, t, g, unknown or other
  misc_feature (204)..(204): n is a, c, g, or t
  modified_base (274)..(274): a, c, t, g, unknown or other
  misc_feature (274)..(274): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcagggcacgagggtcctgggcccaggctgccctgactcagccctccctccgcggtccgggtctccgtggacngtcagtcaccatcctcctgcactcgaccaaccgagcgagtcggtacggtttgggtaggttacgaaagttnttcgttccttccgtaggtaacccaaaccaaacccgaaccccgaaaccaaaacccgaccccccaaaactccaacttaccttagtttttacggacggttacctaaccgtaccgccgtacccgtaccggtacggggttccctgtacttcgtccttactcgtcggtcctaccgtaagtcgtacgaccgaacgcccggtccctcccgtacgtacccgttctccggtcggccctacggcggtacgtagggaaggtagtcggtacggtctagttaacgtttacgttacgtacgacgtacgtcctagtgtacgcgtcgacgtcgaacggcacgtccgtaccgtaccctagttcggtcgttacgggttccggggtaccgggggacccgggggtaaacctgggtaccggtccggtacccggttcggtaaccgggtccgaacccggtaccggtaccggtccccggcccggttaccccggg

SEQ ID NO: 237070 - DNA, 816 bp, Homo sapiens
  misc_feature: GYAE6OF01B3Q1C.5.24.C02.1.454.CMB.1.raw
  modified_base (208)..(208): a, c, t, g, unknown or other
  misc_feature (208)..(208): n is a, c, g, or t
  modified_base (281)..(281): a, c, t, g, unknown or other
  misc_feature (281)..(281): n is a, c, g, or t
tcagatcagacacgcacgaccggtgctcgatttagtacagatcgttagggaaaggggggggtctcagggaggcagcgctctcaggacgtcaccaccatggcctgggctctgctccctcctcaccctcctcactcgagggcacgagggtcctcgggcccaggctcgccctgactcacgcctccctccggcgtccgggtctccgtggacncgtcagtccacctatcctcctcgccactcgaccaacacgctaggtcgtacggttggggttcgttacgaagttntcgtccgtaccgtacggtaaacccaaccaaacccaaccccgtaaaccaaacccgacccccaaactctaaccgttctttaagttttcggacggttacctaaccgtaccgacccgtacccgtacgggtcccgggttacctaggtaccttccggttccttccgtcggtccgtacgtaccgtaagttccgacgaccgtaacccgtccggtccctccgtaccgtccgtccgtccggttacggccgtacggtacggtcgtacgggtacggaggtcggtacgtacgttagttaacgtttacgttacgtcgtacgtactacgtctaacttcggacggtacggacggaccgtacgaccgtacggtacccgttaccgtacccggttagtaccggttaccggtacgggttcccggggtaccggggaacccggggtaaccgttaccgggtcccgggttaaccgggtacccgttaccgggtaaccccgggtccgaacccgggtaaccccggtaacccgggtttccccggtaccccggttacccccggg

SEQ ID NO: 237071 - DNA, 753 bp, Homo sapiens
  misc_feature: GYAE6OF01AVB2J.5.24.C02.1.454.CMB.1.raw
  modified_base (548)..(548): a, c, t, g, unknown or other
  misc_feature (548)..(548): n is a, c, g, or t
  modified_base (611)..(611): a, c, t, g, unknown or other
  misc_feature (611)..(611): n is a, c, g, or t
tcagatcagacacgcacgaccggtgctcgatttagtacagatcgttagggaaaggggggggtctcaggaggcagcgctctcaggacgtcaccaccagtcggcctgggctctgctcctcctcaccctcctcactcgaggcacgaggtcctggcccaggctcgccctgactcagtccctcctcgcgtcccggtctccgtggaccagtccacgttccaacctatccgtcctcgacctacgtgaccctaaccgagtaccgtaaggttggtaccggtttaggggttcggtttaaccgaaagtttgtcggttcctccgttacggtaacccaaacgtaacccgaacccccgaacaaacccgaccccctaaatcctataccttaacgttttagaccggttcctaaccgtccgaccgtaccctcggaccgggtacctgtactcgtcttcgtcgtcggtcctaccaacgtcgtccgacaaccgtccgccctaccgtacgcccgttcgtaccgtcggacctccgtaacgggccttagggaagacggttagacccgggtnttaacgtaacgtttacgtacctcggaccaacgtcttacctaaagtcgtagtaccgcggaaccnggaccctaggacctacccggtacctagttcgaaccgttcgtaccgggttaaccggggaccggtaaaccgtcgtacctaaccgggaccccgtcggttaacggcctaccgggaaccctttaccggcctccccgggttacccccg

SEQ ID NO: 237072 - DNA, 815 bp, Homo sapiens
  misc_feature: GYAE6OF01BYG5A.5.24.C02.1.454.CMB.1.raw
  modified_base (544)..(544): a, c, t, g, unknown or other
  misc_feature (544)..(544): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcacgcctcctccgcggtccggtctcctggacagtcacgtcaccatcctcctgctacgtgaccaaccagccgtaggtacggtacggtttgggttacgggttaccgtaagtacttcgttacccgtaccgtacggtaaacccaaaaccaaccccgaacccggaaacctaaaacccgacccccaaaacctctaacttactttaacggtttttacggaccggttacctaaccgtaccgtacccggtacccgtacgggtaaccgggtcccctaagtccgttacgtcctttccgtcgtcggtacctaccgtaagtccgtacgaaccaaccgggtccggtcccttacccgtcggtacccgtcgttccggtccggtcgtaccggngtaccggtaggtaacggagtacgggtagtcgtaagtaacgtttacgttacgacgcctacgacttaaccgtattacgtcggaacgtacgacgaacgtacccgtaggtacccgtaccccggtaccgttaggtaccgtacgggttaccgttaccggggggtaccccgggaaccgggggtaccctaacgggtccggttaacccggcccgggtttacggaaccggacccgtaaccgggaccccgtaacgggttcccccgtacccgggtaccccccg

SEQ ID NO: 237073 - DNA, 829 bp, Homo sapiens
  misc_feature: GYAE6OF01D0P13.5.24.C02.1.454.CMB.1.raw
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
  modified_base (593)..(593): a, c, t, g, unknown or other
  misc_feature (593)..(593): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctcaccctcctcactcgagggcacagggtcctcgggcccaggcctcgccctgacctcacgtccctcccgtccgccggtccggtctccgtggaccagtccagtccaacctntcctcctgaccacgtcgaccaaaccngcaggtgtacggtttggtggttacgaagttattcgtcgttccgtaggtaacccaaaccgaaacccaaccccggaacctaaaaccgacccccctaaacctaccaactttcttaagtttttcggaacggttcctaaccgtacccgccgtaacccgtccgtacggggtccctgtactcgtaccgttcctcgtccggtcctaccgtaacgtccgtacggaccaaacccgtaccggtccccttacccgaccgtacccgttcgtccgttacgggccgtaccgacggtactacggacgggtatcgggaaggttcgtacggtttaattacttacgtcgtaccacggtntcgtaaacgtttagccgggtcgaggtaccgtaacggaacccgtacgtaccgtacccggtttacccgaagttaccgggttaccggttacggttaccccgggggtttaaccggggggtaccgggtaaaccccgggaaggtttcccccggtaacggtaccccggtttacccgggaccggttaaccggaccccgggtaaccccgtacccgggtaacccggttccccggttaccccccggg

SEQ ID NO: 237074 - DNA, 872 bp, Homo sapiens
  misc_feature: GYAE6OF01DV5RR.5.24.C02.1.454.CMB.1.raw
  modified_base (188)..(188): a, c, t, g, unknown or other
  misc_feature (188)..(188): n is a, c, g, or t
  modified_base (602)..(602): a, c, t, g, unknown or other
  misc_feature (602)..(602): n is a, c, g, or t
tcagatcagacacgcacgaccggtgctcgatttagtacagatcgttagggaaaggggggggtctcaggaggcagcgctctcaggacgtcaccaaccatcgggcctgggcctcgtcgctccctcctccacccttcctcacctcgagggcacgtagggtccgtcgggcccaggcctcgccctagacctcnccgtccctcccgtccggccggttccggtctccgtaggactgtccacgtccaacctgtcctcctgacctaccgacgaacccaaaccgacgacgtaggttacggttacggtttgggttacgggttacgtaagttacgttccgttaccgttaccgtaaccgaaacccaaaacccgtaaaccccgaacccgaaaccaaaacccgaacccctaactactaacgtttacgtttagttttacggaacgttaccgtaaccgtcccgtacccggtaccgtcgggtaccggttccgtacgtaccgttccgttcgttccgttcggtaccgtacctaacgtacgtacgtacccggacccaaccgtcccgtccctccggtacctcccggttccgtccggtccgtccgtacggtacggtacgtacggngtacgggtacgtaggttactgtttaacgtttcgtacgtcgtaccgtactacgtaagtcgtacggtagaccggacgaccgtcgtaccgtaaccgtaccgtaccgtttaccgtaggttacgttaccgggttacccggggtaccggggtaccggggtaacccgggtaaccgtaccggtttacggtccccgggttaaacccggttacccgggtacccggtaccgggaccccgtacccgggttcccggttccccgttacccgggtaacccccggg

SEQ ID NO: 237075 - DNA, 786 bp, Homo sapiens
  misc_feature: GYAE6OF01BG71S.5.24.C02.1.454.CMB.1.raw
  modified_base (203)..(203): a, c, t, g, unknown or other
  misc_feature (203)..(203): n is a, c, g, or t
  modified_base (243)..(243): a, c, t, g, unknown or other
  misc_feature (243)..(243): n is a, c, g, or t
  modified_base (258)..(258): a, c, t, g, unknown or other
  misc_feature (258)..(258): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacgacgggtcctgggcccaggcctcggccctgactcacgcctccctccggcgtccgggtctccgnggacaggtccagtccaccatcctcctgacactgaccaacngcagtgacggttggngtacgagtatcgtctcgtcggaaccaacaaccgaccccgaacaaccgaccccctaaactacctacttacttaagttttcggaacgtaccgtaaccgtacccggaccgtacccgtccgggtaaccgggttccctaggtacctccggttccttcctcgttcggccttacgaacggttccgtacggacctaacccggacccgtcccgttacccggtacgtacccgttccgttaccggtccgggaccccttacgggacggtacgtcgggtaaaggtcgtagggaacggttcgtacggttaactttacgttacggtacgtaccgtacgtacctacgttaacgtaggtaccgacggttacggacggttaccaccggtaaccgtacccgtaccgaccgtacgtagggtaccgtacggttaccggggtaccggggaacccgggtaaccggtcgtacccggtcccgggtacccgttcccgggaaccggttaccccgacgggaaccccggtccggtccccgttccccccgggtacccg

SEQ ID NO: 237076 - DNA, 697 bp, Homo sapiens
  misc_feature: GYAE6OF01AK9FR.5.24.C02.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacgagggtcctgggccccaggctgccctgactcagtcctccctcggcgtccggtctccgtggacngtcagtcaccntctccngacnctgacacagcagtgtacgttggtcgttcgaagttntcgtcctcgtacggtaacccaacaaccgacccgaacaaccgacccccaaatccattaccgttagttttcgacgtaccaccgtacgtaccacccgtcgtaccgggtccctaggtctacgtccttcgtcgtcggacctacctaacgtcgtcggtaccgaaccggtaccgccctcccgtacgtcccgtcgtcggtcgggtacctaccgaggtactggtacggtaagtcgggacgtactacgttaactttacgttaactcggtctagtccgttagtacgttaggcgacggacgacgtacgtccaacgccctacgggtacccctattacgggtaccttgggtacccgggttagggtacccggggaaccgtactcgggtaacccggaccgttaccggaacggtcccggaaccgttacccggccggttccgtccccgtaccccgg

SEQ ID NO: 237077 - DNA, 788 bp, Homo sapiens
  misc_feature: GYAE6OF01DVZSB.5.24.C02.1.454.CMB.1.raw
tcagatcagacacgcacgaccggtgctcgatttagtacagatcgttaggggaaaggggggggtctcaggaggcagcgctctcaggacgtcaccaccatggcctgggctctgctcctcctcaccctctcactcgaggcacgagggtcctgggcccaggctcgccctgacctcgacgccctcccgtccggccggttccggtctccgtggactgtcgacgtccacctatcctcctgccactcgaccaacacgcgagtcggtacggtttagggtacggttacggaagttacgttcgtaccgttaccgtaacggtaacccaaaaccgaaaccccgtaaccccgaaaacgaaaacccgaacccccctaaaacttccgtaactttaccgtttaagtttttacggaacggttaccctaaccgtaccgacccgtaacccgtacgggtaccggggttcccttaagaccgttccgtacgtttcctcggtacggtacctaacccgtaagttccacggacctaaaccgcccggtccctaccgtacggtacccgttcgttcgcgggtacctccggtaggccgtagggacggtacgcgttaaggtccgtaagtttacgtttaacgttacgtcgacgtaactcgttatacgttagccgtagacgaccgtagacgaacgaccgtacctacccgtagtacggttgttaccgtaccggggtacgggaacccgggtaactacggtcggtacccggacccgttacggacgtcgaacccggacccgtacggcccgtaccccggtacccgg

SEQ ID NO: 237078 - DNA, 589 bp, Homo sapiens
  misc_feature: GYAE6OF01BR2OE.5.24.C02.1.454.CMB.1.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
  modified_base (257)..(257): a, c, t, g, unknown or other
  misc_feature (257)..(257): n is a, c, g, or t
  modified_base (364)..(364): a, c, t, g, unknown or other
  misc_feature (364)..(364): n is a, c, g, or t
  modified_base (418)..(418): a, c, t, g, unknown or other
  misc_feature (418)..(418): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccggtctccgtggacngtcagtccaccatcctcctgcactgaccaaccngcagtgacgttggtgttcgaagtntgtctcgtgtaccaacaaccaccccgaaccaaaaccccaactcatctatttgagtctactacgcgacctacgcggtcctcgtatccgtcttctcgtcgctacagtcncgaccacgccgcctccgtcgtaccgtctcgtcggcctcgcgctggagtgtacgngtactagtattactacgcgtacgactctactatacgtcgcacggcagcacgtacctacgtccgtagtcgtacgtacgttccgggtcggggtaccgggacgtacggtgtacccggtaccgtacgttacggcccgtaacggacccggacggtcccgtcccgtccccggtaccg

SEQ ID NO: 237079 - DNA, 772 bp, Homo sapiens
  misc_feature: GYAE6OF01BQQQ7.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacgagggtcctgggcccaggctgccctgactcagcctcctcgcgtccggtctccgtaggacctagtcagtcacctatcctaccgtgacactcgaccaaccgtagcaacggttggtacggtttgggtacggtttacgaaaggttcgttcgttaccttaccgttacggttaaacccaaaccgaaacccgaaccccggaaaccaaaacccggtaaccccctaaactcctaacttacttagtttttacggacggttacctaaccgtccggtaccgtaaccccgttggtaccggggttcctacgtacttcgtccttccgtcgtcggtctaccgtaagtcgtcgactaaccgccgtccttcccgtcgtacccttcggtacggttcgggaccttaccgacggtcgtacgggaaggtacgtaggtacggttactacgttaacgtttaacttcggtcgtaaccgtacgtacctaagtcgttacgtcgaacggttacgacggtacgcgtaacgtcccggtaaccttacccgagttggttaaccggtcggtttacgggaccggggacgggtaccctacggtacggtacccgttacgtacggtacgtccgtaacccggacgtacggtcccgtccccgttaacccgg

SEQ ID NO: 237080 - DNA, 765 bp, Homo sapiens
  misc_feature: GYAE6OF01CY3ET.5.24.C02.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
tcagatcagacacgcacgaccggtgctcgatttagtacagatcgttagggaaaggggggggtctcgaggaggcagcgctctcaggacgtcaccaccatggcctgggctctgctcctcctcacctctcactcgaggcacgaggtcctcgggcccaggctggccctgactcacgtcctcccgcgcggtccggtctccgtaggacngtcagtcaccntctccngcactgacaacngcagtgtacgttggagttcaagtntcgtctacgtacgtaaccaacaacccgaacccgaacaaaccgaccccaaagtcacttcttaagttttcgacgtaccacgtaccgtaccgtacctcggacgggttccctagaccttcgtaccgtttcgtcgtaccgggtaccttacctaacggttccgtaccggtaccaacccgtcccggtcccttaccccgtacgggtaccccgttcgtaaccggtccgggtaaccttccgtaacggtcgttacggaagttcgacgggtacgtacgtaagttaacttacgttaccgtacacgtacgtaccttaagtacttacggtacgcggtaaacgcgaacggtacccgacggtacccgtaaccggttcccgtagtttccggtacgttaaccggttccggggtaccgggaacccgggggttaacaaccgggttccgtaaacgggttaccccgttaacggttaccgggtaaaccgtaaccccgggaccgtaacccggtcccgttaacccgggtcccccg

SEQ ID NO: 237081 - DNA, 768 bp, Homo sapiens
  misc_feature: GYAE6OF01D8SOQ.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctccaccctctcactcgaggcacgagggtccgtggcccaggctcgccctgacctcacgccctcccgtccggccggtccggtcctccgtggacacgtcacgtccacctactcctccgtcgacctacctacgaccaaccgacgtacgtaaggttcggtacggttttgggttacgtttacttaagtcgttcgttaccgtaccgtaaccgtaacccaaccgaacccgaacccgaaccgaacccaacccctaactactacttacgttacgtttacggtacgtaccgtaccgtaccgacccgtaccgtccggtaccggtccgtcgtacgtccgtccttccgtcgtccgtaccgtacgtacgtccgtacgaccgaccgtacccgtcccgtacccgtccgtaccgtccgtccggtccggtaccgtacggtacggtcgtacggtagggtagttacggttaggtttacgttaacgtttacgttacgtacgtacgtacgtacgtacgtacgtacgtcgacgtcgacgtacgtcgacgtaccgtaccgtacgtagtcgttacgtacggtccgggtaccgggaacggtaccgtacggtaccgtacggtcccgtacggtaccgtaccgtaccggtaccgaccggttcccgtcccgtcccggtaccg

SEQ ID NO: 237082 - DNA, 786 bp, Homo sapiens
  misc_feature: GYAE6OF01EGCQP.5.24.C02.1.454.CMB.1.raw
  modified_base (561)..(561): a, c, t, g, unknown or other
  misc_feature (561)..(561): n is a, c, g, or t
tcagatcagacacgcacgaccggtgctcgatttagtacagatcgttaggggaaaggggggggtctcgaggaggcagcgctctcgaggacgtcaccaccatggcctgggctctcgcctcctcctccaccctcctcactcgagggcacgacgggtccgtcggcccaggctcgccctgacctccgaccgccccccgtcggccggttcccggtctaccgtcggactagtccacgtaccacctctcctccgtacgacctcgtacgaccaaccgacgcgtaggtcgggttaacggtttggggtaacggtttacgaaagttcgtccgttccgtacccggttaaccggtaaacccaaacccgtaacccgaacccccggtaaacctaaacccggacccctaaaacgtcttacgttactttaacggtttacggaaccgtcctaaccgtacccggcccgtaacccgtggtaccgggtcctagtaccttcgtacttccggcgtccggtactcctaggtccacggaccctacgtcccgcccttcgaccgtccgtcgtcgtaccgccgttacggngtcacgggtaatcgtaggtacgttacgtaagttactactccggtataacgtcctacgtaacttaggtacgtacggaccgtaaacggtccggaagtcccgaagttacccgtccgttaacgtagtcgttccgttaccgggtacggtccgggaacgtccgtacggttccgaccggttacgcgtacacccggttacgaccccgtagggtcccctccgggtcccgtcccg

SEQ ID NO: 237083 - DNA, 743 bp, Homo sapiens
  misc_feature: GYAE6OF01CYZ4Z.5.24.C02.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (496)..(496): a, c, t, g, unknown or other
  misc_feature (496)..(496): n is a, c, g, or t
tcagatcagacacgcacgaccggtgctcgatttagtacagatcgttagggaaaggggggggtctcaggaggcagcgctctcaggacgtcaccaaccatggcctgggctctgctcctcctcaccctcctcactcgagggcacgagggtcctcgggcccaggctgccctgactcacgcctccctccgcgtccgggtctcctggacngtcagtccaccatcctcctgcctacgtcgaccaaccgnggacagtcgtacggtttggtaggttaccgtaagtacttggtccttaccgtacggtaacccaaaccgaaacccgaaccccgaaacctaaaccgaacccccctaaaatccaacttacttagtttttacgacggtacctaccgtaccgacccgtacccgtaggtaccgggtacccctaggaactccgttccttactcgtcgtacttaccgtaacgtcgtacgaccaaccgtaccgtccctacccgtacgtacccgtnttaccggtcgggtacctcgacgggtacctgggaacgttacgacgggtacggtccttaaggttaacttacgttacgtagtaccgtagtccgtactaagtaccgtagacgtacgacgacgtaccgaactccgtaccgtcccgtagttcggtacctgtcccgggttacggggaccgggaaacgtacgtcggtaccgtacccggtacgacgttaccgaacgtaccggtaacggcccgtacccgtaccccgg

SEQ ID NO: 237084 - DNA, 592 bp, Homo sapiens
  misc_feature: GYAE6OF01ANE9W.5.24.C02.1.454.CMB.1.raw
  modified_base (229)..(229): a, c, t, g, unknown or other
  misc_feature (229)..(229): n is a, c, g, or t
  modified_base (400)..(400): a, c, t, g, unknown or other
  misc_feature (400)..(400): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
  modified_base (460)..(460): a, c, t, g, unknown or other
  misc_feature (460)..(460): n is a, c, g, or t
  modified_base (466)..(466): a, c, t, g, unknown or other
  misc_feature (466)..(466): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacagtcagtcaccatcctcctgcactgacaaccngcagtgtacgttgggtggttacgaagttcgtgttcctcctaggtaacccaaaccaaccaaccccgaacaaacccgacccccaaactcctactcttagttttagacgtccactacgccgtaccctcgtaccgggtccctgacttccgtcttcctcgtcgacctacaacgtcncgacacgccgcctcctcgaccgtctcgcggctcgngctgagngtcgagtntagtatttancgtgcncgtctagntncgcgacgactgacgcgtacgtacgtcctagtcgacgtcgtaccggtcgggaccgggctaccggcgtaccgtaccgtacggtacgtaccgaccggacccgtcgtccgtcccgtcccg

SEQ ID NO: 237085 - DNA, 701 bp, Homo sapiens
  misc_feature: GYAE6OF01CJ2MP.5.24.C02.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacgagggtcctgggcccaggctgccctgactcagcctccctccgcgtccggtctctggacngtcagtcaccntcctcctgcactgacaaccgngcagtgtacggttggtggtcgaagtntgtctctgtaaccaacaaccacccgaacaaccaccccaactcactcttagttttacgacgtacacgtaccgaccgtaccgtcggtacgggtccctgtacgtacgtcttaccgtctcggtccaccgtaagtcgtaggaccaaccgtccggtccctcccgtcgtacccgtccgtacgtccggtcctacgaccggtacgttaggacgtagtacgggagtacgtagttacttacgttacgtagcgtaacgtacctactagttcgacggtacgacgtacgtaccggacgtcgtacccgtacccgtaccgtagttaccggtacgtaccgttaccggggtaccggggaacggggtaccgtaacgggccggttaacccggttacccgggttaccgtacggttaccccggacccggaacccttaccgggttccccgtcccgttaccccccggg

SEQ ID NO: 237086 - DNA, 741 bp, Homo sapiens
  misc_feature: GYAE6OF01AWBC1.5.24.C02.1.454.CMB.1.raw
  modified_base (262)..(262): a, c, t, g, unknown or other
  misc_feature (262)..(262): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccccgtgacctcaccgtcccctcccgtccggtccggttccggtcctccgtaggactagtcacgtccactacttcctccgtcgacctacgtcgaaccaaaccgngacgtaggtacggtacggttgggttacggttacgtaagttacgtcgttcctacgtaaccgtaacccaaaccgaacccgaaccccgaaacaaacccgtaaccccctaactacctaacttacttagttttacggacgtccaaccgtaccgaccgtacccgtacggaccgggttccagtacctacgttccgttctcggtcggtacctacgtaacgtcgacgacgaaccgccggtcctaccgtcgtacccgtctcggcgcctacgacgtcgtaggacgtacgaggacgtctagttaactttacacgtcgtacgtactactacgttagtagccgacggacggtacacgtacgacgaccgtacccgtaccgtagtcggtacgtacggttacccgggtacgggggaaccgggtaccgtagtacggtacccgtacccggtacgttacggaccgaacccgtaaccggtaccgtccgtcccgtccccgg

SEQ ID NO: 237087 - DNA, 612 bp, Homo sapiens
  misc_feature: GYAE6OF01AM8OA.5.24.C02.1.454.CMB.1.raw
  modified_base (225)..(225): a, c, t, g, unknown or other
  misc_feature (225)..(225): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctctcactcagggcacagggtcctgggcccaggctgccctgactcacgcctcctcgcgtccgggtctcctggacagtcagtcacatctctgcactgacaaccngcgagtcgacgttggtggttcgaaagtntgtctctggtaccaacaccacccgacaaacgccccaaactcatctattttcgacgtcactacgccgacctcgcgggtcctgtactcgtcttcgtctcggtctcgagtctggacacacggccctcctcgacccgttcgtcgtcggtcctccgaggtccgtagtacgggtatcggtacggtcgtagtaactttactaacgttcgacgtacgtctactagtactcggacacggtcacggtacgacgacgtccgtaccctagtcgtacggtaccttcgggttaccgggaccggggacttacggccggttaccgaccggttacgaccgttacgaaccgtccggtaaccgcgtcccgtaccccgg

SEQ ID NO: 237088 - DNA, 715 bp, Homo sapiens
  misc_feature: GYAE6OF01EK621.5.24.C02.1.454.CMB.1.raw
  modified_base (187)..(187): a, c, t, g, unknown or other
  misc_feature (187)..(187): n is a, c, g, or t
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
tcagatcagacacgcacgaccggtgctcgatttagtacagatcgttagggaaagggggggtctcaggaggcagcgctctcgaggacgtcaccaccatggcctggctctgctcctcctcaccctctcactcagggcacagggtcctgggcccaggctgccctgactcagcctccctcgcgtccggtcncctggacagtcagtcacgntccnctgcactgcaactgcagtgacgttgtgtacaagtntgtctcagtaccaacaacacccgacaaacgccccaaaactcattcatttttcgagtcactacgcaaccctcgtaacggtccctagactcgtcttctcttacggctacctaagtcctcggacaaacctaccggcccttaaccgtcgaccgtcgtccgtgggtcctacccgaagtccgttacggaggtaacgtacggtacggtaacgttcggtaaacgtttaactttaacgtacgtaccgtaacgtaccgtacctaagtaaacttcggacgaaacggacgaacgttaccggtaacgacccgtaaccggtacccccgtaagttccggttaacggttaaaccgttccgggtttaaccggggacccggggggtaaaccctacggggtaacccgttccgggtaaacccgttcccggtaaaccggtacgttaaccggaaccccggtttaaacggccccgttaccggtacccccccgg

SEQ ID NO: 237089 - DNA, 772 bp, Homo sapiens
  misc_feature: GYAE6OF01EI15R.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcgacgggacacgagggtccgtcgggcccaggctcgccctgactcacgccctccctccgcggtccggtctcgtcggacacgtcagtaccaccattcctcgtcgaccacgtcaccaaccgagacaaggttcggtacggttgggtcggttacgaagttcgtcgtcctctaacggtaaccaacctaaacccgacccgaaccaaaccgtacccctaaactctaacgttacttaagttttcgacgtacgtactacggtacccgaaccgtcggtacgggttcctaggtacgtcctcgttactcggacctacaacgtcgtcgtacggacctaccgaccggtcccttaccgtacgggtcccttcgtcggacggtaccgtcggacgtacgagtacggacgtggtacggtctaacggttaacttacgttacgttacggccaacgttcctactagtacgtcgacggacgtacgacgcccacggtccgtaaccgtcgtaacgttcggtacgtttacgggtacccgggtaccgggggtaaccgggaaccgttaaggggtacccgttcggtaccccgggttaagggaacccggtttcccggaaacccggggttaaccctaacccgggttcccggtcccccgggtttaaaccccggg

SEQ ID NO: 237090 - DNA, 724 bp, Homo sapiens
  misc_feature: GYAE6OF01CNLHZ.5.24.C02.1.454.CMB.1.raw
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
  modified_base (543)..(543): a, c, t, g, unknown or other
  misc_feature (543)..(543): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctccaccctcctcactcgagggcacgcgggtcctcgggcccaggctcgccctgactcagccctcccgtccgcgtccggtctccgtggacagtcagtccaccatcctcgngcactgaccaaccgngcaagtcgtcggttggtggtacgtaagttgtcgtcctccgtacggtaaccaaccaaccacccgaacaaaccgaccccaactcatcttatttgacgtcactaccgaccgaccgtcggacgggtcctagactccgtcttaccgtcgtcgtactccagtcgtacggaccaaccgtccggccctccgtcgacccggttctcggtccgtccgtaccggcgggtacagggtagacggttacggacgtcgttacgtaacgtttacgtttacgcgttacgcgtcttagacttacggtcgaccgtaggacncgtacgacgtcccgtaacgtacctacggttacgtacggacgtttccgggggaccggggacccggggaaacgttacccgggtacccggtaaccccggggtttaccgtaaccccggtaccggggtaccaaccccgggttaacccctcccggggggtaaccccttccccgggttcccccccggg

SEQ ID NO: 237091 - DNA, 881 bp, Homo sapiens
  misc_feature: GYAE6OF01CL641.5.24.C02.1.454.CMB.1.raw
tcagatcagacacgcacgaccggtgctcgatttagtacagatcgttagggaaaggggggggtctcaggaggcagcgctctcaggacgtcaccaccatggcctggctctgctcctcctcaccctctcactcgaggcacgagggtcctgggcccaggctgccctgactcagcctccctccgcgtccgggtctccgtggacagtcagtccaccattcctccgtgacctaacgtcgaccaaacccgagacctaggtcggttacggtttggggttacggttacgaagttacgttcggttaccgttccgtacggttaacccaaaccgtaaacccgaacccccgaaccaaaaccggaaccccccaaactacctaacttaccttagttttttacgacggttaccaaccgttaccggacccgtaccccgttacgggtaccgggttccccgttacggtaaccgttccgtcctttccgttccgttcggtccttaccgtaaacgttccgtaacggacccgtaaaccgacccggtcccttcccgtaccggtacccgtttcccgttccggttccgggtacccgttaacccggtacgggtccgttacgggaacgggtacggttacggggaacggtacggttacgttaaacgtttaacgtttacgtaccgtacgtaccgttacgtacttaacgttaacgtcggtaacgtacggaccgaacgacggtaacgtacccggtacccgttaacccgtggttaccggtacggtaccggttaccggggttcccgggggaaaccggggtaccgtacccgggtaccggtccccgggtaaaccgtcccggttaccggacgttacccggaacccggttacccggtaccggtcccccgttacccccggg

SEQ ID NO: 237092 - DNA, 734 bp, Homo sapiens
  misc_feature: GYAE6OF01AKF0F.5.24.C02.1.454.CMB.1.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (389)..(389): a, c, t, g, unknown or other
  misc_feature (389)..(389): n is a, c, g, or t
  modified_base (566)..(566): a, c, t, g, unknown or other
  misc_feature (566)..(566): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctcgggcccaggctcgccctgacctcacgccctccctccgcgtccgggtctccgtggacngtcacgtcaccntctcctgcactgaccaactagccagttggtacgttgggtggtacgaagttacgtgttccgtccgtacggtaacccaaaccaacccaccccgaaacaaacccgaccccctaaactcctacttccgttaagtttttcgacgttcacgtaccggccgacctcggacgggtcccngtacctcgtcttcctcgtccgtactccgtaacgtccgtacggaccaaccgccggtcccttacccgtcgtacccgtcttcggtacgggtaccctccggtacggtccgtaggacgggtatggtaacggtcttaagttagtttactacgcgtacgacgtctacgtactagtccggtaacnccgggtacgtaaccgccggtaacgtcccgtaacccgtcccgttagttaggtccgtacgggttacccgggtccgggggaacccgggtctaccggacggttacccggtacccgttaccggtaccggacccgttaccggaccccgtcggtccccgttcccggtacccccgg

SEQ ID NO: 237093 - DNA, 614 bp, Homo sapiens
  misc_feature: GYAE6OF01EIX0N.5.24.C02.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (287)..(287): a, c, t, g, unknown or other
  misc_feature (287)..(287): n is a, c, g, or t
  modified_base (327)..(327): a, c, t, g, unknown or other
  misc_feature (327)..(327): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacngtcagtcaccatctcctgcactgcaaccngcagtgagtttggtggttcgaagtntgtctcctggtatcaaacaacaacccgacaaacncccccaaactcatctattttgaggtcactacgcgaccctnacggggtccctgatccgtcttctctaggcctcgaagttctaggcaaacaccggcctacccgtgacccgtctcgtcgggcctccgaggcctaggaggagttggaacggctgtaattatttacgtgtacagtctctaattagtagcacgggactagacgacgccgaacgttccccaagttcggttagtacgttccggttccgggggacggggggtaacccaacggtccggacggtacccggttacccgttacgggacgtaccggacccgacgggtcccgttaccccggg

SEQ ID NO: 237094 - DNA, 811 bp, Homo sapiens
  misc_feature: GYAE6OF01D89ZQ.5.24.C02.1.454.CMB.1.raw
  modified_base (757)..(757): a, c, t, g, unknown or other
  misc_feature (757)..(757): n is a, c, g, or t
tcagatcagacacgcacgaccggtgctcgatttagtacagatcgttagggaaaggggggggtctcaggagcagcgctctcaggacgtcaccaccatggcctgggctctgctcctcctcaccctcctcactcagggcacgagggtcctgggcccaggctgcctgactcacgcctccgtcgcgtccgggtctccgtggacacgtcagtcaacctactcctcctagacaccgtcgacaaccgagctaggttacggtacggtttgggttaggttacgaagttacttgtacctccgttacggaacctaacaacccgaaccccgaactaaaacccgaccccctaaaatcctaactttacctttaagtttttacgggaaccgttacgtaacctaaccggacccgtaacccgttcgggaccgggtttacccctgtaccgttccggttctttacgtccgtacggtacctacgtaacttcgtacgaacctaaaccgccgtacccctaccgtttacggacccgttcgttacggttccggaaccttcggtaacggtccgtagggtaacgtacgtacggggacgttcgtaaacgtttaacgtttaacgtcgtcggtaacaacgttccaacgtttagtacggtagcggtaacgcgacgtacgaacgttcctaccggttaccaggttacgttaccggtacgtttcccggggtaaacgggggaccggggttaaacctaccggggttacccgtaccgttacccggggtttaaanaacccggggtccaacccgtacccgggtaccggtcccgttccccgtacccccggg

SEQ ID NO: 237095 - DNA, 819 bp, Homo sapiens
  misc_feature: GYAE6OF01ALUVA.5.24.C02.1.454.CMB.1.raw
tcagatcagacacgcacgaccggtgctcgatttagtacagatcgttagggaaaggggggggtctcaggaggcagcgctctcaggacgtcaccaccatggcctggctctgctcctcctcaccctctcactcagggcacacggtcctgggccaggctgccctgactcagcctccctcgcgtccggtctcctggacagtcagtcacctatcctccgtgaccacttcgacctaaccgagcaagttcggacggtttggtcggttacgaaagttcgtcgttaccgtccgtacggtaacccaaacgtaaacccaccccgaacaaaacccgtacccccaaactcctaacttctacgtttttacggacgttaccaccttaccgccgtacccgtacgacgggtccctagtactccgtactttccgtcttcgccttaccgtacgtcgtcggaccacgtaccggtccttccgtacggtacccgttccgtaccgtcgggtacctaccgacggtacgtacggacggtagtacgggacggtacgttacgttaacgttttaacgtacgttacggacgttaacgccgtttaccgtaacgttactccgggtaacggacggtacccgtaacggtacccgtacggtacccttaacccggttaccctaacggtttcgggtaacgttacccgtttaccgggggttacccgggggtaacccgggggtaaacccttacgggtaacccggttaacccgggtttacccggtacccgggttaacgggtaaccccggtaccggtaaccccgtaccgggtacccccgttcccgggttaacccccccgg

SEQ ID NO: 237096 - DNA, 883 bp, Homo sapiens
  misc_feature: GYAE6OF01B8BCZ.5.24.C02.1.454.CMB.1.raw
  modified_base (854)..(854): a, c, t, g, unknown or other
  misc_feature (854)..(854): n is a, c, g, or t
tcagatcagacacgcacgaccggtgctcgatttagtacagatcgttaggggaaaggggggggtctcaggaggcagcgctctcaggacgtcaccaccatggcctgggctctgctccctcctccacccctcctcactcgagggccaacgcgggtcccgtgggcccagggcctcggcccctggactccacgccctcccgtccggccggtcccgggtcctccgtggacctaggtcaggtccacctactcctcctgaccactcgacccaacgagaccgtacggtcggtacggtttggggttacggttacgaaagttcgttcgttaccctaccgttaacggtaaacccaaaccgaaccccgaaccccggaaccaaacccgacccccctaaacctccgtaattcctttaaggtttttcggaacggttacctaccgtaaccggtacccgtaacccgtacgggacccggggttcctacggtacttcccggttcctttcctcggtaccgaccgttaccgaacggttaccgaccggaaccaaacccggcccggttacccctcccgtaccggtcccgtcgtaccggtccgggtcctaccgggacgtaccgtaggaacggtacggtagggtaccggttacgtaagttaacgtttaacccgtttaccgcgtacccgagtttaaccctaggtactacgtaccgtacgggacgtacggaacgtccggtaaccgtacccgtacccggtaaccgttagtacgggttccgtttaacggttccccgggggtaacgggggaacccggtaccgggtaccttacccgggtacccggttacccggtacccgggtaccgtaccggacccggttaacccncggggttcccccgtcccccgggttacccg

SEQ ID NO: 237097 - DNA, 674 bp, Homo sapiens
  misc_feature: GYAE6OF01CLD2F.5.24.C02.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcacgggcacgagggtcctcgggcccaggctgccctgactcagcctccctccgcgtccggtctccgtggacngtcagtcaccatctcctgcactgaccaaccngcagtgtacgttggtggttcgaagtntgtctcgtggtaaccaacaaccacccgaacaaccgaccccaactcactcttagttttcgacgtcaacgtaccgccgtacccgtcggacgggttccctagtacgtccgtccttccgtcgtacggtcctaccgtaacgttccgtcggaaccctaaccgaccggtccctacccgtacgtacccgttcgttccgtcgggaccctacggtacggtacgtacggtaggtacgtacgggacgttcgtagtaactttcgtacgtcggtactacgtcgtaactagtacgtcgacgaggacgacgccgacgtacgtaccgtaccgtgtcgtcgtaccggtaccgggtcggggaaccgggtactaggtaccgtaccggaccgttcgtaccggtacgacgtacccgacgggtccctccggtaccccg

SEQ ID NO: 237098 - DNA, 817 bp, Homo sapiens
  misc_feature: GYAE6OF01CAM2R.5.24.C02.1.454.CMB.1.raw
tcagatcagacacgcacgaccggtgctcgatttagtacagatcgttaggggaaaggggggggtctcaggaggcagcgctctcaggacgtcaccaccagtggcctgggctctgctcctcctccaccctcctcactcgacgggcacgacgggtccgtcgggcccaggctcgccctagacctcacgccctcccgtccggtccggtccgggtctccgtggacacgtcacgtccactactcctccgtcgctacgtcgaccaaaccgcgccgtaggtacggttacggtttcgggttacggttaacggtaagttcgttcgttacccgttaccgtaacggaaacccaaaaccgaaacccgaaccccggaaaacctaaacccgaccccctaaactacctaactttacgtttaacgtttttacggaaccgttaccgtaaccgtacccggtacccgtaaccggtaccggtaaccgggtccctacggtacttccggttactttaccgtccggtaccggttacctaacggtaacgttcgacgaccgaaccgtccggtccttaccgcgtaccgtcgtccggacgtcctcggacgacgtagacggtacgtaggtacgtacgttatacgtttacgtacgcgtactacgtactagtaacgtcgacgtacgacgtacgacgaccgtacgcgtaaccgtaccgtagttcgtaacggttcgggtaccggggttaccgggggaaaccggtaccgtaacggtaccggttaccgggaccggttaccggtacggtaccggacccggaccgggtaacccggtcccggttccccgtacccggg

SEQ ID NO: 237099 - DNA, 880 bp, Homo sapiens
  misc_feature: GYAE6OF01C3HLK.5.24.C02.1.454.CMB.1.raw
  modified_base (169)..(169): a, c, t, g, unknown or other
  misc_feature (169)..(169): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcatcgagggcacgagggtcctcgggcccaggcctgcccctnacgtcacgccctcccgtccgcggtccggtcctccgtggacgtaccacgtccacctatccgtcctgaccactcgaccaacgcgacgagtacgtacggttgggtacggttacgtaagtgttacgtcgttaccgttacggtaacccaacaaaccccaaccccgaaaccgaacccgaaaccccctaaagtcctaacttacttaggtttttacggaaggtacctaaccgtaccgacccgtacccgtccggtaccgggtaccctcgaccgtccgtccttcgtcgtacgaccgtaccgtaacggttcgacggtacgaaacccgttcccgggtcccttacccgtccggttaaccgttccgtacgggtaccggttcccgccgtaacgggtcgaccgggtaacgtaggtacgggaccgttaggtaccgtttaaagttaccgttaacccgtaggtccctaacgtaccctagtaaccgtacgtaggaccgtaacgggtacaacggtccgacccggttaccctaaccccggtccgttaaggttaccggtaacccgggttcccggttaacccggggggttcccgggggggacccgggggtaactaacccggggttaccggggtaaacccgttaccccggggtttaaggaaaccccggttcccggggaaaacccggtacccccggtaccggttacccccccggtcccccggggttaaccccccggg

SEQ ID NO: 237100 - DNA, 669 bp, Homo sapiens
  misc_feature: GYAE6OF01ELZTS.5.24.C02.1.454.CMB.1.raw
  modified_base (199)..(199): a, c, t, g, unknown or other
  misc_feature (199)..(199): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (525)..(525): a, c, t, g, unknown or other
  misc_feature (525)..(525): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcacgcctccctccgcgtccggtctcgtgacngtcagtcaccatcctctgcactgacaccagcagtgacgttggtgtcgatntntactctagtacaacaacacccgacaaacgccccaactcactctatttgagtcactcgccgaccctcgacggtccctgtactccgtcttccgtcgtcggtcctaccgtaacggttccgtacggaccaaccgtaacccggtccccttaccccgtacgtacccggttccgtaccggttccggggaccttacccggaggtaccgtagggacggtagtcgggtacggcgttaacgtacgtttaacttacgtacgtcgtaccgtcttagtaacttaacgnggtaccggaggaccgtagaccgtacgacgaccgttaccctagcgttaccgtacggttccgggtacggggaccgggtaccgacggtacgtcccggtaaccggtcgttacggaccaccggaccgtacgcccgttcccggtaccccg

SEQ ID NO: 237101 - DNA, 729 bp, Homo sapiens
  misc_feature: GYAE6OF01B2VTN.5.24.C02.1.454.CMB.1.raw
  modified_base (243)..(243): a, c, t, g, unknown or other
  misc_feature (243)..(243): n is a, c, g, or t
  modified_base (273)..(273): a, c, t, g, unknown or other
  misc_feature (273)..(273): n is a, c, g, or t
  modified_base (316)..(316): a, c, t, g, unknown or other
  misc_feature (316)..(316): n is a, c, g, or t
  modified_base (518)..(518): a, c, t, g, unknown or other
  misc_feature (518)..(518): n is a, c, g, or t
  modified_base (525)..(525): a, c, t, g, unknown or other
  misc_feature (525)..(525): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctccaccctcctcactcgagggcacgagggtccgtgggcccaggctcgccccgtagacctccgacgccctcccctccggtccggttcccgggtcctccgtggaaccaggttcacggtaccaacctnttcctccgtagcctacgtgacccgaaaccngaccgtaggttcggtacgggtttgggtacggttacggaagttnttcggtacctccgtacggtaacccaaccgaaccaccccgaacaaacccgacccctaaactcctacttcgttattttcggacgttacacgtaccgccgacccgtcgacgggtcctgctcgtctctcgtcgtctacgacgtcgcgacctaccgccggtccctcgtcgtaccgtcgtccgtcggtccgtcgacggtcgtagacgngtacggngtacgttagtacgtttactacgcgactagtacctcaagtgaccgacgcgacgtacgaccgtacgaccgttacccgtccgtagttacggtacggttcggttcgggtaacccgggggtcggtaaccgtacgggtaccgtcccggtaccgtaccggtaacgggtccgaacccggacggtacccggtccccggttccccggtacccgg

SEQ ID NO: 237102 - DNA, 980 bp, Homo sapiens
  misc_feature: GYAE6OF01EZU9R.5.24.C02.1.454.CMB.1.raw
  modified_base (236)..(236): a, c, t, g, unknown or other
  misc_feature (236)..(236): n is a, c, g, or t
tcagatcagacacgcacgaccggtgctcgatttagtacagatcgttaggggaaagggggggggtctcaggaggcagcgctctcaggacgtcaccaccatggcctgggctctgctcctcctcacccctcctcactcgagggcacagggtcctgggcccaggctgccctgactcacgcctccctccgcgtccgggtctccgtggacagtcagtcaccatctcctgcactgaccaaccngccaggtcggtacggtttgggtcggtttacgaaagttagttcgttaccgttcccgttacgggtaaacccaaaaaccgaaaacccccgaaaccccccggaaaaccaaaaaaccccggtaacccccccctaaaaaaccttaccccgtaaactttaaccctttaacggttttttttacgggtaaaccggggttaacccgtaaacccgttaacccgggtaccccggttaaccccccgtttaccgggtaacccgggggggtttaccccctttacgggtaaccgttcccggttaccgttttcccgtttacccgttccggggttacccttaaccccggttaaacgggtttcccggttaaccgggtaacccgtaaaaccccggtaaccccggggttccccccgtttacccccggttaccgggtacccccggtttacccgttcccggttccgggggtaccccttacccgggaacgggtccggtttaacgggtaacgggtacggtacggggtaacgggttacgttacggttaacgttttaaacgtttaccgttacggtaccgtacgtaccgttactaagttacgtacggacgtacgggacacggacgacgtacctaccgtcccgtagttcggtagtacggttaccgggtaccgggggaccgggggtaccgaaggtcccggttaccggtacccggttaccgtaccgggtaccggtaaccggaacccgggtacggtcccggtcccggtacccccgg

SEQ ID NO: 237103 - DNA, 894 bp, Homo sapiens
  misc_feature: GYAE6OF01DY4SV.5.24.C02.1.454.CMB.1.raw
tcagatcagacacgcacgaccggtgctcgatttagtacagatcgttaggggaaaggggggggtctcaggaggcagcgctctcaggacgtcaccaccatggcctgggctctgctcctcctccaccctcctcactcgagggcacgacgggtcctcgggcccaggtcctcgaccctggacctcgacgtcccctccccgtccggtccggtccgggttcctccgtaggactacgtcacgtccaacctaccgtcctcctcgacctacgtacgaccaaccgacgactacgggttcggtaccgggtttgggttacggttaacggaacgttacgttccgttacccgttaccgttaaccggtaaaacccaaaacccgtaaacccccgaaaccccggaaaaccgtaaaaccccgaacccccctaaaacttacctaacgtttacgtttaacgtttttaccggaacgtttaaccgtaaccttaccggaacccgtacccggttaccgggtaccggttacccgttagtaccgttcgttaccgtttcgtccgtaccgtaccgtacgtaacggtccggtaaccgaaccgtaacccgtaccggtaccccttaccgtaccgggtacccgttccgtccgggtccgggtaccctacgggaccggttacgaagggtaacgggttaacgttcgggtaaacggtcgttaaggtttacctttaaggttacccgttgaccgttataccgtaacttaggtacgcgaacggtacgagtacgaccgtacgtaacctcccgtacgtagttacggccggttaccggttaccgggtacggggaaccggttacgacggttccgaccggttacctccgggttaacggcccaaccgggtaccctaccggtcccgtcccgttaccccggg

SEQ ID NO: 237104 - DNA, 932 bp, Homo sapiens
  misc_feature: GYAE6OF01DUHY9.5.24.C02.1.454.CMB.1.raw
  modified_base (141)..(141): a, c, t, g, unknown or other
  misc_feature (141)..(141): n is a, c, g, or t
  modified_base (219)..(219): a, c, t, g, unknown or other
  misc_feature (219)..(219): n is a, c, g, or t
  modified_base (620)..(620): a, c, t, g, unknown or other
  misc_feature (620)..(620): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgaggcacgngggtcctcgggcccaggcctcgccctgactccgacgccccttcccgtccgccgttccgggtcctccgtggactgtacncgtaccacctactcctcctgcctacgtcgaaccaacctgtacgacgttacggtaggtttcgggttacgtacggtaagttgttcgtaccgttaccgtaccggtaaaccaaaccctaaacccgaaccccggtaaaccaaaacccgtaaccccctaaactaccactttacgtttacgttttacggaacgttaccgtaaccgtaccgtacccgtacccgtacggtaccggtacctacgtcttccgtacttccgcgtacgtacctacgtacgtcgtaacaccgtaccggtaccgtaccctcgtacggtccctcgttacggtccggtaccgtacggtccggtacggtaacggtaacggtacggtaccgggtacggttaccgtaagtttaaccttaacgtaaccgttnaacccggttacgtaccttacggtaacttaccgggtacgtaaccgggtacgtaacccggtaccgaacgggtccccgttaaacccgttaccccgttacggtaacccgtttacgggtaaaccccgggtttaaccgggttcccccggggggttaaaacggggggtaaaccccggttaaaccgggtaacccggttaaaccccggggttaccccgggttaaccgggtttaaacccccgggaaccgggtttacccccgggtaaacccgggtacccccgggttaacccggttcccccggttaacccccggggttaccccc

SEQ ID NO: 237105 - DNA, 711 bp, Homo sapiens
  misc_feature: GYAE6OF01BCZJE.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgacgggtcctgggcccaggcctcgccctagactcacgccctcccgtccgccggtccgggtctccgtggacagtcagtccaccatcctcctgcacgtcgaccaaccagcaggtcgtacggttggtggttacgaagtgtgtctaccgtacgtaccaacaaccgaacccaacaaaccgacccccaaactcattcttagttttaggacgtacaccgtaccgccgtacccgtcggtaccgggtccctagtactccgtacttctcgtcgcctacgacgtcgtacgacaccgccggtccctaccgtcgaccgtcgtcgtcgggtcctcgaggtctagacggtagtcggagtacgtaggttacttacgtacgtcgtacgcgtacctgtatacgtacgccgagtaaccacggtacgtaccgaaccgtacccggtacctaggttaccgtaggttaccggttccgggtacccgggggtaaacggtacccgtacgggtaacccggttcccggtaacccggttacgtacccggtaccggtaacccggacccgggtaccggtccccggttccccggtacccccggg

SEQ ID NO: 237106 - DNA, 865 bp, Homo sapiens
  misc_feature: GYAE6OF01EATXA.5.24.C02.1.454.CMB.1.raw
  modified_base (201)..(201): a, c, t, g, unknown or other
  misc_feature (201)..(201): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggcctcgccctgactcacgcctccctccgcgtccggtctctggacngtcagtcacctatctcctcgcactcgacaaccagctagtcggtacggttgggttaggttacgtaagttacgtcgtccgttaccgtacggtaacccaaacgaaacccaaccccgaaaccaaaacccgtacccccaaactccaacgttacttaagtttttcggaacggttacctaaccgtaccggacccggtacccgtcgggtaaccggggttcccctaggtaccttcccgttccgtttcgttaccggtccggtaccgttaccgtaaacggttccgtaccggaacctaacccggtacccgtccccgtacccgttacccggtacccggtttccggttccggtccgggtcccttccgggtacggtccggtacgggtaagggtacggtacgggtacggttacgttagttaacgttttaacgttaacgtacgtacgtaccgtaccgttacttaacgttacgtacggtacggtaacggtaccgacggccgtaacggtaccgtaacccgggtacccctaggtacggtacgttaccgggttacccgggggttaccgggggaaccggggtaaccgtaaccggtaccgggttaccggtaacccgggttacccgtaaccgggtaccgtaacccgggaacccgtacccgggttccccggtacccccggttaccccgg

SEQ ID NO: 237107 - DNA, 683 bp, Homo sapiens
  misc_feature: GYAE6OF01AS1CS.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcacgcctcccgtccgcgtccggtctccgtggacagtcagtccacctatcctcctgccactcgacaaccagccgagtcggtacgttgggtcggttacgaagtactcgtcctccgtacggtaacccaacgtaacccaccccgaacaaacccgaccccaaactcaacttcttagttttacggacgtaccactaccgaccgtacccgtcggtacggggtccctaggtactccgtacttcgtcgtcggtacctaccgagttcgacgtaccgaaccgtaccggtcccttcccgtacgtacccgttcgtccggtacgggtcctaccggtaggcgtaggacgtagtcgggtacgtcgtagttattaccgttcgtcgactacgtactatacgtacgtcgacgacgagacgtcgtaacgcctaccgtccgtagtccgtaggtcgtccgggtacggggccgggaactcggtaccgccggttaccgtacggtacgaccgacgacccgtggtcccgtcccgtaccccgg

SEQ ID NO: 237108 - DNA, 500 bp, Homo sapiens
  misc_feature: GYAE6OF02JBVXF.5.24.C02.1.454.CMB.1.raw
tcagatcagacacgcacgaccggtgctcgatttagtacagatcgttagggaaagggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaacgcccccaaactcatcattttgaggtcactacgcgaccctcagggtccctgatcgcttctctggctccaagtctggcaacacggcctccctgaccgtctctgggctccagctgagatgaggctgattatactgcagctcatatgcaggcagcagcacgtcccatgtgatcgttcggcgggggaccaagctgaccgtctaggtcacgccaggctgccccg

SEQ ID NO: 237109 - DNA, 526 bp, Homo sapiens
  misc_feature: GYAE6OF02FN195.5.24.C02.1.454.CMB.1.raw
tcagatcagacacgcacgaccggtgctcgatttagtacagatcgttagggaaaggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgacccgtctctcgggctccgaggctgaggatgaggctgattatactgcagctcatatgcaggcagcagcacgtccccatgtgatcgttcgggcgggggaaccaaggccgtgacccgtccgtacggtccacggcccgaaggcctcgtcccccg

SEQ ID NO: 237110 - DNA, 514 bp, Homo sapiens
  misc_feature: GYAE6OF02I9B6L.5.24.C02.1.454.CMB.1.raw
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaacgcccccaaactcatcattttgagtcactacgcgaccctcagggtccctgatcgcttctctggctccaagtctgcaacacgcctccctgaccgtctctgggctcaggctgagatgagctgattatactgcagctcatatgcaggcagcagcacgtccccatgtgactcgttcgggcggggaccaaggctcgacccgtcgtacggtccacgcccgaacggctccgtcccccg

SEQ ID NO: 237111 - DNA, 517 bp, Homo sapiens
  misc_feature: GYAE6OF02HO99J.5.24.C02.1.454.CMB.1.raw
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctctggtaccaacaacaccccgacaaagcccccaaactcatcatttttgagtcactacgcgaccctcacggggtccctgatcgcttctctggctccaagtctgcaacacggcctcctgaccgtctctgggctccaggctgagatgaggctgattattactgcagctcatatgcgagcagcagcacgtcccatgtgattcgtcggcggggaccacggctacgaccgtccgtaggtccgacgacccgaacggcctcgtcccccg

SEQ ID NO: 237112 - DNA, 511 bp, Homo sapiens
  misc_feature: GYAE6OF02G11OK.5.24.C02.1.454.CMB.1.raw
tcagatcagacacgcacgaccggtgctcgatttagtacagatcgttagggaaaggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacacccgacaaacgcccccaaactcatcattttgaggtcactacgcgaccctcaggggtccctgatcgcttctctggctccaagtctggcaacacggcctcctgaccgtctctgggctccagctgagatgagctgattattactgcagctcatatgcaggcagcagcagtcccatgtgatcgttcgggacggggaccaagcgtacgaccgtcgtaggtcacgcccgaaggtcctcgtccccg

SEQ ID NO: 237113 - DNA, 541 bp, Homo sapiens
  misc_feature: GYAE6OF02I4UFN.5.24.C02.1.454.CMB.1.raw
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaacgcccccaaactcatcattttgagtcactacgcgaccctcacggggtcctgatcgcttctctggctccaagtctggcaacacgcctccctgaccgtctctgggctcagctgagatgaggctgattatactgcagctcatatgcaggcagcagcacgtccccagttgtgtactcgtttcgggaccggggggtaccaaggcgtcggacccggttccgttacgggtccgtacggccccgaagggtccctccggtccccccg

SEQ ID NO: 237114 - DNA, 540 bp, Homo sapiens
  misc_feature: GYAE6OF02GZB47.5.24.C02.1.454.CMB.1.raw
  modified_base (363)..(363): a, c, t, g, unknown or other
  misc_feature (363)..(363): n is a, c, g, or t
  modified_base (465)..(465): a, c, t, g, unknown or other
  misc_feature (465)..(465): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacacccgacaaacgcccccaaactcatcattttgagtcactacgcgaccctcacggggtccctgatcgcttctctggctccagtctgcaacncggcctccctgacccgtctcgtcgggctccgaggtctggaggatggaggctgatttattactgcagtctcatatgcaggacagcagcacgtcccatcgtagngttccgttcgggccgggggacaacggtcgtcgtacccgtccgtacggtcgacgcccgaacggtcctcgtcccccg

SEQ ID NO: 237115 - DNA, 534 bp, Homo sapiens
  misc_feature: GYAE6OF02H02PZ.5.24.C02.1.454.CMB.1.raw
  modified_base (226)..(226): a, c, t, g, unknown or other
  misc_feature (226)..(226): n is a, c, g, or t
tcagatcagacacgcacgaccggtgctcgatttagtacagatcgttagggaaaggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagtatgtctcctggtaccaacaacacccgacaaacgcccccaaactcatcatttttgaggtcactacgcgaccctcacgggtccctgatcgcttctctggctccaagtctggcaacacggcctccctgacccgtctccgtcgggcctccgaggctgaggatggaggctagattattactgtcagctcatatgcaggcagcagcacgtccccatgtgattcgttcgggccgggggacaacggcgtacgaccgtccgtacggtcacgcccgaacggccgtcgtcccccg

SEQ ID NO: 237116 - DNA, 534 bp, Homo sapiens
  misc_feature: GYAE6OF02HSQZG.5.24.C02.1.454.CMB.1.raw
  modified_base (251)..(251): a, c, t, g, unknown or other
  misc_feature (251)..(251): n is a, c, g, or t
  modified_base (447)..(447): a, c, t, g, unknown or other
  misc_feature (447)..(447): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagccctccctccgcgtccggtctcctggacagtcagtcaccatctcctgcactgcaaccagcagtgacgttggtgttcgaagtntgtctcctggtaccaacaacaccccgacaaacgcccccaaactcatcattttgaggtcactacgcgaccctcgacgggtccctgatcgcttctctggctccagtctgcaacacgcctccctgacccgtctcctcgggtcctcccgaggcctggaggactgaggtctgtatttattactgcagctcatatgcagacngcagccacgtcccatgtgagtcgtcgggaccgggggaccagcgtcgacccgtcgtaggccacgcccgaacggtccgtccgtcccccg

SEQ ID NO: 237117 - DNA, 550 bp, Homo sapiens
  misc_feature: GYAE6OF02GY91L.5.24.C02.1.454.CMB.1.raw
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagatcagacacgcacgaccggtgctcgatttagtacagatcgttagggaaagggggggtacgtcgaggaggcgagcgctctcaggacgtcaccaccatggcctgggctctgctcctcctcaccctcctcactcacggcacagggtcctgggcccaggctgccctgactcagcctccctccgcgtccgggtctcctggacagtcagtcaccatctcctgcactgcaaccagcagtgacgttggtgttcaagtntgtctctgtaccaanaaccacccgacaaagcccccaaaatccaatccattttgagtcactacgcgaccctcacgggtccctgatcgcttctctggctcaactntcgctaacncggccctccctgaccgtctctcgggactccgagctgagatgacggctgattatacttgacagtctanatangnacggntagcagtccagtcccagttctagactcgttacggggcggggtaaccaaggcctaggacccgttacccgagtaccgtaggccccgtaaggcccgtacgtccccccgg

SEQ ID NO: 237118 - DNA, 527 bp, Homo sapiens
  misc_feature: GYAE6OF02JFDQK.5.24.C02.1.454.CMB.1.raw
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacggggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaacgcccccaaactcatcattttgaggtcactacgcgaccctcagggtccctgatcgcttctctggctccaagtctggcaacacggcctcctgaccgtctctggctccaggctgaggatgaggctgattatactgcagctcatatgcaggcagcagcacgtccccatcgtgacttcgttcgggcggggaccaaggctcggacccgtcgtaggtcgacggtcccgaaggcctacgtcccccgtacgg

SEQ ID NO: 237119 - DNA, 593 bp, Homo sapiens
  misc_feature: GYAE6OF02G75FF.5.24.C02.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagccctccctccgcgtccgggtctcctggacagtcagtcaccatctcctgcactgccaaccngcagtgacgttggtgttcgaagtntgtctctggtaccaacaacacccgacaaacgcccccaaactcatctattttgagtcactacgcgaccctcgacggggtccctgatcgcttctctggctccaagtctggcaacacggcctccctgacccgtctcgtcgggcctccgaggctggaggagtggaggctgtaattattactgcacgtctactatatgacaggcagacgacgaccgtacgtccccattcgtagtacgttacggttccggggaccggggggaacccgtaacggtccgtaccggtacccggttacccgtacggttaccgaaccggaccccggaacggtcccgtacccgtccccccgg

SEQ ID NO: 237120 - DNA, 532 bp, Homo sapiens
  misc_feature: GYAE6OF02FM3Q1.5.24.C02.1.454.CMB.1.raw
  modified_base (252)..(252): a, c, t, g, unknown or other
  misc_feature (252)..(252): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtntgtctcctggtaccaacaacaccccgacaaagcccccaaaactcatcatttttgaggtcactacgcgaccctcaggggtccctgatcgcttctctggctccaagtctggcaacacggcctccctgaccgtctctcgggctccgaggctgaggatgaggctgattattactgcagctcatatgcaggcagcagcacgtccccagtgtgacttcgttcgggcgggggaaccaaggcgtcgaccgtaccgtacggtcgacgcccgaaggccgtcgtcccccgg

SEQ ID NO: 237121 - DNA, 562 bp, Homo sapiens
  misc_feature: GYAE6OF02HBR00.5.24.C02.1.454.CMB.1.raw
  modified_base (429)..(429): a, c, t, g, unknown or other
  misc_feature (429)..(429): n is a, c, g, or t
tcagatcagacacgcacgaccggtgctcgatttagtacagatcgttagggaaaggggggtctcaggaggcagcgctctcaggacgtcaccaccatggcctgggctctgctcctcctcaccctcctcactcagggcacagggtcctgggcccaggctgccctgactcagcctcctccgcgtccgggtctcctggacagtcagtcaccatctcctgcactgcaaccagcagtgacgttggtggttcgaagtatgtctcctggtaccaacaacaccccgacaaacgcccccaaactcatcatttttgaggtcactacgcgaccctcaggggtccctgatcgcttctctggctccaagtctggcaacacggcctccctgacccgtctcgtgggctccgaggctgaggatgaggtctgattattactgcagctnatatgcaggcagcagcacgtccccagtcgtgagttccgttcggggaccggggggtaacccaacggtccgtacggtacccggttaccgttacggtaccgaccggaccccgaacgggtccgtccggtccccccgg

SEQ ID NO: 237122 - DNA, 554 bp, Homo sapiens
  misc_feature: GYAE6OF02H916P.5.24.C02.1.454.CMB.1.raw
  modified_base (252)..(252): a, c, t, g, unknown or other
  misc_feature (252)..(252): n is a, c, g, or t
  modified_base (365)..(365): a, c, t, g, unknown or other
  misc_feature (365)..(365): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtntgtctcctggtaccaacaacaccccgacaaacgccccaaactcatcattttgaggtcactacgcgaccctcacggggtccctgatcgcttctctggctccaagtctggcaacncggcctcctgaccgtctctcgggctccgagctgagatgagctgattattactgcagctcatatgcaggcagcagcacgtcccagtgtagtacgttcgttcggggaccgggggaaccaacggtccgtaccggtacccgttaccgtacggtaccgaccggtaccccggaacggtcccgtccgtccccccgg

SEQ ID NO: 237123 - DNA, 572 bp, Homo sapiens
  misc_feature: GYAE6OF02I0W87.5.24.C02.1.454.CMB.1.raw
  modified_base (253)..(253): a, c, t, g, unknown or other
  misc_feature (253)..(253): n is a, c, g, or t
  modified_base (294)..(294): a, c, t, g, unknown or other
  misc_feature (294)..(294): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgccaaccagcagtgacgttggtgttcgaagtntgtctcctggtaccaacaacacccgacaacgacccccaacncatctattttgaggtcactacgccaccctcgacggggtccctgactcgcttctctggcctccaagtctcgacaacaccggcctccgtcgaccgtctcgtcgggctccgacgctgaggtagtggagtctgtattacttacgtgcgacgctcatagtgcgaggacagacagcgtaccgtcccagtgtacgtacgtcgttcgggaccggggaaccgtagtccgtaccggaccgttaccgtacggtaccaccggacccggaacggtccgtcccgtcccccgg

SEQ ID NO: 237124 - DNA, 539 bp, Homo sapiens
  misc_feature: GYAE6OF02H60Z3.5.24.C02.1.454.CMB.1.raw
  modified_base (225)..(225): a, c, t, g, unknown or other
  misc_feature (225)..(225): n is a, c, g, or t
  modified_base (402)..(402): a, c, t, g, unknown or other
  misc_feature (402)..(402): n is a, c, g, or t
  modified_base (416)..(416): a, c, t, g, unknown or other
  misc_feature (416)..(416): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctcgcgtccgggtctcctggacagtcagtcaccatctctgcactgcaacngcagtgacgttggtggttcgaagtatgtctctggtaccaacaacaccccgacaaacgcccccaaactcaatcatttttgaggtcactacgcgaccctcaggggtccctgactcgcttctctggctccaagtctggcaacacggcctcccctgacccgtctctgggcctcgaggctgngatgagctgtattnttatgcagctactatatgcgagcagcagcacgtcccatcgtgactcgttcggggacgggggaccaacggcgtcggtaacccgtcgtacggtccgacggccccaaggtccctacgtccccccgg

SEQ ID NO: 237125 - DNA, 679 bp, Homo sapiens
  misc_feature: GYAE6OF02JA7Z2.5.24.C02.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
  modified_base (288)..(288): a, c, t, g, unknown or other
  misc_feature (288)..(288): n is a, c, g, or t
tcagatcagacacgcacgaccggtgctcgatttagtacagatcgttagggaaagggggggtacgtcgaggaggcagcgctctcaggacgtcaccaccatggcctgggctctgctcctcctcaccctcctcactcagggcacagggtcctgggcccaggctgccctgactcagcctccctccgcgtccgggtctcctggacngtcagtccaccatcctcctgcactgccaaccngcagtcgacgttggtggttcaaagtntgtctcctggtaccaacaaccaccccganaaacgcccccaaactaccatccatttttcgacggtctaacctacgccgaccctcgacggggtccctgactcgcttctcgtcggtctccgaacgttctcggctaacgacgtccctcccgtgaccccgtcctcgtcgggccttccgacggtcctcggaggtacgtggacggccttagtactttaacgttaccgtgtaccgaaggttcctactagtttacgtgaacgtacgggactacgccgaacgcctaacgtcccctaaggttacgtcgtaacgttcccggtttaccggggacccgggggggtaacccgtaaacggtcgggtacccgtacccggttaccgttacgggttacgacccggtacccgaacgggtcccgttccccggtaccccccg

SEQ ID NO: 237126 - DNA, 560 bp, Homo sapiens
  misc_feature: GYAE6OF02I4KF6.5.24.C02.1.454.CMB.1.raw
  modified_base (227)..(227): a, c, t, g, unknown or other
  misc_feature (227)..(227): n is a, c, g, or t
  modified_base (360)..(360): a, c, t, g, unknown or other
  misc_feature (360)..(360): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagtatgtctctggtaccaacaaccacccgacaaacgaccccaaatcatctattttgagtcactacgcgacctcgacgggtcctgactcgcttctctgctcagtctgacaacncggcctcctcgaccgtctcgtcgggctccgaggtctaggaggtagtggacggtcgtgtaactttagttactgacagtctactatatcgcgagcagcagcactcccgatgtagtcgtcggttcggggaccggggaaccacggtacgtccggacccggttccgtacggccgtaccggacccgaggtcccgaccgtcccccgg

SEQ ID NO: 237127 - DNA, 550 bp, Homo sapiens
  misc_feature: GYAE6OF02HQEWU.5.24.C02.1.454.CMB.1.raw
  modified_base (254)..(254): a, c, t, g, unknown or other
  misc_feature (254)..(254): n is a, c, g, or t
  modified_base (368)..(368): a, c, t, g, unknown or other
  misc_feature (368)..(368): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgacctgactcagcctccctccgcgtccgggtctcctggacagtcagtcaccatctcctgcactgccaaccagcagtgacgttggtggttcgaagtntgtctctggtaccaacaacaccccgacaaacgcccccaaactcatctatttttgaggtcactacgcgaccctcgacggggtccctgactcgcttctctggctcagtctgcaacncgcctcctgaccgtctcgtgggcctccgagctgaggatggagtctgattattactgcagctacatatgcaggcagcagcacgtcccagtcgtcgacgttcgttcggggccggggtaaccacggcctacggtacccgtaccgtacgggtccaccggtacccgaacggccgtcccgtcccccgg

SEQ ID NO: 237128 - DNA, 612 bp, Homo sapiens
  misc_feature: GYAE6OF02HX0WE.5.24.C02.1.454.CMB.1.raw
  modified_base (227)..(227): a, c, t, g, unknown or other
  misc_feature (227)..(227): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctctgcactgcaaccngcagtgacgttggtgttcgaagtatgtctctggtaccaacaacacccgaacaaacgccccaaactcactctattttgaggtcactacgcgaccctcgacgggtccctgactcgcttctcgtcgctccaagtctggcaacacggcctccctgacccgtctcgtcgggcctccgaggctggaggtatggacggtcgtagtatttaattactgtacgagtctactacttaagtcgctacggcacgcgtacgccgaccgttccccgagtcgttagaccgtttccggttccgggggacccgggggtaaccaacggtccgtacggtaaccccggttaccgtacggttaccgaacccggacccggaacggtcccgttcccggtaccccccgg

SEQ ID NO: 237129 - DNA, 550 bp, Homo sapiens
  misc_feature: GYAE6OF02GVCJT.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaacgcccccaaatcatcattttgaggtcactacgcgaccctcacggggtccctgatcgcttctctggctcagtctggcacacgcctccctgaccgtctcgtcgggctccaggctggaggatggaggctgatttattactgcagctcatatgcgaggcagcagcacgtccccatcgtgacttccgttcgggaccgggggtaccaacggtcgtacgacccggttaccgtacggtccgaccggacccgaacggtccctaccggtccccccg

SEQ ID NO: 237130 - DNA, 508 bp, Homo sapiens
  misc_feature: GYAE6OF02HAIO1.5.24.C02.1.454.CMB.1.raw
  modified_base (252)..(252): a, c, t, g, unknown or other
  misc_feature (252)..(252): n is a, c, g, or t
  modified_base (276)..(276): a, c, t, g, unknown or other
  misc_feature (276)..(276): n is a, c, g, or t
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtgttcgaagtntgtctctgtaccaacacacccganaaagcccccaaatcatctattttgagtcactacgccaccctcgacgggtccctgatcgcttctctgctcagtctgcaacncgcctcctgaccgtctcgnggcctcgagctgaggatgaggctagtattagtactgcagctcatatgcaggcagcagcacgtcccatgtgatcgtcgggcggggacagctacgtaccgtcgtacggtcacgacccgacggtccgtcgtccccg

SEQ ID NO: 237131 - DNA, 643 bp, Homo sapiens
  misc_feature: GYAE6OF02I244L.5.24.C02.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
tcagatcagacacgcacgaccggtgctcgatttagtacagatcgttagggaaagggggggtcgtcaggaggcagcgctctcaggacgtcaccaccatggcctgggctctgctcctcctcaccctcctcactcaggcacagggtcctgggcccaggctgccctgactcagcctccctcgcgtccgggtctcctggacngtcagtccaccatcctcctgcactgccaaccngcagtgacgttggtggttacaagttntgtctctggtaccaacaaccacccgaacaacgaccccaaactcactactattttcgagtcactacgacgtacctcgacgggtcctgacgtcgtaccttctctcggcctaccaacgtcgtcgaccacgacgtcctcccgtcgacccgtctcgtcgggccttccgacggccgtggacggtactcggacggtctgtattacttacgtcgtactacgtctaccgtatacgtcgacacggtactacgcgaacgtccgaaccgttcccgagttacgtcggtacttccgggtcggggaccgggggaaccctaacgggtcccgtacggtacccggttaccgttacgggtaccctaccgggaaccccgtaacgggtccccgtacccggtacccccgg

SEQ ID NO: 237132 - DNA, 548 bp, Homo sapiens
  misc_feature: GYAE6OF02HIP5J.5.24.C02.1.454.CMB.1.raw
  modified_base (253)..(253): a, c, t, g, unknown or other
  misc_feature (253)..(253): n is a, c, g, or t
  modified_base (434)..(434): a, c, t, g, unknown or other
  misc_feature (434)..(434): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgccaaccagcagtgacgttggtggttcaagtntgtctcctggtaccaacaacacccgacaaacgcccccaaactcatctattttgaggtcactacgcgaccctcgacggggtccctgatcgcttctctgctcaagtctggcaacacggccctcctgacccgtctcgtcgggctccaggctaggagatgaggctagattatactgcagctcatntgcgagcagcagcacgtcccatcgtgtactcggtcgggaccggggtaacaggtccgtacggtacccgtccgttacggtaccacggtacccgaacggtccgtcccgtacccccgg

SEQ ID NO: 237133 - DNA, 582 bp, Homo sapiens
  misc_feature: GYAE6OF02GXPC0.5.24.C02.1.454.CMB.1.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagccctccctccgcgtccggtctcctggacagtcagtcaccatctcctgcactgcaaccngcagtgacgttggtggttcgaagtntgtctctggtaccaacaacaccccgacaaacgacccccaaactcatctattttgagtcactacgcgaccctcgacgggtccctgactcgtcttctctcggctccaagtctggacaacaccggcctccctgtacccgtctcgtcgggctccgaggctgaggtatgaggtctagtattattacgtgacgacgtctctattatgcgagcagcagcacgtccctagtcgtcgtacgttcgttacggggaccgggggaacctaacggtccggtacggtacccggtacggttaccggtccgaccggtacccggaacggtccgtcccggtcccccgg

SEQ ID NO: 237134 - DNA, 524 bp, Homo sapiens
  misc_feature: GYAE6OF02JZ8XT.5.24.C02.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (437)..(437): a, c, t, g, unknown or other
  misc_feature (437)..(437): n is a, c, g, or t
  modified_base (462)..(462): a, c, t, g, unknown or other
  misc_feature (462)..(462): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctggtcccaggctgccctgactcagcctccctccgcgtccgggtctcctggacagtcagtcaccatctcctgcactgcaaccngcagtgacgttggnggttcaagtntgtctcctggtaccaacaacaccccgacaaacgcccccaaactcatcattttgagtcactacgcgaccctcacggggtccctgactcgtcttctctggctccaagtctggcacacggcctcctgacccgtctctgggcctccaggctcgaggatcggaggctggattagttactgtcagcttcatntgcaggcagcagcacgtcccatgtnactcgtcgggccgggacaggcgtcgtaccgtccgtcggtcacgtccgaagcctcgtcccccg

SEQ ID NO: 237135 - DNA, 552 bp, Homo sapiens
  misc_feature: GYAE6OF02HD1AB.5.24.C02.1.454.CMB.1.raw
  modified_base (252)..(252): a, c, t, g, unknown or other
  misc_feature (252)..(252): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacagtcagtcaccatcctcctgcactgccaaccagcagtgacgttggtgttcgaagtntgtctctggtaccaacaacacccgacaaacgcccccaaactcatcatttttgaggtcactacgcgaccctcacgggtccctgactcgcttctctggctcaagtctgcaacacggcctcctcgaccgtctcgtcgggctccacggctggaggatgaggctgatttattactgctagctacatatgactaggcagcagcacgtcccagtcgtagtagttccgttacgggccgggggaacctaacggccgtacggtacccgtcgtacggtaccgacgtacccgaggtaccgtccgtacccccg

SEQ ID NO: 237136 - DNA, 648 bp, Homo sapiens
  misc_feature: GYAE6OF02G1QYT.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcgagggcacagggtcctgggcccaggctgccctgactcagcctccctcgcgtccgggtctcctggacagtcagtcaccatctcctgcactgccaaccngcagtgacgttggtgttacgaagtntgtctcctggtaccaacaacaccccgacaaacgcccccaaatcatctattttgagtcactacgcgaccctgacgggtccctgactccgtcttctcgtcggtcctaccgaagtcctggacctaaacgaccggcccttcccgtcggtacccgtctccgtacgggtccctaccgaggtcctggaggtagtaggagtccgttaggtaactttacgttacgtcggtacgtacgtccttactaacgtatacggtacgacgggtacctacggaccgaacggacctaccggtcccctaaagtcgtgtaaccgttcgttaccggggaccgggggtaaccaacggtccgtaccggtaccggtccgtacggtaccacggacccgaagggtccgtaccgtcccccgg

SEQ ID NO: 237137 - DNA, 528 bp, Homo sapiens
  misc_feature: GYAE6OF02F34SN.5.24.C02.1.454.CMB.1.raw
  modified_base (227)..(227): a, c, t, g, unknown or other
  misc_feature (227)..(227): n is a, c, g, or t
  modified_base (519)..(519): a, c, t, g, unknown or other
  misc_feature (519)..(519): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagtatgtctcctggtaccaacaacaccccgacaaagcccccaaactcatcattttgaggtcactacgcgaccctcgacggggtccctgactcgcttctctggctccaagtctggcaacacggcctcctcgaccgtctcgtcggctccgaggctgaggatggagctgtattatactgcagtctcatatgcagcagcagcacgtcccatcgtgattcgttcgggaccggggtaccaaggcctcggaccgtcgtacggtcacgcccgaggtccncgtcccccg

SEQ ID NO: 237138 - DNA, 567 bp, Homo sapiens
  misc_feature: GYAE6OF02IVU4T.5.24.C02.1.454.CMB.1.raw
  modified_base (365)..(365): a, c, t, g, unknown or other
  misc_feature (365)..(365): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgccaaccagcagtgacgttggtggttcgaagtatgtctcctggtaccaacaacaccccgacaaacgcccccaaactcatcatttttgaggtcactacgcgaccctcacgggtcctgatcgcttctctggctcaagtctggcaacncgcctccctgaccgtctcgtcgggctccaggctgagatgagctgattatactgcagctctatatgcgagcagacagcctagtccccattcggtcgtagttccgttccggggaccggggggtaacccgtaacggtccgtacggtaacccggttccgttacgggtacctaccggacccgaacggtccgtcccggtaccccccgg

SEQ ID NO: 237139 - DNA, 630 bp, Homo sapiens
  misc_feature: GYAE6OF02H2GDM.5.24.C02.1.454.CMB.1.raw
  modified_base (198)..(198): a, c, t, g, unknown or other
  misc_feature (198)..(198): n is a, c, g, or t
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacngtcagtcacatctccngcactcgcaaccagcagtgacgttggtgttcgaagtntgtctctcgtaccaacaacacccgaacaaacgaccccaactcactctattttgagtctactacgccgtacctcgacgggtccctgactcgtcttctctgctctagtctgcaacgcgcctcctgtacctctcgtcggctcaggctagagtacgtggagtcgtagtatttacgttacgtcgcgtacgtctacgtattagcgtacgtacggacacgtccgaacgtaccgtaccgtaccccgtagtacggttacgtacggttcccgggttaccggggtaccggggggaaccctaacgggtccgtaaccggtacccggttaccggtaacgggtaccgtaaccggtaccccggtaacgggtccccgtaccccggttaccccccgg

SEQ ID NO: 237140 - DNA, 606 bp, Homo sapiens
  misc_feature: GYAE6OF02IHWKQ.5.24.C02.1.454.CMB.1.raw
  modified_base (370)..(370): a, c, t, g, unknown or other
  misc_feature (370)..(370): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgccaaccagcagtgacgttggtggttcgaagtatgtctctggtaccaacaacaccccgacaaacgcccccaaactcatctattttgaggtcactacgcgaccctcgacggggtccctgactcgcttctctggctccaagtctggcaacncgcctcctgaccgtctcgtgggcctccgaggcgtggaggagtcggaggtctgtaatttagttactgtcgatctacatatcgtcgacggcgacgacacgcgtaccgtaccccgatcgtacgtacgttaccggttccggggtaccggggggtaaccgaacggtccggtaccggtacccggttacccgttacggtaccgaccggtaccccgtaacgggtcccgtcccggtaccccccgg

SEQ ID NO: 237141 - DNA, 510 bp, Homo sapiens
  misc_feature: GYAE6OF02GFOP6.5.24.C02.1.454.CMB.1.raw
  modified_base (344)..(344): a, c, t, g, unknown or other
  misc_feature (344)..(344): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaaccaccccgacaaagccccaaactcatcatttttgaggtcactacgcgaccctcaggggtccctgatcgcttcnctggctccaagtctggcaacacggcctccctgacccgtctctgggctccgagctgaggatgagctgattattactgcagctcatatgcaggcagcagcagtccccatgtgatcgtcgggcggggacagctcgaccgtccgtagtcacgcccaaggcctcgtccccg

SEQ ID NO: 237142 - DNA, 581 bp, Homo sapiens
  misc_feature: GYAE6OF02FH7H7.5.24.C02.1.454.CMB.1.raw
  modified_base (253)..(253): a, c, t, g, unknown or other
  misc_feature (253)..(253): n is a, c, g, or t
  modified_base (327)..(327): a, c, t, g, unknown or other
  misc_feature (327)..(327): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgccactgcaaccagcagtgacgttggtggttcgaagtntgtctcctggtaccaacaacaccccgacaaacgcccccaaactcatctatttttgagtcactacgccgaccctnacggggtccctgactcgcttctcgtgctccaagtctggcaacgacggcctccctgacccgttctcgtcgggcctcccgaggctggaggatggaggctacgtatttatactgtcagtctcattatcgcgaggcagcgacgcacgtcccctatcgtagacgttcgtaccgggccgggggtaaccaacggtccgtacggtacccgtaccgttacggtccgaaccgtacccggaacgggtccgtaccgtaccccccgg

SEQ ID NO: 237143 - DNA, 562 bp, Homo sapiens
  misc_feature: GYAE6OF02IGDQJ.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (410)..(410): a, c, t, g, unknown or other
  misc_feature (410)..(410): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgccaaccngcagtgacgttggtggttcgaagtntgtctcctggtaccaacaaccacccgacaaacgcccccaaactcatctattttgagtcactacgcgaccctcgacggggtccctgactcgcttctctggctccaagtctggcaacacggcctccctgaccgtctcgtcgggcctccgaggctgaggntgaggctgtattatactgctagctcatatgcaggtcagcacgcaccgtcccatcgagtagtccggttcggggaccgggggtaaccaacggtccgtacggacccgttacgtacggtaccgaccggacccgaacggtcccgtaccgtcccccgg

SEQ ID NO: 237144 - DNA, 659 bp, Homo sapiens
  misc_feature: GYAE6OF02H8Q2O.5.24.C02.1.454.CMB.1.raw
  modified_base (273)..(273): a, c, t, g, unknown or other
  misc_feature (273)..(273): n is a, c, g, or t
  modified_base (396)..(396): a, c, t, g, unknown or other
  misc_feature (396)..(396): n is a, c, g, or t
tcagatcagacacgcacgaccggtgctcgatttagtacagatcgttagggaaagggggggtctcgaggaggcagcgctctcaggacgtcaccaccatggcctgggctctgctcctcctcaccctcctcactcaggcacagggtcctgggcccaggctgccctgactcagccctccctccgcgtccgggtctcctggacagtcagtcaccctatcctcctgaccactcgaccaaaccagtcaagtcgtacgtttgggtaggtttccgaaagttntgtcgttccgttacggtaaccaaaccaaaccgaccccgaacgaaaaccgacccccaaaactccaatcctatttttacgagttacactaacgccgaaccctcgacgggtccctgactcgcttcnctgctccagtctagcaacgtaccggcctaccgcgtaccgtctcgtcgggctccgaggtctcggaggactgaaggtctacgtaacttagttacgtgaccgtacgtaccttacgtaattaacgtcgacgtaacgggcacgaccgtagacccacgttaccccagttgtaccgtaattccggggtacgggaccgggggtaaccaacgtcgtaaccggtaacccgtccgttaggaccgacggtaccccgaagcccgtccgtcccccgg

SEQ ID NO: 237145 - DNA, 563 bp, Homo sapiens
  misc_feature: GYAE6OF02IZBSZ.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagtntgtctcctggtaccaacaaccacccgacaaacgcccccaaatcatctattttgagtcactacgcgaccctcgacgggtccctgatcgcttctctggctcaagtctgcaacacggcctcctgaccgtctcgtcgggctccgagctgagatggagctgtattatactgctagctcatatgacaggcagcgagcacgtccccatcgtacgtacgttcgttacggggaccgggggtaacctaaggccgttacggaccccgttaccggtacggtaccgtaccggaccccgaacggtcccgtaccggtccccccgg

SEQ ID NO: 237146 - DNA, 587 bp, Homo sapiens
  misc_feature: GYAE6OF02JEPF7.5.24.C02.1.454.CMB.1.raw
  modified_base (210)..(210): a, c, t, g, unknown or other
  misc_feature (210)..(210): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
  modified_base (379)..(379): a, c, t, g, unknown or other
  misc_feature (379)..(379): n is a, c, g, or t
  modified_base (410)..(410): a, c, t, g, unknown or other
  misc_feature (410)..(410): n is a, c, g, or t
  modified_base (522)..(522): a, c, t, g, unknown or other
  misc_feature (522)..(522): n is a, c, g, or t
tcagatcagacacgcacgaccggtgctcgatttagtacagatcgttagggaaagggggggtacgtcgaggaggcgagcgctctcaggacgtcaccaccatggcctgggctctgctcctcctcaccctcctcacctcacgggcacacgggtcctcgggcccacggcctcgccctgactcacgcctccctccgcgtccggtcctcctggacncgtcagtcnccatcncctgcnctgcaaccngcagtgacgttggaggttcaagtatgtcgtcctggtaccaccaacaccccgaccaaaacgcccccaaactccaacttccacttttcgacgttcactaaccgtcaacccgttccacggggtccctcgacttccgctttcnccttcggactcctaaacggtctacggcaacnccggcctccctgacccgtcgtcctgggcctcctacggcctgacggagtcgtaggcttgattacgtactagtcacgtctcagtctcgcaggcagtcacgctacgcccatcgtntacgtcgtcggcggggacctagtacgtcgaccgtcgacgtcacggtcccaaggtcccttcgcccg

SEQ ID NO: 237147 - DNA, 558 bp, Homo sapiens
  misc_feature: GYAE6OF02JLVKR.5.24.C02.1.454.CMB.1.raw
  modified_base (229)..(229): a, c, t, g, unknown or other
  misc_feature (229)..(229): n is a, c, g, or t
  modified_base (257)..(257): a, c, t, g, unknown or other
  misc_feature (257)..(257): n is a, c, g, or t
  modified_base (285)..(285): a, c, t, g, unknown or other
  misc_feature (285)..(285): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (398)..(398): a, c, t, g, unknown or other
  misc_feature (398)..(398): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
tcagatcagacacgcacgaccggtgctcgatttagtacagatcgttagggaaagggggggtcgtcgaggaggcagcgctctcaggacgtcaccaccatggcctgggctctgctcctcctcaccctcctcactcaggcacagggtcctgggcccaggctgccctgactcagcctccctccgcgtccggtctcctggacagtcagtccaccatctcctgcactcgcaaccngcagtcgacgttgggtggttcaaagttntgtctcctggtaccaacaacaccccganaaacgcccccaaatcatcattttgagtcactacggcaccctcgacgggtccctgactcgcttctctgctcagtctgcaancggctcctgacctntcgtggctccgagctgagntgaggctgattatactgacngctcatangcnggacngtcacgtcacgtcccagtgtacgtacgttcgttaccggggcgggggtaaccctaaggccggtaccggtaacccggtccgtacggttccggacgaccccggacggtccggtacccggtcccccgg

SEQ ID NO: 237148 - DNA, 554 bp, Homo sapiens
  misc_feature: GYAE6OF02FZUN3.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagtntgtctcctggtaccaacaacaccccgacaaacgcccccaaactcatcattttgaggtcactacgcgaccctcacggggtccctgactcgcttctctggctccaagtctggcaacacggcctccctgacccgtctcgtcgggctccgaggctggaggatggaggctagtatttacttactgcagctacatatcgcaggcagcagcacgtccccatcgtgtacttcgttccgggcgggggaaccaacggtcgtacgtaccgtaccgtacggtccacggacccgaacggtcctccgtcccccgg

SEQ ID NO: 237149 - DNA, 574 bp, Homo sapiens
  misc_feature: GYAE6OF02FQLPV.5.24.C02.1.454.CMB.1.raw
  modified_base (252)..(252): a, c, t, g, unknown or other
  misc_feature (252)..(252): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcaagtntgtctcctggtaccaacaacacccgacaaacgccccaaactcatctattttgaggtcactacgccgaccctcgacggggtccctgactcgcttctctggctccaagtctgcaacgcgcctcctcgaccgtctcgtcgggcctccgacgctggagagtggaggtcgtagatttagttactgcgtagtctacattagtgcgaggcgagacgacgacctacgtcccagtcgtacgtcgttccgttcggggaccgggggtaaccaacggtccgtacggtacccgtcgtacggtccgtacggcccgaacggtccgtcccgtccccgg

SEQ ID NO: 237150 - DNA, 599 bp, Homo sapiens
  misc_feature: GYAE6OF02GJ6WK.5.24.C02.1.454.CMB.1.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccgggtctcctggacagtcagtcaccatctcctgcactgcaaccngcagtgacgttggngttcgaatntntctcctggtaccaacaaccacccgacaaacgcccccaaactcatctattttgagtcactacgccgaccctgacgggtccctgactcgctttctcgtggccttacaagttcgtaggaccaacgaccggtcctccccgtagacccgttctcgtcgggcctccgagctggaggatggagtctgtattattactgctacgtctctatatgcgaggacacgcacgctacgtcccctatcggtagtacgttcggtaccggggaccgggggaccgtaacggtccgtaccggtaacccggttaccgtaacggttccgaaccggtcccgaacgggtccctccggtaccccccgg

SEQ ID NO: 237151 - DNA, 526 bp, Homo sapiens
  misc_feature: GYAE6OF02HG53D.5.24.C02.1.454.CMB.1.raw
  modified_base (252)..(252): a, c, t, g, unknown or other
  misc_feature (252)..(252): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtntgtctcctggtaccaacaacaccccgacaaacgcccccaaatcatcattttgagtcactacgcgaccctcacggggtccctgatcgcttctctggctccagtctggcaacacgcctccctgacccgtctcgtgggcctccgaggctgaggatgaggctgtattattactgcagctcatatgcgagcagcagcacgtcccatgtgtactcgttcgggaccggggaccaagcgtacgaccgtcgtacggtcgacgaccgacggccgtcgtcccccg

SEQ ID NO: 237152 - DNA, 617 bp, Homo sapiens
  misc_feature: GYAE6OF02I6SGU.5.24.C02.1.454.CMB.1.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (290)..(290): a, c, t, g, unknown or other
  misc_feature (290)..(290): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctcgcgtccggtctcctggacagtcagtcaccatctcctgcactgacaaccngcagtgacgttggtggttacaagtntgtctctgtaccaacaaccaccgacaaacgccccaaancatctattttgagtcactacgccaccctcgacgggtccctagactcgcttctcgtcggtctacgtaagtcgtacggactaaccgaccggtcctacccgtgacccgttctacggtcgggcctccggagacgtaggaggtagtcggacggtctagttattaacttacgtgtacgacgtccttaactacgttacgtacggacgtacggacgtacgacgtaacgccgtaaccgtcccgtagtcgtagacgttccggtcggggaccgggaacctaggccgtacgtacccgtacggttacgccgaccgacgaccggtccgtcccggtaccccg

SEQ ID NO: 237153 - DNA, 650 bp, Homo sapiens
  misc_feature: GYAE6OF02IWTH6.5.24.C02.1.454.CMB.1.raw
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
tcagatcagacacgcacgaccggtgctcgatttagtacagatcgttagggaaaggggggtcgtcgaggaggcgagcgctctcaggacgtcaccaccatggcctgggctctgctcctcctcaccctcctcactcacggcacagggtcctcgggcccaggctgccctgacctcagcctccctccgcgtccggtcctcctggacagtcagtcaccatctcctgcactgaccaaccagcagtcgacgttggngttcgaagttntgtctctggaccaacacacccgacaaacgccccaactcactactattttgacggtcacctacgccgacctcgacggggtcccngacttcgccttcncgtggcctcaacgtctcggactaacgacgtcctccgtagcccgttctcgcggtctccgaggtcctagacgtacgtcggaggtctacgtacgttacgtaccttggacgtacgtcgtaccgtacttactcggtacgtacggacctagaccgtacgtaccgacgttcccgaacgtcgtacggtaacgttccgtttaccgggggaccggggtaccgtaaacgggtcctaccgggacccggttaccgtacgggttacccgaaccggttcccggaaacggttccggtacccggtcccccgg

SEQ ID NO: 237154 - DNA, 622 bp, Homo sapiens
  misc_feature: GYAE6OF02IT7TJ.5.24.C02.1.454.CMB.1.raw
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtntgtctcctggtaccaacaaccacccgaacaaacgacccccaaactcatctattttgacggtcactacgcgacctcgacgggtccctgtactcgcttctctggctaccgagtctcggacaacgacggcctcctgacccgtctcgtcgggcctccgacgctaggacggtagtggaggtctagtaatttacttactcggactacgctactagtatcggacgacggtacagaccgacgtaccgaccgttaccctagttcggtacgtacgttccgggttaccgggggaccgggggtaaccaacggtccgtaccggtacccgttaccgtacggtaccgaaccggacccggaacggtcccgtacccggtcccccgg

SEQ ID NO: 237155 - DNA, 558 bp, Homo sapiens
  misc_feature: GYAE6OF02HS7WE.5.24.C02.1.454.CMB.1.raw
  modified_base (252)..(252): a, c, t, g, unknown or other
  misc_feature (252)..(252): n is a, c, g, or t
  modified_base (418)..(418): a, c, t, g, unknown or other
  misc_feature (418)..(418): n is a, c, g, or t
tcagatcagacacgcacgaccggtgctcgatttagtacagatcgttagggaaagggggggtctcaggaggcagcgctctcaggacgtcaccaccatggcctgggctctgttcctcctcaccctcctcactcagggcacagggtcctgggcccaggctgccctgactcagcctccctccgcgtccgggtctcctggacagtcagttaccatctcctgcactgcaaccagcagtgacgttggtggttcgaagtntgtctctggtacaacaacaccgacaaacgccccaaactcatctattttgagtcactacgcaccctcacgggtcctgatcgcttctctggctcagtctcgcacacgctcctgaccgtctcgtcgggcctcgacgctgacgagtgagctgtattattacgtgcagctnatatgcgacgcacgcacgccgacgtcccagtcgtagtacgttcggttaccgggtacgggggacctaacggcgtaccggtaccgtaccgttacggtacacggtacccgaacggtcccgtccggtacccccgtcggtacccg

SEQ ID NO: 237156 - DNA, 641 bp, Homo sapiens
  misc_feature: GYAE6OF02JGUGU.5.24.C02.1.454.CMB.1.raw
  modified_base (197)..(197): a, c, t, g, unknown or other
  misc_feature (197)..(197): n is a, c, g, or t
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
  modified_base (354)..(354): a, c, t, g, unknown or other
  misc_feature (354)..(354): n is a, c, g, or t
  modified_base (369)..(369): a, c, t, g, unknown or other
  misc_feature (369)..(369): n is a, c, g, or t
tcagatcagacacgcacgaccggtgctcgatttagtacagatcgttaggaaaggggggtcgtcgaggaggcgagcgctctcaggacgtcaccaccatggcctgggctctgctcctcctcaccctcctcactcaggcacagggtcctggcccaggctgccctgactcagcctccctccgcgtccgggtctcctggacngtcagtcaccatctcctgcactgcaaccagcagtnacgttggtggttcaagtntgtctcctggtaccaacaacacccgacaaacgcccccaaaactcactcctattttcgacggttcacttacgccgaccctcgacgggtcccctgatccgtcttcnctggctccaagttcnggccaacaccggcctccctgacccgttctcgtcgggtcctccgtacggccttgacggtacgttggacggtcgtgtacgtttaattactggactacgtcgttccaagttacgtcggtacaagggttaccaacgggtccaacggccgtaacgtcccccgaaagttccggtagtaacgttccgtttcgggggaccgggggtaacccgtaaggccgttaccggcccgttacccgtacggtccaaccggtcccgaacgggtacctccggccccccgg

SEQ ID NO: 237157 - DNA, 606 bp, Homo sapiens
  misc_feature: GYAE6OF02G4E3E.5.24.C02.1.454.CMB.1.raw
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctcctgcactgcaaccngcagtgacgttggtggttcgaagtntgtctcctggtaccaacaacaccccgacaaacgccccaaactcatcattttgacgtcactacgcgacctcgacgggtccctgactcgcttctcgtggctccaacgtctcggacaacgaccggccttcctcgacccgtctcgtcgggtcctccgacggtcgtcggaggtagtcggacggtcgtagtactttaagttacgtcgactacgtctacacttagtacgacgtaggctagcacgcgtacgtaccccagttcgtcgtacgttcgtccggggtaccggggaacctaacggcgtacggaccgttccggtacggtaccgacggacccgtaacggtccgtcccggtacccccgg

SEQ ID NO: 237158 - DNA, 573 bp, Homo sapiens
  misc_feature: GYAE6OF02H6T0U.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgacaaccagcaagtgacgttggtgtcgaagtatgtctctgtacaacaacacccgacaaacgaccccaaactcactcatttttagagttacactacgcacctcgacgggtcctgactcgcttctctggctccaagtctggcaacgacgcctccctagaccgtctcgtggtcctccgagctggacggataggacggtctagtattattacgtagacgacgctactatatgacaacggacagacgacgacctacgtcccaatcgtagtacttcgttacgggacgggggaaccaacggtcgtaccgtaccgtccgttacggacctacggacccgtacggtccgtaccgtacccccg

SEQ ID NO: 237159 - DNA, 557 bp, Homo sapiens
  misc_feature: GYAE6OF02FQWXX.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgtttggtggttcaagtntgtctcctggtaccaacaacaccccgacaaacgcccccaaatccatctattttgaggtcactacgccgaccctcacggggtccctgatcgcttctctggctcagtctgcacacggcctcctgacccgtctcgtcgggcctccgacggtcgtgaggtatggaggtctgtattacttactgcagtctcatatgacaggcagcacgccacgtccccagtcgtagtacttcgtccggggaccgggggaaccaacggccgtacgacccgtccgtacggtccgacgccccgaaggtcctccggtcccccg

SEQ ID NO: 237160 - DNA, 553 bp, Homo sapiens
  misc_feature: GYAE6OF02GP707.5.24.C02.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccgggtctccgtggacagtcagtcaccatctcctgcactgcaaccngcagtgacgttggtggttcgaagtntgtctcctggtaccaacaaccaccccgacaaacgcccccaaactcatctattttgaggtcactacgcgaccctcgacggggtccctgatcgcttctctggctccaagtctggacaacgacggtcctcccgtgacccgtctcgtcgggcctccgaggctgaggatgagctgatttatctgcagctcatatgctaggcagcagcacgtcccagtgtgtacttcggttcggggaccgggggaacaaggccgtacggtacccgtcgtacggtcaccggcccgaacggtcctccggtcccccg

SEQ ID NO: 237161 - DNA, 636 bp, Homo sapiens
  misc_feature: GYAE6OF02JQ0ST.5.24.C02.1.454.CMB.1.raw
  modified_base (227)..(227): a, c, t, g, unknown or other
  misc_feature (227)..(227): n is a, c, g, or t
  modified_base (277)..(277): a, c, t, g, unknown or other
  misc_feature (277)..(277): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacagtcagtcaccatctcctgcactgcaaccngcagtcgacgttggtgttcaagtatgtctctggtaccaacaacacccganaaacgaccccaatcatctattttgagtcactacgcacctnacgggtccngatcgctctctgctcagtctgctaacacggcctcctcgaccgtcgtaccgtgggccctacgcgtcgtagaacggtactaggacgtcgtacgtatttaacgttacgtacgtacctagtacccttacgtattaacgtcggtaccgaacggtaccgacggactaccggactaccgttccccagttcggtagtaccttccgggttaccggggaccgggggtaaacctaacgggtaccgtaccggtaccggttaccggttaaccgggtccgtaacccggtacccgaaacgggttcccgtacccggtaccccccgg

SEQ ID NO: 237162 - DNA, 643 bp, Homo sapiens
  misc_feature: GYAE6OF02IMSRQ.5.24.C02.1.454.CMB.1.raw
  modified_base (257)..(257): a, c, t, g, unknown or other
  misc_feature (257)..(257): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcaggcacagggtcctgggcccaggctcgccctgactcagccctccctcgcgtccgggtctcctggacagtcagtcaccatctcctgcactcgacaaccagcagtgacgttggtggttacgaagttntgtcctccgtacggtaaccaaaccaaccaaccccgaacaaaccgtacccccaaatccatactagttttgacgtcaactaccgcgaccctgtaccgggtcctagactcgtacttctcgtcggacctaccgtaagtcgtacggaccaacgtacccggtcccttcccgtagtaccccggttcttcgtcgggtccctaccgaggtcgtaggacgggtatcggacggtctagttattacttacgtgacgtactacgtactaagtactggacgacggacacgacacgtccgacgtcccagtcgtacgtacgtccggttacgggaccgggaacgtacgacgtccgtaccgtacgtacggtacgaccggaccgtacggccgtccgtacccccgg

SEQ ID NO: 237163 - DNA, 566 bp, Homo sapiens
  misc_feature: GYAE6OF02F8TBB.5.24.C02.1.454.CMB.1.raw
  modified_base (228)..(228): a, c, t, g, unknown or other
  misc_feature (228)..(228): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcaagtatgtctcctggtaccaacaacaccccgacaaacgcccccaaatcatctattttgaggtcactacgcgaccctcacggggtccctgactcgcttctctggctccaagtctggcaacacggcctccctgacccgtctcgtcgggcctccgacggctggaggatggaggctggtatttacttactgcagctcgatatgcaggcagcgagccacgtccccagtcgtgacttccggttcggggaccgggggaaccaacggtccgtacggtacccgtccgtacggtccaccggacccgaacggtccctaccggtccccccg

SEQ ID NO: 237164 - DNA, 530 bp, Homo sapiens
  misc_feature: GYAE6OF02HMEKR.5.24.C02.1.454.CMB.1.raw
  modified_base (228)..(228): a, c, t, g, unknown or other
  misc_feature (228)..(228): n is a, c, g, or t
  modified_base (364)..(364): a, c, t, g, unknown or other
  misc_feature (364)..(364): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtgttcgaagtatgtctcctggtaccaacaaccacccgacaaacgacccccaaactcatctattttgagtcactacgcgaccctcgacggggtccctgatcgcttctctgctcagtctgcaacncgcctcctgaccgtctctgggcctcgaggctgaggatgagctagtattattactgcagctcatatgcgagcagcagctacgtcccatcgtagtctcggttcgggaccggggacaaggccgtacgtaccgtcgtacggtcacgacccgaacggtccgtccgtccccg

SEQ ID NO: 237165 - DNA, 518 bp, Homo sapiens
  misc_feature: GYAE6OF02GXONU.5.24.C02.1.454.CMB.1.raw
  modified_base (415)..(415): a, c, t, g, unknown or other
  misc_feature (415)..(415): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacagtcagtcaccatctcctgcactgcaaccagcagtgacgttggtggttcgaagtatgtctcctggtaccaacaacaccccgacaaacgccccccaaactcgtgatttctgaggtcagtagcggcctcaggggtcctgatcgcttctctgctcagtctgcacacggcctcctgaccgtctcgtgggcctccgagactgacggatgaggctgactattacngcagctcatttgcagcagccgtatactcgttcggcggaggaccagctgaccgtccgtaggtcacgcccaaggcctcgcccctcggtccacgttctcgttcccc

SEQ ID NO: 237166 - DNA, 564 bp, Homo sapiens
  misc_feature: GYAE6OF02IXYWB.5.24.C02.1.454.CMB.1.raw
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
  modified_base (366)..(366): a, c, t, g, unknown or other
  misc_feature (366)..(366): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngccagtgacgttggtggttcgaagtntgtctcctggtaccaacaacaccccgacaaacgcccccaaactcatctattttgagtcactacgcgacctcgacgggtccctgatcgtcttctctgctccaagtctgcaacncgcctcctgaccgtctctcgggcctcgaggctgagntgngctgtattatactgacagtctacatatcgcaggcacgcacgactaccgtcccctagtcgtacgtacgttcggttccggggaccgggggtaaccaacggccgtacggacccgttcgtacggtccgaccggacccgtaacgggtcctccggtaccccccgg

SEQ ID NO: 237167 - DNA, 566 bp, Homo sapiens
  misc_feature: GYAE6OF02GNQ8X.5.24.C02.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcaagtntgtctcctggtaccaacaacaccccgacaaacgcccccaaactcatctatttttgaggtcactacgccgaccctcgacggggtccctgactcgcttctctggctccaagtctgcaacacggcctcctgaccgtctcgtcgggcctccgaggctggaggtagtggaggtctagtatttaacttactgcgacgtctcattatgcaggcagacagcaccgtcccagtgtcgagttccggttcgggacgggggtaccaaggtccgtacggtaccgttaccgtacggttcgacgacccgaaggtccgtcccggtccccg

SEQ ID NO: 237168 - DNA, 698 bp, Homo sapiens
  misc_feature: GYAE6OF02H6MN8.5.24.C02.1.454.CMB.1.raw
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtntgtctctgtaccaacaaccacccgaacaaacgccccaaactcatctatttttgaggttcactacgccgaccctcgacggggtcctgactcgtcttctcgtcgctaccagtctcggacaacgcggccctcccgtcgacccgtctcgtcgggtcctccgaggtccgtaggaggtagtcggaacggtcgtagtaactttacgttaacgtcggtacgtacggtccttacgtaacgttacgtacggaccggtaacgggtacctaacggtaccgaacggtacccgtaaccggttaccccctaagttacggttacgtaccggtttaccgggtttcccgggggaaccggggggtaaccctaaaccgggtccgtaccgggtaccccgttaccggttaaccggttaccggaacccggtaccccggtaacggtccccgttcccggtacccccccgg

SEQ ID NO: 237169 - DNA, 591 bp, Homo sapiens
  misc_feature: GYAE6OF02GN90O.5.24.C02.1.454.CMB.1.raw
  modified_base (230)..(230): a, c, t, g, unknown or other
  misc_feature (230)..(230): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccgggtctcctggacagtcagtcaccatcctcctgcactgcaaccngcagtgacgttggtggttacgaagtatgtctcctggtaccaacaacaccccgacaaacgacccccaaactcatctattttgaggtcactacgccgaccctcgacggggtccctgactccgctttctctcgctcctaagtctcggaccaacgaccggtccctcccgtcgtaccgtcctcgtcgggctccgaggtctggaggatggaggtctgtatttatacgtgctagtctcatctagcgtagcagacacgcacgtcccagtcgtagcgttacgttcggggacggggtaaccaacggtccgtacggtacccgttacgtaccggtcgtaccggtacccgaacggtccgtcccggtacccccgg

SEQ ID NO: 237170 - DNA, 676 bp, Homo sapiens
  misc_feature: GYAE6OF02I7WOM.5.24.C02.1.454.CMB.1.raw
  modified_base (375)..(375): a, c, t, g, unknown or other
  misc_feature (375)..(375): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgcctgactcagcctccctcgcgtccgggtctcctggacagtcagtcaccatcctcctgcactgccaaccagcagtgacgttggtggttcgaagtatgtctctggtaccaacaaccacccgacaaacgccccaaactcactctattttgacggttcacgtaccgccgtaccctcgacggggtccctgactcgtcttctctcggtctcagtctggcaacncgcctcctgacctctcgtcggcctccgaggtcgtaggacggtagtggacggtcttaggtatttaacttacgtacggtctacgtcttactacgtacgttcggaccgtagggtacccagtaccgacggtccgtaccgtaccccgtaagtttcggtacgttaaccggttccggtttaccggggggaccggggggtaaacctaacggggttaccggttacccggtacccgggttacccggttacggggttacccgtaaccgggtaccccggtaaccggttcccggttaccccggtacccccccgg

SEQ ID NO: 237171 - DNA, 609 bp, Homo sapiens
  misc_feature: GYAE6OF02HNJAT.5.24.C02.1.454.CMB.1.raw
  modified_base (281)..(281): a, c, t, g, unknown or other
  misc_feature (281)..(281): n is a, c, g, or t
  modified_base (370)..(370): a, c, t, g, unknown or other
  misc_feature (370)..(370): n is a, c, g, or t
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
  modified_base (453)..(453): a, c, t, g, unknown or other
  misc_feature (453)..(453): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccgggtctcctggacagtcagtcaccatctcctgcactgcaaccagcagtgacggttggtgttcgaagtatgtctctgtaccaacaacaccccgaanaacgaccccaatcatctattttgacgtcactacgccacctcgacgggtccctgatccgcttctcgtggctaccaagtctcggaccaacncggtcctccctgacccgttctcgtcgggtcctccgaggtcctggagganggtacggnttagtactttatacgtgactgacttnaacttagcgacgaggcagacacgcctaccgtcctagtgtacgtacgtcggttaccggggaccggggtaccaacgggtccgtaccggtaacccggtacggttaccgggtaccgaacccggtacccggtaaacgggtccccgtcccggtaccccccgg

SEQ ID NO: 237172 - DNA, 695 bp, Homo sapiens
  misc_feature: GYAE6OF02G6R0P.5.24.C02.1.454.CMB.1.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (280)..(280): a, c, t, g, unknown or other
  misc_feature (280)..(280): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtccaccatcctctgcactgccaaccngcagtgacgttggtgttcaagtntgtctctggtaccaacaaccacccganaaaccgcccccaactcatctattttgagtcactaccgcgacccgtcgacggggtccctgacttccgtcctttcctcgtcggtcctaccgtaagtccgtcggacctaacgacccgggtcccttaccccgtcgtaaccccgttcttaccggtccggggtcccttacccggacgggtccgtagggacgggtagttcgggacggtacgtagttaacttttacgttaccgtcggacctacgtccttacgtatacgtgacgacgggactacggccgaggtccctacccggtcccaaggttgtacgttacgttccgggttccgggggaccggggtaaccctaacgggtccgtaccgggtacccgttcccggttaggtcccgaaccggtacccgtaaccgggtccctaccccggtacccccgg

SEQ ID NO: 237173 - DNA, 780 bp, Homo sapiens
  misc_feature: GYAE6OF02HD704.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacgagggtcctgggcccaggctgccctgactcagccctcctccgcgtccgggtctcctggacagtcagtccaccatcctcctgcactgcaaccagcagtgtacgttgggtgttacgaagttagtcgtctccgtacggtaaccaacaaccaccccgaacaaacccgacccccaaactcacttactagtttttacgacggttcctacgtaccggaccgaccgtcggacgggtccctgactcgtcttcgtcgtcggtcctaccgtacgttcgtacggacctaaacccggtacccggtcccctttacccgtaccgtaccccggtttccgtaccggttaccgggtacccgttaccggaaccgggttcgtaacgggtacgggtacgtacgggtacgggtccgttaaggttaactttaacggttactacggtacgtacgtactacgtaagttacgtacgtacggtacggtacgacgaccgtacgtaccgtacccgtaccccgtagttaccggtacgttaccgttccgggttaccgggggacccgggggtaaccctaacgggtaccgttacccggtacccggttaccggttaccggttaacccggaccggtaaccccggtaccggttacccgtccccggttaccccccgg

SEQ ID NO: 237174 - DNA, 626 bp, Homo sapiens
  misc_feature: GYAE6OF02JYPJ9.5.24.C02.1.454.CMB.1.raw
  modified_base (141)..(141): a, c, t, g, unknown or other
  misc_feature (141)..(141): n is a, c, g, or t
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (342)..(342): a, c, t, g, unknown or other
  misc_feature (342)..(342): n is a, c, g, or t
  modified_base (370)..(370): a, c, t, g, unknown or other
  misc_feature (370)..(370): n is a, c, g, or t
tcagatcagacacgcacgaccggtgctcgatttagtacagatcgttagggaaagggggggtcgtcgaggaggcagcgctctcaggacgtcaccaccatggcctgggctctgctcctcctcaccctcctcactcagggcacngggtcctgggcccaggctgccctgacctcagccctccctccgcgtccgggtctccgtggacngtcagtcaccatctcctgccactgccaaccngcagtnacnttgggcgttacaagtatgtctccgtggtaccaacaccacccgacaaacgccccaaactcatctattttgacgtctacacgccgaccctcgacgggtccngtactccgtctctcgtgtctaccagtcncggtacaacgtcggcctccgtcgaccgtctcgtcgggcctccgacggtcctggacggtactggacgtctacgtacgttacgttacgttacgcgtacgtccgttacgacttagtcgacgtaggcgtacgcgacgtcgtaaccgtccctaagtcgtcgtacttccggttacggggaccggggttaaccacggtccgttacggacccggttacgtacgggtaccgtaaccggtacccggtaacggtcccgttaccccgg

SEQ ID NO: 237175 - DNA, 554 bp, Homo sapiens
  misc_feature: GYAE6OF02G0L5D.5.24.C02.1.454.CMB.1.raw
  modified_base (230)..(230): a, c, t, g, unknown or other
  misc_feature (230)..(230): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgccaaccngcagtgacgttggtggttcgaagtatgtctcctggtaccaacaaccacccgacaaacgcccccaaactcatctattttgaggtcactacgccgaccctcacgggtccctgatcgcttctctcggctccaagtctggcaacgacggcctccctgaccgtctcgtcgggcctccgaggctgaggatggaggtctgtattagttactgcagtctactatatcgcgaggcagcagcacgtcccatcgtgtacgttcgtcgggaccgggggaccaggcgtacggaccgtcgtacggtcgaccggaccgacggtcctccggtacccccgg

SEQ ID NO: 237176 - DNA, 524 bp, Homo sapiens
  misc_feature: GYAE6OF02HFE0L.5.24.C02.1.454.CMB.1.raw
tcagatcagacacgcacgaccggtgctcgatttagtacagatcgttagggaaaggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacacccgacaaacgccccaaactcatcattttgagtcactacgcgaccctcacggggtccctgatcgcttctctggctcaagtctggcaacacggcctcctcgaccgtctcgtcggctccaggctgagatggagctagattattactcgacagtctcatatgcaggtcagcacgcacgtcccatcgtgatcgttcgggcggggaccaggcgtcgaccgtcgtacggtcacggtcccgaacggtcctcgtcccccg

SEQ ID NO: 237177 - DNA, 661 bp, Homo sapiens
  misc_feature: GYAE6OF02G0GVW.5.24.C02.1.454.CMB.1.raw
tcagatcagacacgcacgaccggtgctcgatttagtacagatcgttagggaaaggggggggtctcaggaggcagcgctctcgaggacgtcaccaccatggcctgggctctgctcctcctcaccctctcactcagggcacagggtcctgggcccaggctgccctgactcagcctccctcgcgtccgggtctcctggacagtcagtcaccatctcctgcactgccaaccagccagtgtacgttggtggttcgaagtgtgtctctggtaccaacaacacccgaacaacgccccaaactcatctattttgagtcactacgccgacctcgacgggtccctgacttccgcttcctcgtcgcctccgaacgtcgttcggacaacgaccggtcctccgtacgccgtctcgtcgggcctccgacggctgacggagtggacgtcgtagtatttaacttactcgacgtgtcttcgattatacgcacgggaccgtacggaccacggaccgaccgttaccccgtagttccggttagtacgttacccgggtcggggtacccggggggtacctaaacggggtccgttaaccgggtaacccggttacccggttaaccggtaccgggtaacccggtaaccccggtaacgggttacccggtccccggttaccccccggg

SEQ ID NO: 237178 - DNA, 552 bp, Homo sapiens
  misc_feature: GYAE6OF02FQ2TL.5.24.C02.1.454.CMB.1.raw
  modified_base (257)..(257): a, c, t, g, unknown or other
  misc_feature (257)..(257): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccgggtctcctggacagtcagtcaccatctcctgccactgccaaccagcagtgacgttggtggttcgaagttntgtctcctggtaccaacaaccaccccgacaaacgcccccaaactcatctatttttgaggtcactacgcgaccctcgacggggtccctgatcgcttctctggctccaagtctcggacaacacggcctccctgacccgtctcgtcgggcctccgaggcctggacggagtcgaggctggtatttattactgctagctcatatcgctaggcagcacgcacgtcccatgtgattccgtcgggacggggaaccaagccgtaggaccgtccgtaggccacgcccgaaggtcctcgtcccccg

SEQ ID NO: 237179 - DNA, 582 bp, Homo sapiens
  misc_feature: GYAE6OF02GXRC4.5.24.C02.1.454.CMB.1.raw
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgacaaccagcagtgacgttggtggttcaagtntgtctcctggtaccaacaacaccccgaacaaacgcccccaaactcatctattttcgaggtcactacgccgaccctcgacggggtccctgactcgtcttctctcggcttccaagtctgaccacgaccggcctccctgacccgtctccgtgggcctaccgagcgtggaggacgtggacgtctacgtatttaacttacgtgcacgtctactaatatcgcgaggctagcacgcacgtcccagtcgtgacgttacgttcggggacggggtaccaaggtcgtacgtacccgtcgttacggacgacggtacccggacggtccgtccgtacccccgg

SEQ ID NO: 237180 - DNA, 523 bp, Homo sapiens
  misc_feature: GYAE6OF02GU0FQ.5.24.C02.1.454.CMB.1.raw
  modified_base (365)..(365): a, c, t, g, unknown or other
  misc_feature (365)..(365): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaacgcccccaaactcatcatttttgagtcactacgcgaccctcagggtccctgatcgcttctctggctccaagtctggcaacncggcctcctgacctctctcgggctcgaggctggagatggaggctgattattactgctagctcatatgcaggcagcagcagtcccatgtgattcgtcgggcggggacacggcgtcgtaccgtcgtacggtcacggacccgaaggtccgtcgtaccccgg

SEQ ID NO: 237181 - DNA, 548 bp, Homo sapiens
  misc_feature: GYAE6OF02G8EG7.5.24.C02.1.454.CMB.1.raw
  modified_base (250)..(250): a, c, t, g, unknown or other
  misc_feature (250)..(250): n is a, c, g, or t
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
  modified_base (426)..(426): a, c, t, g, unknown or other
  misc_feature (426)..(426): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacagtcagtcaccatctcctgcactgcaaccagcagtgacgttggtggttcaagtntgtctcctggtaccaacaacaccccgacaaacgcccccaaactcatctattttgaggtcactacgcgacctcacgggtcctgatcgcttcnctggctcagtcngcacacggcctcctgaccgtctctgggctccgaggctgagatggagtcgtagtattattacgtgcagctcatntgcgagcgagcagcacgtacccagtgtcgtagtcgttccggggacgggggtaaccaaggtcctacggtacccgttaccgtacggtccgaaccggccccaacgggtccgtcccgtaccccccg

SEQ ID NO: 237182 - DNA, 521 bp, Homo sapiens
  misc_feature: GYAE6OF02G2UL8.5.24.C02.1.454.CMB.1.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (436)..(436): a, c, t, g, unknown or other
  misc_feature (436)..(436): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcacatctcctgcactgcaacngcagtcgacgttggtgttcaagtntgtctctgtaccaacacacccgacaacgccccaaactcatctattttgagtcactacgcacctcgacgggtcctgactcgcttctctcgctccaagtctgacaacacggcctcctgaccgtctcgtcgggtctccaggctgaggagtcggagtctgtattactactgctacgctacatatcgacgngcagtcagcacgtcccatcgtgacgtcgtcgggcgggacacgcgtcgacccgtcgtacggtcacggcccgaggtcctcgtccccg

SEQ ID NO: 237183 - DNA, 644 bp, Homo sapiens
  misc_feature: GYAE6OF02JQREG.5.24.C02.1.454.CMB.1.raw
  modified_base (260)..(260): a, c, t, g, unknown or other
  misc_feature (260)..(260): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
tcagatcagacacgcacgaccggtgctcgatttagtacagatcgttagggaaaggggggggtctcaggaggcagcgctctcaggacgtcaccacatggcctgggctctgctcctcctcaccctcctcactcacgggcacagggtcctgggcccaggcctgccctgactcacgcctccctccgcgtccgggtctccgtggacagtcagtcaccatcctcctgcactgccaacctagccagtgacgtttggtgttcgaagtntgtctcgtggtaccaacaaccaccccaagaacgacccccaaatcatctaagttttgaggtcactacgcgacctcggacggtcccagactcgtcttctctcggcctacacgtcgtcggaccaacgccggccctccgtcgaccgttctccgtcgggcctcgacggctaggaggtacnggacgngtatacgtttatactgacacgtctacgattaactggacaggtactacgacgtacgaccgtaacctacccgtacgttacgtacgtaaccgttccgggttaccggggaccgggggtaacccgacggtaccggtacccggtaaccggttaccggtacggtacccggaacggtccccggtaaacggtccgtaccccgggtcccccgg

SEQ ID NO: 237184 - DNA, 511 bp, Homo sapiens
  misc_feature: GYAE6OF02IKEWC.5.24.C02.1.454.CMB.1.raw
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacacccgacaaacgccccaaactcatcattttgaggtcactacgcgaccctcagggtccctgatcgcttctctggctccaagtctggcaacacgcctcctgaccgtctctgggctccgaggctgagatgagctgattatactgcagctcatatgcaggcagcagcacgtcccatcgtagatcgttcgggcgggggaccaagcgtgaccgtccgtaggtcacgcccaaggcctcgtcccccg

SEQ ID NO: 237185 - DNA, 671 bp, Homo sapiens
  misc_feature: GYAE6OF02F956E.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagccctccctccgcgtccgggtctcctggacagtcagtcaccatctcctgcactgcaaccngcagtgacgttggtggttcgaagtntgtctcctggtaccaacaacacccgacaaagcccccaaactcatctattttgagtcactacgcgacctcacgggtccctgactcgcttctcgtggcctaccaagtctggacaacgaccggtcctcccgtgacccgttccttcgtcgggccttccgacggtccgtaggacggtacgtggacggtcgtagtaactttaattacgttgacctacggccttacctaagtacgttcgacgacgggacaacggcgacgtaccgtaccggttacccccaagttcggtacgttacgttccggttaccggggtacccgggggggaacctaaacgggtcccgttaaccggtaccccggttaccgttaaccgggttccggaaccggtacccccggtaaacgggttcccgtaccccggttcccccccggg

SEQ ID NO: 237186 - DNA, 619 bp, Homo sapiens
  misc_feature: GYAE6OF02G4JUB.5.24.C02.1.454.CMB.1.raw
  modified_base (252)..(252): a, c, t, g, unknown or other
  misc_feature (252)..(252): n is a, c, g, or t
  modified_base (434)..(434): a, c, t, g, unknown or other
  misc_feature (434)..(434): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtgttcgaagtntgtctctggtaccaacaaccaccccgaacaaacgacccccaaatcatctattttgagtcactacgcgacctcgacgggtcctgactccgtcttctcgtcggtcctacctaagtctacggacctaacgaccggcccttcccgtacgacccgttctcgtcgggccttccgaggtctaggacggngtaggaggctagtatttacttactgacgtacgcttacattatcggacaggtacacggacaacgtccaccgtcccgtagttacgtcgtacgttccgggttaccggggaccggggaaccctaaggccgtacggtacccggttccgacggtaccgaccggtaccgaacggtcccgtcccgtaccccgg

SEQ ID NO: 237187 - DNA, 629 bp, Homo sapiens
  misc_feature: GYAE6OF02IVX14.5.24.C02.1.454.CMB.1.raw
  modified_base (255)..(255): a, c, t, g, unknown or other
  misc_feature (255)..(255): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtcggttcgaagttntgtcttcctggtaaccaacaaccaccccgaacaaaccgacccccaaactcactctattttgagttcactacgcaccctcgacgggtcctgactcgcttctctggctcgacgtctcggacaacgacgcctacccgtcgtacccgtctcggtcggtcctcgacgtccgtggtaacggtagtcggaggtcttaggtaactttacgttacgtgtaccgtaacgtcttaccgaacttacgtcggacctagggccacgacacggacctaaccgtcccgtagtagtacgtacgtccgggttacggggaccgggtaccaacggtccgtaacgtaccggtcgtacgtaccgacgtacccggacggtccgtacccggtaccccg

SEQ ID NO: 237188 - DNA, 566 bp, Homo sapiens
  misc_feature: GYAE6OF02HHLE6.5.24.C02.1.454.CMB.1.raw
  modified_base (284)..(284): a, c, t, g, unknown or other
  misc_feature (284)..(284): n is a, c, g, or t
  modified_base (344)..(344): a, c, t, g, unknown or other
  misc_feature (344)..(344): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctctgcactgcaaccagcagtgacgttggtggttcgaagtatgtctctggtaccaacaacacccgacaaacnccccaatcatctattttgagtcactacgccgacctcgacgggtccctgactcgcctttcncgtggcctaccagtctcgcaacacggtccctcctgtacccgtctcgtcgggctccgaggtctggaggtagtggacggctgtaatttactacgtgacgtgctcatactgcgaggctagcacgaccacgttcccagtcgtagtcgttccggtcggggaccggggaactacggcgtaccggtacccgtcgtacggtcaaccggccgacgtccgtcccgtccccgg

SEQ ID NO: 237189 - DNA, 542 bp, Homo sapiens
  misc_feature: GYAE6OF02IQ2S3.5.24.C02.1.454.CMB.1.raw
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
  modified_base (241)..(241): a, c, t, g, unknown or other
  misc_feature (241)..(241): n is a, c, g, or t
  modified_base (346)..(346): a, c, t, g, unknown or other
  misc_feature (346)..(346): n is a, c, g, or t
  modified_base (424)..(424): a, c, t, g, unknown or other
  misc_feature (424)..(424): n is a, c, g, or t
  modified_base (459)..(459): a, c, t, g, unknown or other
  misc_feature (459)..(459): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctcctccgcgtccgggtctcctgacngtcagtccaccatcncctgcactgcaaccagcagtgacgttggngttcgaagtatgtctcctggtaccaacaaccaccccgacaaacgcccccaaactcacttctattttgagtcactacgcgaccctcgagggtccctgatcgcttcnctggctccagtctgcacacgcctcctgaccgtctctcgggctccaggctgaggatggaggctagtattacttactgcngctcatctgcagcagcagcacgtcccagtgtacgntcgttcgggaccgggggactaacggccgtaccggtaccggtaccgtacggtcgaccgtacccgaacggcctccggtacccccg

SEQ ID NO: 237190 - DNA, 638 bp, Homo sapiens
  misc_feature: GYAE6OF02JR7WZ.5.24.C02.1.454.CMB.1.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
tcagatcagacacgcacgaccggtgctcgatttagtacagatcgttagggaaagggggggtcgtcgaggaggcgagcgctctcaggacgtcaccaccatggcctgggctctgctcctcctcaccctcctcactcacggcacagggtcctgggcccaggctgccctgactcagcctcctccgcgtccgggtctcctggacngtcagtcaccntcctctgcactgccaaccngcagtgaccgttggtcggttcaagttctgtctctgtacacacacccgacaacgaccccaactcactaccattttcgacgtcgtactacgcgacctctcgggtaccctgactccgtcttctactcgctcctagtctcgcacacgcctcctcaccgtactcgtaggcctccgcgtcctagacggtactcggacgtcgttacgtacttacttacgtacgacgtacgtcctacgacttacgtgtaccgaggtaccacgtaccaagaccgtaaccgttcccgaagtacgttacgtaccgttacgtttaccggggaccgggggtaaccctaacgggtaccgtaccggaaccggtttcccggaacgggttccgaccggtaccccgtaagggtccccggttaccgtaccccccggg

SEQ ID NO: 237191 - DNA, 604 bp, Homo sapiens
  misc_feature: GYAE6OF02GDI5I.5.24.C02.1.454.CMB.1.raw
  modified_base (258)..(258): a, c, t, g, unknown or other
  misc_feature (258)..(258): n is a, c, g, or t
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgaccaaccagcagtgacgtttggtggttcgaagttntgttctccgtggtaaccaaacaaccaaccccgaacaaaccgacccccaaactcatctattttgaggtcactacgcgaccctcgacggggtccctgacgtcgtcctttctcgtcggcctcgaacgtctggacacgaccggtccctccgtcgaccgtctcgtcggcctccgnggctggagntggacggcttagtattatacngcngtctanatatcgacgaggcagacgacgctaccgtcccagtcgtagacgttcgggtcgggaccgggggaactacggaccgtacggtaccgttccggtaacggccgtaaccggaccccgtacgggtccctaccccggttccccgg

SEQ ID NO: 237192 - DNA, 752 bp, Homo sapiens
  misc_feature: GYAE6OF02HB1UG.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (485)..(485): a, c, t, g, unknown or other
  misc_feature (485)..(485): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagtntgtctccgtgtaccaacaaccaccccgaacaacgaccccaactcatctattttgagtcactacgcgaccctcgacgggtcctgactcgtcttctctcggtcctcgaagtcgtcgacaacgaccggtcctcctcgaccctcgtccgtcgggtcctaccggaggtccgtaggaacgggtagtacgggtaacggtcgttaacggttaacttttaacgttaccgttacggtaaccncggttaccttaacctaacgtttaagtcgggaccgaaggggtaccctaaggaccctaacggaccgttaaccccgttaacccgtaaagttccggtacgttaacggtttacccgggggttaccccgggggggaacccggggttaacccgttaaaccgggtccggtttaaccccgggtaacccgggttttaccccggttaacgggttacccgaaccccgggtaacccccggttaaaccgggttccccggttaacccccggtcccccccggg

SEQ ID NO: 237193 - DNA, 659 bp, Homo sapiens
  misc_feature: GYAE6OF02HGWVO.5.24.C02.1.454.CMB.1.raw
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctccgtggacagtcagtcaccatctcctgcactgcaaaccngcagtgacgtttggtggttcgaagtntgtctcctagtaccaacaacaccccgaacaaacgaccccaaactcactctattttgagtcactacgccgaccctcgacggggtcctgactcgtcttctcgtcggcctacgacgtcgtcggactaacgaccggtcccttcccgtacgtacccgttcgtccgtcgggtccctccgacggtcctagggagtacgtgggtacggtcgttaggtactttaacgtacgttcgacctacgtaccttacgaatttcgacgtcgaggtaccgagaccgtacgacgtacccgttccctaagttcgtacgtacgttccggttcggggaccgggggtacctaacggtccgtaccggtacccggttacggttacgtcggaacccgtacccgggacggtcccgtcccggtcccccgg

SEQ ID NO: 237194 - DNA, 600 bp, Homo sapiens
  misc_feature: GYAE6OF02HJUKQ.5.24.C02.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (458)..(458): a, c, t, g, unknown or other
  misc_feature (458)..(458): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctcctgcactgcaaccngcagtgacgttggtggttcaagtntgtctcctggtaccaacaaccacccgacaaacgcccccaaatcatctattttgagtcactacgccgaccctcgacgggtcctgactcgtcttctcgtggcctccaagtctcggacaacacggcctccctacgacccgtctcgtcgggcctccgaggtctggaggactggaggtctagtactttacgttactgtacacgtctacatntcgcaggacagcgacgaccacgtacccctgtccgtagtacgttccggttacggggccgggggtaaccgtaacggccggttaccggtaacccggtccgtaccgggtacaccggtacccgaacggtcccgtcccgtacccccgg

SEQ ID NO: 237195 - DNA, 686 bp, Homo sapiens
  misc_feature: GYAE6OF02IMYZ5.5.24.C02.1.454.CMB.1.raw
  modified_base (243)..(243): a, c, t, g, unknown or other
  misc_feature (243)..(243): n is a, c, g, or t
tcagatcagacacgcacgaccggtgctcgatttagtacagatcgttaggggaaaggggggggtctcaggaggcagcgctcgtcaggacgtcaccaccatggcctgggcctcgtgctcctcctcaccctcctcactcgaggcacgagggtcctgggcccaggctgccctgactcagccctccctccgcgtccgggtctccgtaggactagtccgaggtcaccactcctcctgcactgaccaacngacagtgacgttggtggttacgaagtatgtactccgtacggtaccaactaaccgacccggaacaacgacccccaaacacactctacgttttcgacggtaccactaacgccgtacctacgtaaccgggttccgcgtacgtccgtccgtttactcgtcggcctaccgtaacgtcgtcgacaaacccgtcggcccttcccgtggaacccgtctaccgtcgggcctcccgagtccgtagaaggtacgtgacgcgtaattacgttaatctggactcgacctagtaattacgtcgctaaccgggataccgagacctacgacccgtcccgagttacggtacgaacgtcccgggtttcggggaccggggtaaccaggtacctacccgggtaaccgttccgggttaacgacccggtaccaacccgggtacgtacccggtccccttccccggg

SEQ ID NO: 237196 - DNA, 595 bp, Homo sapiens
  misc_feature: GYAE6OF02GCDWX.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccgggtctcctggacagtcagtcaccatcctcctgcactgccaaccagcagtgacgttggtggttcagtatgtctccgtgtaccaacaaccacccgacaaacgacccccaaactcatctattttgacgtcactacgccgaccctcgacgggtccctgactcgtcttctcgtcggctaccagtctcggcaacgccggcctccgtgacccgtctcgtcgggcctccgaggtcgtagaggtagtggacggcttagtaatttacgttacgtgtacacgtctacaattacgtgacgacggacagcgacacgaccgtcccagttcgtagtacgttccggttcggggacggggaccaacggtcgtccggaccgttccgtacggaccgaccggtaccgacggtccgtcccgtcccccgg

SEQ ID NO: 237197 - DNA, 725 bp, Homo sapiens
  misc_feature: GYAE6OF02FEUFL.5.24.C02.1.454.CMB.1.raw
  modified_base (263)..(263): a, c, t, g, unknown or other
  misc_feature (263)..(263): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacgagggtcctgggcccaggctgccctgactcacgcctccctccgcgtccgggtctcctggacagtcagtcaccatctcctgctactgacaaccagcagtggtacgtttgggtcggttacgaagttntcgtctcctaggtaaccaaacaaccaccccgaacaaacgacccccaaatcatctattttgacgtcactacgcgacctgacgggtcctgactcgtcttctcgtcggcctacctaagtcgtacggaccaaccgtaccggtcccttacccgtcggtaacccgttccgtccggttcgggcctacggtacgggtcgtaggacgggtagttagggtacggtcttagttaacttacgtacgtacgacgtacgtccttacgaagttacgtacggacgtaacggccgaacggtacctaacggtacccgttacccgtaccccgttaaggttccggttacgttaccggtttccgggtaaccgggggacccggggtaaccgtacggtacccggtaccggtacccggttaccggtaacggtacccggtaacccggtacccggtaacccggttcccgtaccccggttaccccccgg

SEQ ID NO: 237198 - DNA, 555 bp, Homo sapiens
  misc_feature: GYAE6OF02F9CAI.5.24.C02.1.454.CMB.1.raw
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (371)..(371): a, c, t, g, unknown or other
  misc_feature (371)..(371): n is a, c, g, or t
  modified_base (433)..(433): a, c, t, g, unknown or other
  misc_feature (433)..(433): n is a, c, g, or t
  modified_base (447)..(447): a, c, t, g, unknown or other
  misc_feature (447)..(447): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagccctccctccgcgtccgggtctcctggacagtcagtcaccatctcctgcactncaaccngcagtgacgttggtggttcgaagtntgtctcctggtaccaacaaccaccccgacaaacgcccccaaactcatctattttgaggtcactacgcgaccctcgacgggtccctgactcgcttctcgtcgctccaagtctggcaacncggcctccctgaccgtctcgtcgggcctcgagctgagagtggagtctagtattattactgcngtctcatatgacgngcagcagcacgtcccagtcgtgtacttcggttccgggacggggaaccacggtccgtaccgtaccgtcgtacggtccgaccgtaccgaacggtccgtacccgtcccccg

SEQ ID NO: 237199 - DNA, 605 bp, Homo sapiens
  misc_feature: GYAE6OF02GYOFQ.5.24.C02.1.454.CMB.1.raw
  modified_base (232)..(232): a, c, t, g, unknown or other
  misc_feature (232)..(232): n is a, c, g, or t
  modified_base (257)..(257): a, c, t, g, unknown or other
  misc_feature (257)..(257): n is a, c, g, or t
  modified_base (338)..(338): a, c, t, g, unknown or other
  misc_feature (338)..(338): n is a, c, g, or t
  modified_base (452)..(452): a, c, t, g, unknown or other
  misc_feature (452)..(452): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtccaccatcctcctgacactgccaaccngcagtgacgttggtggttacaagtntgtctcctggtaccaacaacaccccgaacaaacgcccccaaatcatctattttgagtcactacgcgaccctgacgggtccngatcgcttctctcggtctccgaagtctcggacaacgacggcctcctcgtaccgtctcgtggctccgacgctcggaaggactcggaggctgtaacttatacgtgctaggtcctanattatcgacgtaacgggcacggcgacgaccgtacgtacccagttgtacgtacgttcggtacggggaccgggggtaacctaacggtccgtacggtaacccggttccgttaacgggtcctaccggtacccgacggtcccggtacccgtcccccgg

SEQ ID NO: 237200 - DNA, 810 bp, Homo sapiens
  misc_feature: GYAE6OF02IP54T.5.24.C02.1.454.CMB.1.raw
  modified_base (257)..(257): a, c, t, g, unknown or other
  misc_feature (257)..(257): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctcctccgcgtccggtctctggacagtcagtcaccatctcctgcacgtgacaccagcaaggttgaccgttggtacgttcgaaagttntggttctccgttggaacccaaactaaccgaccccgaactaaaccggaccccccaaaagtcaacttcctaatttttcggacggtacctacgtaaccggccgtaacccttcgggtaccgggggttaccctaggtacgttcccggacctttcgtccgttacggggtccttacccggtaaacggttcggtaccggtactaaaacccgtccgggtcccttacccgtacgggaaacccgttcggttacgttccggggtccttaccgtaacggaccgtttcgggtaacgggtacgttagggaaccggttcgtacggttaactttaacggtttaacgttacggtacgtaacggtccgttaacgtacgttactaacggtcgaacggtacgacggacgtaacgtaccgttaccggtacccctaaggtttaccgacgttaaccgtccgggttaccggggtaccgggggtaacccgtaccgggtacccgtaacggttacccggtaacgttaccgggtaccgacccggttacccggtaaacggtccccgttacggttaccccccgg

SEQ ID NO: 237201 - DNA, 577 bp, Homo sapiens
  misc_feature: GYAE6OF02I5MB0.5.24.C02.1.454.CMB.1.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (260)..(260): a, c, t, g, unknown or other
  misc_feature (260)..(260): n is a, c, g, or t
  modified_base (380)..(380): a, c, t, g, unknown or other
  misc_feature (380)..(380): n is a, c, g, or t
  modified_base (446)..(446): a, c, t, g, unknown or other
  misc_feature (446)..(446): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacngtcagtcaccatcctcctgcactgaccaaccngcagtgtacggttggtggttacgaagttntgtctcctggtaccaacaaccaccccgaacaaacgacccccaaactcatctattttgacgtcactacgccgacctcgacggtcctgactcgtcttctctcgctccaagtctaggacaacnccggcctcctcgaccgtctcgtcgggctcgcgctgaggatggagtcgtagtatttaagtactgacngtctactatagtgacgaggacacgcagcctaccgtccagttgtacgacgttcggtacggggaccgggaaccgtaacgtcgtaccgtaccggtacgtacgtccgaccgcccgaacggtccgtcccgtccccg

SEQ ID NO: 237202 - DNA, 682 bp, Homo sapiens
  misc_feature: GYAE6OF02G2KZ1.5.24.C02.1.454.CMB.1.raw
  modified_base (335)..(335): a, c, t, g, unknown or other
  misc_feature (335)..(335): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgtcggtggttcgaagtatgtctctggtaccaacaaccaccccgacaaacgcccccaaactcatctattttgacgtcactacgcgacctcgacgggtccngatctcttctcgtcggctaccagtctcggacaacgcgccctcctacgacccgtctcgtcgggtcctaccgagcctggaacggtagtcggaacggcgtagttaacgtttacttaaccgtggaccgtaacggttccttacgtaacgttacttaccggcgtaacgggaccgacgtaccgaacgtcccgtaaccgttaccccgtaagttccgttacggtaacgttccggggttacccggggacccgggggtaaccgtaaacggtcccggttaccggtaccccggtttacggttaaccgggttaccgaacccggtaccccggtaacgggtcccgtccccgggttaccccccg

SEQ ID NO: 237203 - DNA, 667 bp, Homo sapiens
  misc_feature: GYAE6OF02F139G.5.24.C02.1.454.CMB.1.raw
  modified_base (353)..(353): a, c, t, g, unknown or other
  misc_feature (353)..(353): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcagggcacagggtcctgggcccaggctgccctgactcagccctccctccgcgtccgggtctcctggacagtcagtcaccatctcctgcactgccaaccagcagtgtacgttgggtgttacgaagtatgtctctggtaccaacaaccacccgaacaaacgaccccaatcactctagttttgagtcactacgccgacctcgacgggtcctgtactcgtcttcncgtcggaccttacgaacgtcgtacgaccaaacccgaccggtccctaccccgtacgtacccgttccgtcggtccggggtcctccggacggtcgtaggacgggtagtagggaggtaccgttaggttaactttaacttccggtagtacgacgtctacctagttacgcgacgtacggacacggaccgacgaccgtaccgtacccgtagttcgtacgttaccgtcgggttaccgggggaaccgggtactaaccggtcgtaccggaccgttaccggtacggtaccgaccggacccggtacggtcccgtacccggtccccg

SEQ ID NO: 237204 - DNA, 677 bp, Homo sapiens
  misc_feature: GYAE6OF02FFT4H.5.24.C02.1.454.CMB.1.raw
  modified_base (249)..(249): a, c, t, g, unknown or other
  misc_feature (249)..(249): n is a, c, g, or t
  modified_base (417)..(417): a, c, t, g, unknown or other
  misc_feature (417)..(417): n is a, c, g, or t
  modified_base (529)..(529): a, c, t, g, unknown or other
  misc_feature (529)..(529): n is a, c, g, or t
  modified_base (584)..(584): a, c, t, g, unknown or other
  misc_feature (584)..(584): n is a, c, g, or t
tcagatcagacacgcacgaccggtgctcgatttagtacagatcgttagggaaagggggggtctcaggaggcagcgctctcaggacgtcaccaccatggctggctctgctcctcctcaccctcctcactcagggcacgagggtcctgggcccaggcctagccctgactcacgtccctcctccgcgtccggtctcctaggactaggtcacgtccaaccctattcctcctgcctaacgtcgaccaaacccgngacctaggttcggtaaccggtttggtacgggttacaaagttgttcgtccttaccgtacggtaacccaaacgaaccaaccccgaacaaaaccgaccccctaaaatcctaatccttagttttacgacgtacacgttacgccgaccgtcgacgggtcctagctcgtcttcncgtcgcctactacgtctacggacaaccgaccgtcctccgtacgtaccgtcgtccgtacggctaccgaggtctagggagtacgtacggtacgtactacgttaattactacgtncgtacgtcttaaccattacgacgtacggacgtcgaacgacgtactaccgtaaccncgttagtcgtacgtacggtcggtacgggacggtacgacgtccggtacgtccgttacgtacgtaccgacgaccggcgtaccgtcccggtacccg

SEQ ID NO: 237205 - DNA, 514 bp, Homo sapiens
  misc_feature: GYAE6OF02G3GNQ.5.24.C02.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
  modified_base (394)..(394): a, c, t, g, unknown or other
  misc_feature (394)..(394): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagccctcctccgcgtccgggtctcctggacagtcagtcaccatctcctgcactgcaaccngcagtgacgttggngttcaagtntgtctcctggtaccaacaacacccgacaaacgcccccaaactcactctattttgagtcactacgcgacctcgacgggtcctgatcgcttctctggctcaagtctggcaacacggcctcctgaccgtctctcggctcagctgagntgagctgattatactgcagctcatatgcagcagcagcacgtcccatgtgatcgttcgggacggggacaaggcgtgacccgttacgtacggttcacgacccaacgggtcctccgtccccgg

SEQ ID NO: 237206 - DNA, 804 bp, Homo sapiens
  misc_feature: GYAE6OF02I0C99.5.24.C02.1.454.CMB.1.raw
  modified_base (230)..(230): a, c, t, g, unknown or other
  misc_feature (230)..(230): n is a, c, g, or t
  modified_base (262)..(262): a, c, t, g, unknown or other
  misc_feature (262)..(262): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcaggcacagggtcctgggcccaggctgccctgactcagccctccctccgcgtccgggtctcctggacagtcagtcaccatcctcctgcactgaccaaccngccagtcgtacggtttgggtggttacaagttntgtcctctggtaccaacaaccacccgacaaacgcccccaaatcatctattttgaggtcacgtaccgccgaccctcgacgggtcctcgacttcgcttctcgtcggcctaccgaagttcctcggaccaaccgtaccgggtcccttacccgtacgtaaccccgttccgttaccggtcgggtacccgtaccgtacggggtaccttacgggaacgggtacgtacgggtacgggtaccgtttacgggttaaactttttaaccgttaccgttacggtaaccgtacgggttacctttaaccgtaaacgttttactaccgggtaaccgttacgggacccacgggtaccgaaccggtacccggtaacccgttaacccccgtaaggtttcggttaacgggtcccgtttaccggggtttacccggggaaccggggggttaaccccgtaacgggtacccggttacccggttaacccggtttacccggttaaccggtacccggtaacccggtaccccggtaaaccgggttccccgttaaccccggttccccccggg

SEQ ID NO: 237207 - DNA, 589 bp, Homo sapiens
  misc_feature: GYAE6OF02HK558.5.24.C02.1.454.CMB.1.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (394)..(394): a, c, t, g, unknown or other
  misc_feature (394)..(394): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacngtcagtcaccatctctgcactgcaacngcagtcgacgttggtgttcgaagtntgtctctggtaccaacaaccacccgacaaacgacccccaaactcatctattttgagtcactacgcgacctcgacgggtcctgactcgtcttctcgtgcctcagtctggcaacacggcctcctcgaccgtctcgtcgggcctcgnggctgaggatggacggctagtacttaagttacgtctacgtacgtcctacgaattagtcgtcgaggtccaagtcaacgaccgtaccgtccctagttcgtagtacgttccggttacggggaccggggaacctaacggcgtaccggaccgttccgtacggtaccaccggacccgtaaggtccctcccggtacccccgg

SEQ ID NO: 237208 - DNA, 762 bp, Homo sapiens
  misc_feature: GYAE6OF02J3G8Z.5.24.C02.1.454.CMB.1.raw
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (358)..(358): a, c, t, g, unknown or other
  misc_feature (358)..(358): n is a, c, g, or t
tcagatcagacacgcacgaccggtgctcgatttagtacagatcgttagggaagggggggtctcaggaggcagcgctctcgaggacgtccaccaccagtcggcctgggctctcgctccctcctccaccctcctcacctcgacgggcacgtacgggtccgtcgggacccaggcctcggccctagactcgaccgccctccgtccggccggttccggtctccgtacgactacggtcacgtccactacgtccnccgtacgcacgtcgaacctacgngtacgngtacgtcggttcggtcgtaacgtacgtcgtcctacgcgtaaccgaaccaaccaacccgacccgtaactaaccgaccctaanccgtatttcgtagtttacgaccgacgtaccgtacggacccgtccggtacggaccgttctagcccgttctacgttaccgtgtaccggactaccgttaggaccctacggaaccctacccgtcccggaccttaccgtacggtcccgtcgttccgggacctacccggtacgtaggtaccgtacggtacgtacgtacggtacgtaccttagttaaccgtactacgcgacgtagttaccgtataaccgtcgaccgtacgaccgtaccgtaccgcgtaaaccggtcctaccggtacctaggttccgaacgggtcccgggtttaacggcggtacccggtaaccggtccgtacccggacgtttccggaccgttaacccgccgaaccgttcgccccgtaccgtcccgttacccg

SEQ ID NO: 237209 - DNA, 659 bp, Homo sapiens
  misc_feature: GYAE6OF02HB4U1.5.24.C02.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
  modified_base (283)..(283): a, c, t, g, unknown or other
  misc_feature (283)..(283): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacngtcagtcaccatctcctgcactgcaaccngcagtgacgttggtggttacgaagtntgtctcctggtaccaacaacaccccgaanaaacgcccccaaactcatctattttgacgtcacgtacgcgaccctcgacggggtcccctgactcggtcttcctctcggcctaccgaagttcctcgggacctaaccgacggcccttccctgacccgttctcgtgggcctccgaggtcctggaggatggaggctagatttatacgtgcgagctacacgtatcgacgaggtaccgagtaccgagtaccgtaccgtaccccctagtaccgttagacgtttaccgggttccggggaccggggggtaacccgtaaaccgggtccgttaaccgggtaccccggttacccggtttaaccgggtccgtaacccggacccggtaacgggtccccgttccccggttacccccccggg

SEQ ID NO: 237210 - DNA, 606 bp, Homo sapiens
  misc_feature: GYAE6OF02GV2CF.5.24.C02.1.454.CMB.1.raw
  modified_base (260)..(260): a, c, t, g, unknown or other
  misc_feature (260)..(260): n is a, c, g, or t
  modified_base (373)..(373): a, c, t, g, unknown or other
  misc_feature (373)..(373): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctcaccctcctcactcagggcacagggtcctgggcccaggctgccctgactcacgcctccctccggcgtccgggtctcctggacagtcagtccaccatcctcctgcactgaccaaccagcagtgacgttggtgttacgaagtntgtctcctgtaaccaacaaccacccgaacaaaccgaccccaaactcactctattttgacgtcactacgccgacctcgacgggtcctgactcgctctctgctcagtctgcaacncgcctcctcgacctctcgtcggcctacgcggtctggagtacgtaggagtcgtagtaatttactacgtgactagtactacattagtcgacgagtcgagcacggcctaacgtccctagtacggtactacgttcccgggtacgggggacccggggtaactaaccgggtcgtaccggtaccgtttaccggtacggtaccgacccggtacccgaacggtcccgtcccggtacccccgg

SEQ ID NO: 237211 - DNA, 570 bp, Homo sapiens
  misc_feature: GYAE6OF02JA19J.5.24.C02.1.454.CMB.1.raw
  modified_base (359)..(359): a, c, t, g, unknown or other
  misc_feature (359)..(359): n is a, c, g, or t
  modified_base (398)..(398): a, c, t, g, unknown or other
  misc_feature (398)..(398): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacagtcagtcaccatctcctgcactgcaaccagcagtgacgttggtggttcgaagtatgtctcctggtaccaacaaccaccccgaacaaacgcccccaaactcatctattttgagtcactacgcgacctcgacgggtcctgatcgcttctctgctcatctgcacncgcctcctgacctctctcgggcctccgagcgtgacggtntggaggtctagtatttacgtacgtcgtacgacgtctactagtatcgtcgacggtacacgacgacgcctaccgtccctagtcgtagtacgtcggttcgggaccggggacacggtaccgtacggtaccgttaccgtacgtaccgaccgaccgtaccgtccgtacccgtcccccg

SEQ ID NO: 237212 - DNA, 625 bp, Homo sapiens
  misc_feature: GYAE6OF02IZ947.5.24.C02.1.454.CMB.1.raw
  modified_base (263)..(263): a, c, t, g, unknown or other
  misc_feature (263)..(263): n is a, c, g, or t
  modified_base (410)..(410): a, c, t, g, unknown or other
  misc_feature (410)..(410): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctcgccgtccggtctcctggacagtcagtccacctatcctcctgcctactgaccaaaccagccaagtcgtacgttggtgttcgaagtntgtctctgtaaccaacaacacccgacaaacgccccaaatcatactattttgagtcactacgcaccctcgacgggtcctgactcgtcttctctggcctccaagtccgtagcaacgacgcctcctcgtaccgtctcgacgggtctccgngtacgtgacggtatgaggtctagtagttaacttactgaccagtcctacatacgtctcgaaggtcaggtactaagccgtaaccgtacccgagttagtacgtacgttaccggttcggggaccgggggtaacctaacggccgtaccggtaaccccggtaccggttaaccgggtacgtaacccggacccggtaaacggtcccgtacccgttacccccgg

SEQ ID NO: 237213 - DNA, 703 bp, Homo sapiens
  misc_feature: GYAE6OF02J1RS8.5.24.C02.1.454.CMB.1.raw
  modified_base (128)..(128): a, c, t, g, unknown or other
  misc_feature (128)..(128): n is a, c, g, or t
  modified_base (189)..(189): a, c, t, g, unknown or other
  misc_feature (189)..(189): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (280)..(280): a, c, t, g, unknown or other
  misc_feature (280)..(280): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctnactcagggcacagggtcctgggcccaggctgccctgactcagcctccctcgcgtccggtcnccgtggacagtcagtcaccatcctccngcactgaccaacngcagtgacgttggtgttacaagttctgtctctggtaccaacaccacccganaaacgccccaactcatactatttgagtcactacgcaacctcgacggggtccctagactcgtactttcacgtcggccttactaacggtcctagggccaaaccgtacccggtcccttacccgacgtacccgttcttccggtcgggtacctccgtacggtacgtggacggtagtacggacggttcgttaacgttaactttaacgttacgtcggtccgtaacgttcttaccttagtttaacgcggtacgaacggttaccgacgacgtaccgaccgttacccgtaccccgtaggtgttacggtccgtttaccgggttacgggtaacccgggggaacctaaccggtcccgtaaccggttaccccggtaccgttacggtacccggacccgtacccggtaaaccggttcccggaccccggtttccccccgg

SEQ ID NO: 237214 - DNA, 558 bp, Homo sapiens
  misc_feature: GYAE6OF02H0NR3.5.24.C02.1.454.CMB.1.raw
  modified_base (226)..(226): a, c, t, g, unknown or other
  misc_feature (226)..(226): n is a, c, g, or t
  modified_base (447)..(447): a, c, t, g, unknown or other
  misc_feature (447)..(447): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctctgcactgcaacngcagtgacgttggtgttacgaagttatgtctcctggtaccaacaacaccccgaacaaacgcccccaaactcatctatttttgaggtcactacgcgacctcgacggggtccctgatcgcttctctcggtctaccagtctggcaacgccggtccctcctcgtaccgtctcgtcgggcctccgaggctggaggagtgaggctagtattattactgcagctcatntgcgaggcagcagcctacgtcccagtcgtagcttcggtcggggacgggggtaccaacggcgtacgtacccgtccgtacggtcgacgacccggaacggtcctccggtccccg

SEQ ID NO: 237215 - DNA, 570 bp, Homo sapiens
  misc_feature: GYAE6OF02GOZLW.5.24.C02.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (462)..(462): a, c, t, g, unknown or other
  misc_feature (462)..(462): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccgggtctcctggacagtcagtcaccatctcctgcactgcaaccngcagtgacgttggtgttcgaagtntgtctcctggtaccaacaaccaccccgaacaaaccgacccccaactcatctattttgagtcactacgcgaccctcgacgggtcctgactcgcttctcgtggcctacaacgtctcggccaacgccgtcctccgtcgaccgtctcgtggcctcgaggtctgaggactggacgctagtattactcgtgcacgctcntatgcnggacagcganccgacgtccctatgtcacgttccggtcggggaccggggacctaacggccgtacggtacccgttcgtacggtccgaccgaccccgtaaggtcccgtaccgtacccccgg

SEQ ID NO: 237216 - DNA, 544 bp, Homo sapiens
  misc_feature: GYAE6OF02GTJXC.5.24.C02.1.454.CMB.1.raw
  modified_base (357)..(357): a, c, t, g, unknown or other
  misc_feature (357)..(357): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtgttcgaagtatgtctcctggtaccaacaacaccccgacaaacgcccccaaactcatcatttttgaggtcactacgcgaccctcacggggtccctgatcgcttctctgctcagtcngcaacacgcctcctgacctctctcgggctccaggctgacggntgnggctagtattattactgcanctacatntgcagctagcagcacgtcccatgtcagttccgtacgggcgggggtaaccaacggtccgtacggtacccgttccgtacgggtccacggccccgaaggtcccgtccgttacccccgg

SEQ ID NO: 237217 - DNA, 698 bp, Homo sapiens
  misc_feature: GYAE6OF02FM1O0.5.24.C02.1.454.CMB.1.raw
  modified_base (256)..(256): a, c, t, g, unknown or other
  misc_feature (256)..(256): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctcctgcactgacaaccagcagtgacggttggtggttcgaagtntgtctcctggtaccaacaaccaccccgacaaacgcccccaaactcatctatttttgagtcactacgcgacctcgacgggtccctgactcgcttctctcgctccaagtctgcaacacggcctccgtgtacccgtctcgtcgggcctaccgacggtctcggaggtacgtaggagggtcttacggtaatttaacgttaccgtgaccgagtcctactaacgtacgttacggaccgtaacgggccgaacggccgtaaccggaccgtaaccgttcccccgtaagttcggtacgtacgttacccggttccgggggacccggggggtaaaccctaacgggtacccggtacccgggttaacccccggttacccggttaaccgggttacccggtaaaccccgggtacccccggtaaaccgggttcccgttacccccgggttccccccccggg

SEQ ID NO: 237218 - DNA, 700 bp, Homo sapiens
  misc_feature: GYAE6OF02GMYSK.5.24.C02.1.454.CMB.1.raw
  modified_base (235)..(235): a, c, t, g, unknown or other
  misc_feature (235)..(235): n is a, c, g, or t
  modified_base (601)..(601): a, c, t, g, unknown or other
  misc_feature (601)..(601): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcacgcctccctccgcgtccggtctccgtggacagtcagtccacctatcctcctgccactgaccaaccngctagtgtacggtttgggtggttacgaagttatcgtctccgtaggtaacccaacaaccacccgaacaaacccgacccccaaactcacttaccttagttttcggacgttaccaaccgtaccggccgtaacccctacggtacggggtccctagacttccgtctttcctcgtcgtcctacgtaacgtcgtacggaccaaccgaccggtcccttcccgtacgtacccgttccgtaccggttccgggtacccttacccggacggtaccgtacgggtaacgggtaacgtacggggtaacgtacgttacggttaaacttttaacgttcgtacgtacgtacgttctactagtacgtcggacgagacacgcgacnccgacctcctagtgtacgtcgtcgggtaccgggacgggtaactacgcggtaccgtaccgtcgtacgaccgaccgaccgtacgtcccgtacggtcccccg

SEQ ID NO: 237219 - DNA, 726 bp, Homo sapiens
  misc_feature: GYAE6OF02H3VCV.5.24.C02.1.454.CMB.1.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccggtctccgtggacngtcagtcaccatctcctgcactgcaaccngcagtcgacgttggtggttacgaagttcgtgtctccgtagtaacccaactaaccaccccgaacaaaccgacccccaaatcaactctatttttcgaggttaccactacgaccgtacccctcgacgggtccctagacttccgctttcctcgtcggtcctaccgtaagttcctacgtaccaaaccgtccggccctcccgtacgtacccgttccgttaccgtcggggtacccttaccgtaggtccgtagacgggtactcggaacggtcgtataacgtttacgtacttcggactacggtcttacaagtactcgtacgacggtacgaacggccaacgaccgtacccgtaccctaaagtttcgggacgtacgtttcccggggttacccggggccgggggtaaacctaaccggttacggtacccggttaacccggttacccggtttacgggaacccgtacccgggtaaccccgtaacgggtccccggttaccccgttcccccccggg

SEQ ID NO: 237220 - DNA, 676 bp, Homo sapiens
  misc_feature: GYAE6OF02FVRNJ.5.24.C02.1.454.CMB.1.raw
  modified_base (275)..(275): a, c, t, g, unknown or other
  misc_feature (275)..(275): n is a, c, g, or t
  modified_base (327)..(327): a, c, t, g, unknown or other
  misc_feature (327)..(327): n is a, c, g, or t
tcagatcagacacgcacgaccggtgctcgatttagtacagatcgttagggaaagggggggtcgtcgaggaggcagcgctctcaggacgtcaccaccatggcctgggctctgctcctcctcaccctccctcactcagggcacaggtcctgggcccaggctgccctgactcagcctccctccgcgtccggtctcctggaccagtcagtcaccatctccctgccatgccaaccagccagtgacgttggtcggttcaagtatgtctcctggtacccaanaactacccccgacaaacaccccccaaactccatcctattttgagtcactacnccgacctcgacgggtccctgactcgtccttctctcgctaccgaagtcttggccaactaccggtcctcccgtcgacccgtccgtccgttcgggcctcccgaggcctacggtagggacgtggtacgggccttggtacttaacgttacgttacggctacggtccttacgaattaacgtgtactcggacgacgtaccgagacccgtaagaccccctaagtcgttaccgtagtttccgtaccgggggtcccgggggaaacccggaacggtacccggttaccggtaacccgggtaccccgttagggttacccgaaccgggttcccaaccgggtaccgttcccggtacccccccgg

SEQ ID NO: 237221 - DNA, 590 bp, Homo sapiens
  misc_feature: GYAE6OF02IG8SC.5.24.C02.1.454.CMB.1.raw
  modified_base (197)..(197): a, c, t, g, unknown or other
  misc_feature (197)..(197): n is a, c, g, or t
  modified_base (252)..(252): a, c, t, g, unknown or other
  misc_feature (252)..(252): n is a, c, g, or t
  modified_base (453)..(453): a, c, t, g, unknown or other
  misc_feature (453)..(453): n is a, c, g, or t
tcagatcagacacgcacgaccggtgctcgatttagtacagatcgttagggaaagggggggtctcaggaggcagcgctctcaggacgtcaccaccatggcctggctctgctcctcctcaccctcctcactcagggcacagggtcctgggcccaggctgccctgactcagccctccctccgcgtccggtctcctggacngtcagtcaccatctcctgcactgaccaaccagcagtgacgttggtgttcgaattntgtctctggtaccaacaacaccccgacaaacgcccccaaatcatctattttgaggtcactacgcgaccctcgacgggtccctgactcgtcttctctgctccgaatcgtgcaacgcggcctccctgtacccgtctccgtggtcctccgacggtcgtagaggagtggacgggctagtatttaacgttaactgtcacgtcttanacgtagtcgcgaggacctagacagaccgtaccgtaccccagtgtacggattccggtttacggggccgggggtaacacggccgtacggacccgttaccgttacggtcgaaccggccctaaggcccgtacgtcccccgg

SEQ ID NO: 237222 - DNA, 789 bp, Homo sapiens
  misc_feature: GYAE6OF02ILVZA.5.24.C02.1.454.CMB.1.raw
tcagatcagacacgcacgaccggtgctcgatttagtacagatcgttagggaaagggggggggtctcaggaggcagcgctctcaggacgtcaccaccatggcctgggctctgctcctcctcaccctcctcactcagggcacagggtcctgggcccaggctgccctgactcagcctccctccgcgtccgggtctctggacagtcagtcaccatcctctgcactgaccaaccgagcagtcgtacggttgggtcggttacgaagtatcgtacctcgtacggtaaccaaccaaaccaccccgaaacaaacccgacccccaaactctaacttacttagttttaggacggttactaaccgtaccgaccgtacccgtaccggtacggggttccctagacttccggtacttccgttcgtcggtaccttaccgaacgttccgtacgggacctaaaccggtcccggacccttaccccgtacggtacccgttccgttaccggtccgggtacctacccgtagggtccgtaagggacgggtaatacgggtacgtacgttagttaactttaacgttacgtacggtaaccgtacgtaacttacgtaaattacgacgaacggaggacctacggtaccgacgttaccgtaacccgttaccctaggttaacgacgttacggttacccggggtaccggggggaacccgggtaactaaccgggtccgttaaccggtacccgtttaacggttaacgggtacccgtaaccgggaccccggtaacggtccccggtacccccggttaccccggg

SEQ ID NO: 237223 - DNA, 624 bp, Homo sapiens
  misc_feature: GYAE6OF02G41IU.5.24.C02.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
  modified_base (261)..(261): a, c, t, g, unknown or other
  misc_feature (261)..(261): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctcaccctcctcactcgagggcacgagggtcctgggcccaggctgccctgactcacgcctccctccgcgtccggtctccgtggacngtcagtccaccntcctcctgcactgaccaacngcagtgtacgttggtggttacaagtntgtctctgtaccaacaccacccgaacaacgaccccaactcatctattttgacgtacactacgccgtaccctcgacggtccctgatcgtcttcgtctcgctacgacgtcgtcgacacgccgtcctccgtcgaccgtctacgtcggtacctccgacggcgtaggagtagtcggacggtacttagttaagtttactaccgtcgtacgtacgtctacgtactagtcgtacgacggtaccagacctacgccgtaaccgtcctagtcgtccgtagggttccggtacgggggaaccgggtaaccgacggtccgtaccgaccggttacgacggttaccgaccggaccggtacggtccgtacccgtccccgg

SEQ ID NO: 237224 - DNA, 667 bp, Homo sapiens
  misc_feature: GYAE6OF02JR630.5.24.C02.1.454.CMB.1.raw
  modified_base (142)..(142): a, c, t, g, unknown or other
  misc_feature (142)..(142): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (526)..(526): a, c, t, g, unknown or other
  misc_feature (526)..(526): n is a, c, g, or t
tcagatcagacacgcacgaccggtgctcgatttagtacagatcgttaggaaagggggggtcgtcgaggaggcagcgcgtcgtcaggacgtcaccgaccatggcctgggctctgctcctcctcaccctcctcactcaggcacnggtcctgggcccaggctcgccctgactcagcctccctcgcgtccgggtctccgtggactcgtcacgtcaccatcctcctgctactcgccaacagccagtcgtacgttggtggttacaagttctagttcgtccgtcgtaaccaacaaccgacccgtaacaaccgacccccgtaactacactaccttagtttacgacgtcctaacaccgtaccgaccctcgacgggtcctacgtacnccggtnttaccgtctcggacctcgtaacgtcgtctacgaacgaccgtcctccgtacgtaccgtccgtacgtacgggtcctccgacgtcgtcggacgtacgtcgtaacgcgttacgttagtacttacggtgacctaggtcttacgaattntcgggacctagggtaccacggtatcgaccgttacgacctagtgtaccgtcgttcgggtaccgggtccgggaaacgtcgtacggtccgaccgttacggtccggtacgccgtaacccgggtacggtccgttaccccgccccgg

SEQ ID NO: 237225 - DNA, 631 bp, Homo sapiens
  misc_feature: GYAE6OF02I0AFT.5.24.C02.1.454.CMB.1.raw
  modified_base (374)..(374): a, c, t, g, unknown or other
  misc_feature (374)..(374): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcggggcacagggtcctgggcccagtctgccctgactcagcctccctccgcgtccgggtctcctggacagtcagtcaccatctcctgcactgcaaccagcagtcgacgttggtggttacgaagtatcgtctcctggtaccaacaaccaccccgacaaaccgcccccaaactcatctatttttgaggtcacgtacgcgaccctcgacgggtccctgactcgtcttctctggctccagtctgcacncgcctccgtgacctctcgtgggcctccgacggcgtaggaggtagtcggacgggtacttgtatttaacgtttaccgtcgcgtacgtccttacgtaatacgttcgcgtagggccagtccgaacgtccgtaccgtcccctagttcgttacgtacgttccggttcggggaccggggaaccgtaacggtaccgtacggtacccgtaccggttacggtaccgaccggacccgaacggtcccgttacccggcccccgttaccgg

SEQ ID NO: 237226 - DNA, 714 bp, Homo sapiens
  misc_feature: GYAE6OF02I393H.5.24.C02.1.454.CMB.1.raw
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
  modified_base (351)..(351): a, c, t, g, unknown or other
  misc_feature (351)..(351): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctggcccaggctgccctgactcacgcctccctccgcgtccgggtctcctggacagtcagtccaccatcctctgacactgaccaaccngcaagtgacgttggtggttacgaatntgtctcctaggtacccaacaaccaaccccgaacaaaccgaccccaactcattctattttgacgtcactaccgccgacctcgacgggtcctanctcgtcttctctcggcctaccaacgtctacggtaccaaccgtaccggtcccttcccgtacgtacccgttacgtccgtccgggtacctcccggacgggtactacgggaacggtacgtacgggacggtacgttacgttaaacgtttacgttacgtcgaccgtacgttacctacgttaacgtacgtacggaccgaaggtcctaacgaccgtacggtacccgtaccgtaccccgtagttccggttagtaccggttaccgggtaccgggggtaccggggtaaccctaaggtcgttaaccggtacccgtaccgggttacgtcccggaaaccggtcccggtaccggaccccggttcccggtaccccccgg

SEQ ID NO: 237227 - DNA, 676 bp, Homo sapiens
  misc_feature: GYAE6OF02JEMNT.5.24.C02.1.454.CMB.1.raw
  modified_base (241)..(241): a, c, t, g, unknown or other
  misc_feature (241)..(241): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggcctgccctgactcagcctccctccgcgtccggtctcctggacagtcagtcaccatctctgcactgcaacagcagtgacgttggngttacaagttatgtctccgtggtaaccaactaaccaaccccgaacaaaccgaccccaaactacactactattttgacgtctaactacgaccgtaccgtcgacgggtcctagtactccgtacttctcgtcgctacctaagtctgacaacgaccggtcctaccgtcgaccgtcctcgtcgggtcctccgacgtcgtacggaggtacgtacgtacgtcgtaagtacttttaacgtacgtcgactacgtaccgtactaacgtacttacggaactacggacgtacgaccgacgacctaccggttaccctaggttaccgtacgtaccggtttcgggtaccggggaccgggaacccgttaacgcgttacccggtaacccggttacggtaccggttaaccgaccgttaacccggaacggttccccgtacccggttacccccgg

SEQ ID NO: 237228 - DNA, 569 bp, Homo sapiens
  misc_feature: GYAE6OF02FL2F7.5.24.C02.1.454.CMB.1.raw
  modified_base (258)..(258): a, c, t, g, unknown or other
  misc_feature (258)..(258): n is a, c, g, or t
  modified_base (286)..(286): a, c, t, g, unknown or other
  misc_feature (286)..(286): n is a, c, g, or t
  modified_base (365)..(365): a, c, t, g, unknown or other
  misc_feature (365)..(365): n is a, c, g, or t
  modified_base (388)..(388): a, c, t, g, unknown or other
  misc_feature (388)..(388): n is a, c, g, or t
  modified_base (399)..(399): a, c, t, g, unknown or other
  misc_feature (399)..(399): n is a, c, g, or t
  modified_base (434)..(434): a, c, t, g, unknown or other
  misc_feature (434)..(434): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctccgtggacagtcagtcaccatcctcctgccactgccaaccagcagtcgacgttggtggttcgaagtntgtctcctggtaccaacaacaccccganaaacgcccccaaactcatctattttgagtcactacgcgacctcgagggtccctgactcgcttctctgctcatctgcacncgcctccgtgccgtctcgcggcncgcgctgagtntaggcgcgtagtattagtactgcagctacagttancgacgaggcagtcacgtcaccgttacccngttacgngtacgtccggttcgggggaccggggtaaccacggtacgtaccggtacccggtacgtaggttacccgaggaccccgtaaggccccttccggtccccccgg

SEQ ID NO: 237229 - DNA, 709 bp, Homo sapiens
  misc_feature: GYAE6OF02GZGOE.5.24.C02.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcaggcacagggtcctgggcccaggctgccctgactcagcctcctccgcgtccggtctcctggacngtcagtcacatctcctgcactgcaaccngtccagtcgtacgttgggtgttacgaagtatgtctcctggtaccaacaacaccccgaacaaacgccccccaaactcgtagtactttctggacgtcagtaacgccggccctcgacggggtcccagacttccggtcttctcgtggtcctccaagttctcggactaaccgacggtccctccctagaccccgttctcgtcgggtccttacccgagtacgtcgaggtaatcgggtaaggtcctaggtaccttaacgtttaaccgttcggaccacgtaccgttaccgtaagttttcgggaccttagggaccgaacggttaccgttaacgttacccgttacgtttccggggtaaccggggaaacggttccccgaaacgggttcttacccgggaacccgttaccggtaaaccgggttcccgtaaccggacccgtaacgtcccgtcccggtacccccgttggttacccaccgtttcccgtcccgtttccccccgg

SEQ ID NO: 237230 - DNA, 718 bp, Homo sapiens
  misc_feature: GYAE6OF02IZE5S.5.24.C02.1.454.CMB.1.raw
  modified_base (229)..(229): a, c, t, g, unknown or other
  misc_feature (229)..(229): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtccaccatctcctgcactgcaaccngcagtcgacgttggtggttacgaagtctgtcctcctaggtaaccaaacaaccaacccgacaaaccgcccccaaactcatctattttgagtcacgtaccgccgacctcgacgggtccctgactccgtcctcgtctcggtcctaccgaacgttctcggaccaacgtaccggtcccttcccgtcgtaacccgttccgtaccgtcggggaccctaccgtagggtcccgttagggaacggtagtcggacgggttccttaggttaaccttttaacgttacctcgtacgtagttaccttacctaattacgtccgtacgtacggtaccgtaacggaccgtaacgtacccgtaaccgttaccccgtagttcggttacgtaccgtttccggggtccggggaaccggggtaacctaacggtccgttaaccggtacccggtaccggttacggacccgtaaccggtaccccggtaaccggttcccgtccccggtacccccgg

SEQ ID NO: 237231 - DNA, 627 bp, Homo sapiens
  misc_feature: GYAE6OF02I0G8J.5.24.C02.1.454.CMB.1.raw
  modified_base (198)..(198): a, c, t, g, unknown or other
  misc_feature (198)..(198): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacngtcagtcaccatctcctgcactgcaaccagcagtgacgttggtggttacgaagtntgtctcctggtaccaacaaccacccgaacaacgcccccaaatcatctattttgagtcactacgcgtacctcgacgggtcctgatcgcttctcgtcggcctaccgaagttcctcggacaacgaccggtccctcccgtcgacccgttccgtcgtcgggcctccgaggtcgtcggaagtcgtggaggtctggtaactttatacgtcggtacagtccgtactaatagtcgaccgaggaccgacgtacgaacggccaccggttacccagttcgtagaccgtttccggtacggggaccgggggtaaccacgtcggtaccgaccggttccggttaacgtaccggacggtacccgaaccgggtccttacccggtaccccccg

SEQ ID NO: 237232 - DNA, 801 bp, Homo sapiens
  misc_feature: GYAE6OF02GWTSF.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctggcccaggctgccctgactcacgcctccctccgcgtccggtctcctggacagtcagtcaccatcctcctgccactcgaccaaacccagcctaagtcgtaccgtttgggtcggttacgaaagttagttcgttccttccgtacggtaaaccaaaccaaacccaacccccgaaccaaaaccgaccccccaaactccaattccttaatttttcggaacggttcctaaccgtaccggaccgtacccctacggtaccggggttccctacgacgttccgttccttccttccgttacggtccttaccgtaaacgtttccgtacgggtacccaaacccgtacccgggtccccttaccccgttaccgggtaccccgttcccgttccggttaccggggtacccttacccggaggtacccgtacgggtaacgggtacgtagggacggtacgttacggttaaacttttaacttacgttcgacgtaccgtacttacgttaacttaacgtcggaaccgacggacgacgtaccgaacgtaccgtaaccgtccccgtagtcgtgttaaccgtcgggttacggggaccggggaaccgtaacggtccggtaccgtaccgttaccgtacggaccgtaaccggacccggtacggtcccgtaccccggtccccgg

SEQ ID NO: 237233 - DNA, 692 bp, Homo sapiens
  misc_feature: GYAE6OF02HMQK8.5.24.C02.1.454.CMB.1.raw
  modified_base (263)..(263): a, c, t, g, unknown or other
  misc_feature (263)..(263): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacagggtcctgggcccaggctcgccctgacctcacgccctcccgtccgcggtccggtctcctggacagtcagtcaccatcctcctgcactcgacaaccagctagtgacgttggtggttcgaagtntgtctctcgtaaccaacaaccacccgaacaaacgaccccaaactcatctattttgagtcaactacgctaccctcgacgggtccctgtacgtcgtcttcgtcgtcggtctacgtaacgtctacgactaacgaccgcccttccgtacgtacccgttctccgtcgggccttaccgacgttccgaggtagacgtggacggtcgttacgttaattaacgttacgtcgtacctacgtacctagtaacttacgtacggacgaccgggctaaccggacgtaacgtacccgtacgttaccccagttccggtaactcgggttaccgggttaccgggggtaccgggggaacctaccggtaccgttacccggtaccgttacccggtaccggtaccgaaccgggtaaccccgtaaggtccccggtaccccggttccccccgg

SEQ ID NO: 237234 - DNA, 1072 bp, Homo sapiens
  misc_feature: GYAE6OF02JVCH8.5.24.C02.1.454.CMB.1.raw
  modified_base (148)..(148): a, c, t, g, unknown or other
  misc_feature (148)..(148): n is a, c, g, or t
  modified_base (260)..(260): a, c, t, g, unknown or other
  misc_feature (260)..(260): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtccngggcccagggctcggccctagactcagccctcccgccgcggtcccgggtctccgtggacctacggtccagtccacctacttcctcccttggacctacctcggccaaaacccngacgtacggttcgtaacgggtttcggtggttacgaaggttacgttcgtaccttccgtcggtaaccaacctaacccgaccccgtaaccaaaaccgccccccaaactccaatacttacgttttacgaacggttacctacgttaccgaccgtaccccgtacggtaacccggggttccctacggtaacgtcccgggtacctttccgttcccggttaccgtacccgttacccgtaacgtttacccggtcggttaacccgaaccgtaccccggggtaccccttaccccgggttacccggttaaccccggttccgttccccggggtttaccggggtacccgtttaccccggtaaacccggggttccgttaaccggggtaaccgggtttaaccggtaggggttaaacccgggttccggtttaacgttaaaccggtttttaaccgtttaccgtaacccgggttaccgttaaaccggttaccgtttaaccggttaaaccggtttaaccgttaaccgggggttaaccggtaacgggttaaccccgtaaccggtaaccgttacccgggtaacccggtttaaccccgttaaacccccggggttcgtaaccgggggtttacctaccgggggttttaccccgggggttttaccgggggggaaacccccccgggggggtaaccggtttaaaccccggggttaacccgggtttacccccgggtaacccgggggtttaaaccggttttccccgggaacggtttaaaccccggggtacccccgggttaaacccgggtcccgggggttaccccccccgttaaccccccgggg

SEQ ID NO: 237235 - DNA, 582 bp, Homo sapiens
  misc_feature: GYAE6OF02FI7WQ.5.24.C02.1.454.CMB.1.raw
  modified_base (254)..(254): a, c, t, g, unknown or other
  misc_feature (254)..(254): n is a, c, g, or t
  modified_base (476)..(476): a, c, t, g, unknown or other
  misc_feature (476)..(476): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgccactgcaaccagcagtgacgttggtggttcgaagtntgtctcctggtaccaacaacacccccgacaaagccccccaaaactccatctatttttgaggtcactacgcgaccctcgaggggtccctgactcgcttctctggctccaagtctgcaacacggcctcctgaccgtctctgggcctccaggctgaggatggagctgtattatactgcagtctcaatatgctaggctagactacgcctacgtccccagttcgtanacgttccggttcggggaccgggggacccaaaggtccgtacggtacccgttacccggtacgggttccgaaccggtaccccgaacggtccctacccggtaccccccgg

SEQ ID NO: 237236 - DNA, 665 bp, Homo sapiens
  misc_feature: GYAE6OF02HB127.5.24.C02.1.454.CMB.1.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcaggcacgagggtcctgggcccaggctcgccctgactcagcctccctccgcgtccggtctcctggacagtcagtcaccatcctcctgcactgacaaccngcagtgacgttggtgttcgaatntgtctctgtaaccaacaaccacccgaacaaaccgaccccaaactcatctagttttagacgtccaactacgaccgtaccccgtcgacggggttccctagtactccgtctttccgtcgtcggtcctaccgaacgtcgtacggacctaacgaccggtccttcccgcgtacccgttcgtcgtcgggtcctaccgacggtctggaggactggacggtctagtaagtttaacttacgcggtctacgtcctacgtaattacgtccgtacgaacggcgaacgtcgaacgtacccgtaccgtaccctagttcgtgttaccgttcggtccgggggaccggggtaacctaaggtccgtaacccggtaccgtaccgttacggtaccgaaccggaccgtaacgggtcccgtacccggtacccccg

SEQ ID NO: 237237 - DNA, 685 bp, Homo sapiens
  misc_feature: GYAE6OF02GDY6E.5.24.C02.1.454.CMB.1.raw
  modified_base (248)..(248): a, c, t, g, unknown or other
  misc_feature (248)..(248): n is a, c, g, or t
  modified_base (279)..(279): a, c, t, g, unknown or other
  misc_feature (279)..(279): n is a, c, g, or t
  modified_base (367)..(367): a, c, t, g, unknown or other
  misc_feature (367)..(367): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctcctccgcgtccgggtctcctggacagtcagtcaccatctcctgcactgcaaccgcagtgacgttggtggtcaatntgtctctggtaccaacaacacccgacaaacnccccaaactcactctattttgacggtcacctacgccgacccgtcgacggggtccctgactcgtcttctcgtacggccttcaacgttcncggaccaacgaccggtccctcccgtcgacccgttctccgtcgggtcctccgaggtctcggaaggtacgtcggtacggtcgtagtacttacgtttactcggacgacgttccttagtaagttacgtcggtccgaaggtaccgacggtacgacgttaccgtaccgtcccgttaaggtcgtttacgtacgttacccgggttaccggggggaccgggggtaaccgtaaccgggttacccgtacggggtaccccgtttaccgggtaaccggttcccggtaacccggtaacccggtacggtaccccgtcccgggttaccccccgg

SEQ ID NO: 237238 - DNA, 571 bp, Homo sapiens
  misc_feature: GYAE6OF02G9TMY.5.24.C02.1.454.CMB.1.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctcctccgcgtccgggtctcctggacagtcagtcaccatctccgtgcactgccaaccngcagtgacgtttggnggttcgaagttatgtctcctggtaccaacaacacccgaacaacgccccaaactcatcattttgagtcactacgcgacctcgacgggtcctgactcgtcttctctcgctcaagtctggacacgacggcctcctcgaccgtctcgtcgggctccgagctggaggatgagtcgtgtattattactgtacngtctnaatatcgacgaggcagtccgagcaccgtcccagttcgtagacgttcgttacggggaccgggggtaacctaacggtcgtacggtacccgttccgtaacggtccgacgccccggtaaggtccgtaccggtccccccgg

SEQ ID NO: 237239 - DNA, 681 bp, Homo sapiens
  misc_feature: GYAE6OF02JH2P4.5.24.C02.1.454.CMB.1.raw
  modified_base (221)..(221): a, c, t, g, unknown or other
  misc_feature (221)..(221): n is a, c, g, or t
  modified_base (519)..(519): a, c, t, g, unknown or other
  misc_feature (519)..(519): n is a, c, g, or t
tcagatcagacacgcacgaccggtgctcgatttagtacagatcgttagggaaaggggggggtctcgaggaggcagcgctctcaggacgtcaccaccatggcctgggctctgctcctcctcaccctcctcactcagggcacgagggtcctgggcccaggctcggccctgactcagccctccctccgcgtccggtctccgtggacagtcagtcaccatctccngcactgaccaaccagccaggtcgtacggtttggtggttacgaaagtgtcgttacctccgtcggtaaccaacgaaccaaccccgaacgaaaccgaccccccaaactccgacttactacgttttcgacggtccactaccggccgaccccttacggaccggggtccctagtacctcgtaccttctacgtcgtcctcgaacgtcgtgaccaacgtaccgcctcgtcgacctctcgtcggcctcgacggtccgtaggtacggctaggcggtgtactattacgtcgtagctacgtctcagttancgtcgaacgtccagaccgtagtaccaccgttaccctagtcggtacgtaccgttcgggtacccgggggccgggtaacctaaccggcctaccgggttacccggttaccggtaccggtttcgaacccggtacccggtaccgggtaccccgtcccggtacccccgg

SEQ ID NO: 237240 - DNA, 613 bp, Homo sapiens
  misc_feature: GYAE6OF02HCBR3.5.24.C02.1.454.CMB.1.raw
  modified_base (268)..(268): a, c, t, g, unknown or other
  misc_feature (268)..(268): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcagggcacagggtcctgggcccaggctgccctgactcagcctccctccgcgtccgggtctccgtggacagtcagtcaccatcctcctgctactcgacaaccagcgaagtcgtacggtttgggtggttacgaagttntcgtcctccgtaggtaaccaacaaccaccccgaacaaaccgcccccaaactcatctattttgacgtcactacgcgacctcgacgggtccctgactcgtcttctctcgctaccagtctggccaacaccggcctccgtcgaccgtctcgtcggctcgacgctggagtgtggagctagtattacttactgtcacgtctacgtatagtcgtacgaggacagccgacgccgtaccgtaccctagttcgtacgtacggttccgggttcggggaaccgggggtaccacggtaccgtcggtacccgtacggtcggtacgaccggtaccggacggtccgtcccggtacccccgg

SEQ ID NO: 237241 - DNA, 579 bp, Homo sapiens
  misc_feature: GYAE6OF02IUYDG.5.24.C02.1.454.CMB.1.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctcctcgcgtccggtctcctggacagtcagtcaccatctcctgcactgccaaccngcagtgacgttggtggttcgaagtntgtctcctgtaccaacaaccacccgacaaacgccccaaactcatctattttgagtcactacgcgacctcgacgggtcctgactcgcttctctcgctccaagtctcggacaacgcggcctccgtgaccgtctcgtcggctccgaggctggggggggactacgtcggacggtcgtagtattacttacgtcgtcgacgtctctattactcggacgaggcgagaccgtagacgtaccgtccctagttcgtacgtacgtcggttcggggacggggaactaacgcgtacgtaccgtcgtacggtcgaccgacccgaacggtccgtccgtccccg

SEQ ID NO: 237242 - DNA, 580 bp, Homo sapiens
  misc_feature: GYAE6OF02IZEQX.5.24.C02.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
  modified_base (466)..(466): a, c, t, g, unknown or other
  misc_feature (466)..(466): n is a, c, g, or t
tcagatcagacacgcacgaccggtgctcgatttagtacagatcgttagggaaaggggggggtctcaggaggcagcgctctcaggacgtcaccaccatggcctgggctctgctcctccctcaccctcctcactcagggcacagggtcctgggcccaggctgccctgactcagcctcctccgcgtccgggtctcctggacngtcagtcaccatctcctgcactgaccaacngcagtgacgttggtgttcgaagttntgtctcctggtaaccaacaaccaaccccgacaaacgcccccaaactcatctagttttgagtcactacgccgaccctcgacgggtcctaggactcgtcttctctcggactccaagtctagcaacaccggcctcccgtcgaccgtctcgtcgggtcctccgagctgagatggagtctgtatttatactgctagcctanagtangcgacgcacgngacgacaccgtacccagtcgtgtacgttcggttaccgggacggggacctaacggtccgtacggacccgttccgtacggtaccaccggtacccgacgtcccgtcccgtcccccgg

SEQ ID NO: 237243 - DNA, 703 bp, Homo sapiens
  misc_feature: GYAE6OF02JZBSA.5.24.C02.1.454.CMB.1.raw
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (350)..(350): a, c, t, g, unknown or other
  misc_feature (350)..(350): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacaggtcctgggcccaggctgccctgactcagcctcctccgcgtccggtctccgtggacagtcagtcacatcctcctgcactgccaaccgngcagtcgtacgttggngttacaagttntgtctacgtcggtaaccaacaaccaccccgacaaccgccccaatcactctattttgacgtcactacgccgaccctcgacgggtccctgacttccncttactcgtcggcctaccgaagtcgtacggtacaccgtaccggtcctacccgtcgtacccgttccgttcgtcggtcctaccgtacgggtcctacggtacggtaacgtcggaacggtcgtaggttactttaacgttacgtcgtacgtaccgtccttacgaacttagtaccgacgtacggtacgacggtacgaacgacccgtaaccgtccccgtaggtccgttagtaccgtttcgggtaccgggggtaccggggaaaccggttacggtaccggtccggtaaccccgttacgggttaacggtccccggtaaaccggtacccggtaaccgggttccccgttacccggtccccccggg

SEQ ID NO: 237244 - DNA, 655 bp, Homo sapiens
  misc_feature: GYAE6OF02FLNPG.5.24.C02.1.454.CMB.1.raw
tcagatcagacacgcacgaccggtgctcgatttagtacagatcgttagggaaagggggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacagtcagtcaccatctcctgcactgcaaccagcagtgacgttggtggttcgaagtatgtctcctggtaccaacaaccaccccgacaaacgacccccaaactcatctattttgagtcactaccgcgaccctcgacggggtccctgtactacgtcttcctcgtcggtcctaccacgtcgtacggaccaaccgaccggtccctacccgtcgtacccgttctacgtcgggcctccgacggcgtggacggatacggaggtctacgtaatttacttacgtgcctagtccttactatacgtgaccgaggtacgacgaccgagtacctaaccgtcccctaagttcgtaccgtacgttaccgggttaccgggggaccggggggtaacccgacggtccgttaaccggtacccgtacggtaccggtaccggaccggaccccgaacgggtcccgtacccgtaccccccgg

SEQ ID NO: 237245 - DNA, 626 bp, Homo sapiens
  misc_feature: GYAE6OF02I1B93.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (547)..(547): a, c, t, g, unknown or other
  misc_feature (547)..(547): n is a, c, g, or t
tcagatcagacacgcacgaccggtgctcgatttagtacagatcgttagggaaagggggggtctcaggaggcagcgctctcaggacgtcaccaccatggcctggctctgctcctcctcaccctcctcactcagggcaacgagggtcctgggcccaggctgccctgactcagccctcctccgcgtccggtctcctggactagtcagtcaccatctcctgcatgacaaccngcaagtgagttggcgttacgaagtntgtctcgtgtaccaacgaaccacccgaacaaaccgcccctaaactcaacttctattttcggacgtctacgtaccgccgaccgtcgacgggtcctgactcgcttactcgtcgcctacgagtcgtgacaacgccgtacctccgtcgacctcgtcgcggtcctcgagtccgtgagtatcggacgtctagtacttactcgagtcagtctagaacttgacgacaggtccgaagtccgaacgtcgacccgtccgtagttacgttcgtacccgttacgggtaccgggggacggggtaaacnccgggtacccggtacggtacccgttaacgttcggaaccggtaccggtacccgaacgggtcccgttccccggtaccccgg

SEQ ID NO: 237246 - DNA, 661 bp, Homo sapiens
  misc_feature: GYAE6OF02G7GAH.5.24.C02.1.454.CMB.1.raw
  modified_base (214)..(214): a, c, t, g, unknown or other
  misc_feature (214)..(214): n is a, c, g, or t
  modified_base (471)..(471): a, c, t, g, unknown or other
  misc_feature (471)..(471): n is a, c, g, or t
tcagatcagacacgcacgaccggtgctcgatttagtacagatcgttagggaaaggggggggtctcaggaggcagcgctctcaggacgtcaccaccatggcctgggctctgctcctcctccaccctcctcactcgagggcacagggtcctgggcccaggctgccctgactcacgcctccctccgcgtccgggtctccgtggacagtcagtcaccntctctgcactgaccaaccagcagtgaccggttgggtggttacgaagttgtgttcctccgtacggtaaccaaacaaccaacccgaccaaaccgacccccaaactcactctattttgacgtacacgtacgaccgaccctcgacgggtcctgtactcgtcttctcgtgcctacagtctcgacacgccgcctccgacgtaccgtctcggtcggtacctcgcgtcgtaggaggtagtcgacggtctagtattactacgtacncgtagtcctatatacgtcgcgaacggcgacgtacgaacgtaccgtaccgtcccgtagttcggtacgttacggttaccggttaccggggggtaccggggtaaccggtaacggtcggttaacccggtccgttaacccggttacgggacccgtaaccgggaccgtaaccggttcccgccccggttcccccggg

SEQ ID NO: 237247 - DNA, 652 bp, Homo sapiens
  misc_feature: GYAE6OF02JQISQ.5.24.C02.1.454.CMB.1.raw
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
  modified_base (260)..(260): a, c, t, g, unknown or other
  misc_feature (260)..(260): n is a, c, g, or t
  modified_base (332)..(332): a, c, t, g, unknown or other
  misc_feature (332)..(332): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcacgggcacgagggtcctgggcccaggctgccctgactcagccctccctcgcgtccgggtctcctggacagtcagtccacntctcctgcactgccaacngcagtcgaccggttggtcggtacgaagttntgtctcctgtaccgtaacacaccccgacaaaccgacccccaaactcactacttagttttgacgtcacgtacncgaccctcgacggggtacctgactcggtccttcgtctggcctacgaagttccgtacggccaacgtaccggccctcccgtcgaccgttctccgtcggtacccgtcgtaccggtcgtacggtacggagtcgggtacgtcgttacggtaactttacgttaccgtacgtcgtacggtccttacgtatacgttcgacgcggtacgcgtacgacgaccgtaccgtcccctagtgtacgtcgttccggttacgggaccgggtaaccgagtccggtacgaccggtacgtacggttcaccgttcccggaacggtcctacccgtccccgg

SEQ ID NO: 237248 - DNA, 769 bp, Homo sapiens
  misc_feature: GYAE6OF02IEOAD.5.24.C02.1.454.CMB.1.raw
  modified_base (220)..(220): a, c, t, g, unknown or other
  misc_feature (220)..(220): n is a, c, g, or t
  modified_base (625)..(625): a, c, t, g, unknown or other
  misc_feature (625)..(625): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgaggcacgagggtcctgggcccaggtctcgccctgactcagccctcctccggcgtccgggtctccgtggacagtcagtcacatctcgnctctgaccacgagcagtacgtacggtttggtaggttacgtaagtattcggttacctcgtaacggtaacctaaaccgaaccgtaacccgaaacgtaaacccgaccccctaaactcgtaacttaccgttaattttacggaaccggttactaaccctaacggtacctaccccgtacggtacccgggggttaccccttaggaacttcccggttctttacgaccggttacggacccttaaccgtaaagttcccggaggtacctaaaccgtcgtaccccgttctaccgaccgtttctccgtacgggtccctaacggacgttacgtacgacggtaagtcggaacgttgtaacgttaacgttacgttaccgtacgacgtacgacgtactaagttcgaacgtcgtacgggtacncgtaaccgtagtaccgtaaccgttcctaagtttcgtacgtacgttccgggtacggggaaccggtacgtaaccggtctacccgggttaaccctaggttaaccggccgtaacggtacccgaacggttcccgaaccccggtttcccg

SEQ ID NO: 237249 - DNA, 678 bp, Homo sapiens
  misc_feature: GYAE6OF02JW2TN.5.24.C02.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtccacntctctgcactgaccaacngcagtcgacgttggtggttcgaagttntcgtctccgtagtaccaacaaccacccgaacaaaccgaccccctaaactctactacttagttttgacgtaccacgtaccgcctacctcggacgggtccctagactcgtcttctcgtcgtcctcgtacgtcgacggacaccgaccgtcctacccgtcgtacccgtccgttcggtcggtccgttaccgacgggtcgtacggacgggtacgtcggtaacggttcgttaacgttacgttaactttaccggtcgtaccgtacgttacttaccgtaacgttcgtacggaccgtacgggtccacgtacgaccgtaccgtaccgtcccgtaagttcgtacgtacgttccgggtacggggaccggtaacgacgtcgtaaccggccgttaccgtacgaccgaccggtacccgtacgtcccgtccgtaccccgg

SEQ ID NO: 237250 - DNA, 605 bp, Homo sapiens
  misc_feature: GYAE6OF02H3WQH.5.24.C02.1.454.CMB.1.raw
  modified_base (229)..(229): a, c, t, g, unknown or other
  misc_feature (229)..(229): n is a, c, g, or t
  modified_base (256)..(256): a, c, t, g, unknown or other
  misc_feature (256)..(256): n is a, c, g, or t
  modified_base (391)..(391): a, c, t, g, unknown or other
  misc_feature (391)..(391): n is a, c, g, or t
  modified_base (411)..(411): a, c, t, g, unknown or other
  misc_feature (411)..(411): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctctcactcagggcacagggtcctgggcccaggctgccctgacctcacgccctccctccgcgtccgggtctcctggacagtcagtcacatctcctgcactgacaacngcagtgacgttgggtgttcgaaagttntgtcctccgtacggtaccaaaccaaccacccgaacaaaccgacccctaaactcaacttctaacgtttttgacggttcaactaccgccgaccctcgacgggtcctgactccgtcttctcgtcgtcctcgtaagtcncggacaaccgcgccctccgngtaccgtctcgcggcctacgngtcngaggatcggacgtcgtagtactttacgttacgtcgccgaactcgtactactagtcgacgtaaggcgtaacgcacggacaccgttcccagttacgtcgacttcggtacgggacggtacgacgtcgtcgtaccgtggtaaccgcgtaccgccgaacggtcctacgtccccg

SEQ ID NO: 237251 - DNA, 680 bp, Homo sapiens
  misc_feature: GYAE6OF02GHUW2.5.24.C02.1.454.CMB.1.raw
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgaccaaccngcagtcgacgttggtggttcgaagtntgtctccgtggtaccaacaaccacccgaacaaaccgcccccaaatcatctattttcgagtcactacgcaccctcgacgggtcctgactcgtcttctcgtcgcctcgagtctcgacaccgacggtccctacctcgtaccgtcctcgtcggtcctccgtacggtctagggaggagtcggacggtcgtagtaacgtttaactaccgttggtaccagttaccgtacctaagttacgtacggacgtacgggaccgaacggtccgtaacggaccgtacccgtaacccgtaagtcgttacgtacggtttccggggttaccgggggtaacccgggggtaaccgtaaccggtccggttaaccgggacccggttaccggtaccggttaccgaaaccggtaccccggaacggttccccggtacccgtccccccgg

SEQ ID NO: 237252 - DNA, 800 bp, Homo sapiens
  misc_feature: GYAE6OF02JGUGY.5.24.C02.1.454.CMB.1.raw
  modified_base (237)..(237): a, c, t, g, unknown or other
  misc_feature (237)..(237): n is a, c, g, or t
tcagatcagacacgcacgaccggtgctcgatttagtacagatcgttagggaaagggggggtcgtcgaggaggcgagcgctctcaggacgtcaccaccatggcctgggctctgctcctcctcaccctcctcactcagggcacagggtcctgggcccaggctgcccctgactcagcctccctccgcgtccgggtctccgtggacagtcagtccaccagtctccgtgcactcgcaaaccngcagtcgacgttggtgtcgaatctgtctcctggtaccaacaacacccgacaaacgacccccaaactccatactattttcggacggtccacgtacgccgaccctcgtacgggtccctggtactccggttcgttcctaccgttcgggtacctacccgtaaacggtttccgtaacggtaccctaaaccgtacccgggccccctttaccccggtacgtaacccccgtttccgtaccggtccgggtaccctccgtaaccggtcgtaccggaacggtacgtacggtaccgggtacgttacggttaactttaccgttaacgtcgtaccgtacggtaccttaccgtacgttactacggttacgaagggttccaaacggccttaccggaaacctccggttacccccgtaagttacgggttacgtaacccggttcggttaccgggggtacccgggggtaaaccctacgggttacccggtaaccggttaccccgggttaacccggtttaccggtaaccggtaacccggtacccggtaacccgggttccccggttaccccggttacccccccggg

SEQ ID NO: 237253 - DNA, 754 bp, Homo sapiens
  misc_feature: GYAE6OF02HSOB2.5.24.C02.1.454.CMB.1.raw
  modified_base (268)..(268): a, c, t, g, unknown or other
  misc_feature (268)..(268): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctctcactcagggcacagggtcctgggcccaggctgccctggactcagcctccctccgcgtccgggtctccgtggacagtcagtaccacctatctcctgacactcgaccaaccgagctaagtgaacgttggtggttacgaaagttntgtccttccgtaggttaaccaaaccgaaaccaccccgaacaaaaacgccccctaaactcaactctaattttcgacgttacacgtaacgccaccctacgaggggtcccctagacgtccgtctttcgtccgtcggtctaccgaaggttcctacgggacaaaccgtcccgggcccttcccgtagtaccccgtcgtccttcggggaccctaccgacggtaccggtggtaaggagtacggtacggtgtacggttaatttaacgttaactaggtaccgtacgtccttaacgaactagtacggacggtaagcgtaaccgacggacaaccgtaccgttaacccgtaagttaccggtagttaccggttaccggtttaccgggggaacccgggggtaaacccgtaacggtaccgtccgggtaacccgttaacccggttaccggtaaccgaacccggtaccctaaacgggttccccgtaccccgttaaccccccggg

SEQ ID NO: 237254 - DNA, 584 bp, Homo sapiens
  misc_feature: GYAE6OF02FUY09.5.24.C02.1.454.CMB.1.raw
  modified_base (342)..(342): a, c, t, g, unknown or other
  misc_feature (342)..(342): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacacgggtcctgggcccaggctgccctgactcagcctccctccgcgtccgggtctcctggacagtcagtcaccatctcctgcactgacaaccagcagtgtacgttgggtcggttacgaagttatgtctcctggtaccaacaacaccccgacaaacgccccaaactcatctattttagagtcactacgcgaccctcgacgggtccngatcgtcttctcgtgcctaccaagtctggacaacaccggtacctcccgtgtacccgttcctctcgggtcctccgacggtctaggacggtatcggacggctagtacttacttactcgctacgactcatactgacacggactacgcgacgtacacgtcccagtcgtacgtcgtcgtccggacggggtaccaacgtcgtacgaccgtccgtacgtccgacgtcccgaacgtccgtaccgtccccg

SEQ ID NO: 237255 - DNA, 603 bp, Homo sapiens
  misc_feature: GYAE6OF02FO32E.5.24.C02.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (391)..(391): a, c, t, g, unknown or other
  misc_feature (391)..(391): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtgttcgaagtntgtctcctggtaccaacaacaccccgacaaacgccccaaactcatctattttgagtcactacgcgacctgacgggtcctgactcgcttctctcggctcaagtctgacacacggcctcctgaccgtctcgtcggctccgnggctcgaggacgtgaggtctagtattactacgtgacacgtctacgattagcgacacggtcgagacagccgtacgtcccgtagttcgtacgtacgtttccggtaccggggaccgggggtaaccgtaaccggtccgtaccggtacccggttaccggttaacggttacccggtaaccggtacccggtaacggtcccgttaccggtacccccccgg

SEQ ID NO: 237256 - DNA, 688 bp, Homo sapiens
  misc_feature: GYAE6OF02HGGG7.5.24.C02.1.454.CMB.1.raw
  modified_base (534)..(534): a, c, t, g, unknown or other
  misc_feature (534)..(534): n is a, c, g, or t
tcagatcagacacgcacgaccggtgctcgatttagtacagatcgttaggggaaagggggggggtctcaggaggcagcgctctcaggacgtcaccaccatggcctgggctctgctcctcctcaccctcctcactcagggcacagggtcctgggcccaggctgccctgactcagcctccctcgcgtccgggtctcctggacagtcagtcaccatcctcctgcactcgaccaaccagcagtcggtacgttgggtggttacgaagttatgtctccgtacggtaccaacaaccacccgaacaaaccgacccccaaactcaacttcttagttttcggacgtccacgtaccgccgtaccctcggacggggtccctagtactccgtcttctcgtcggcctacgtaacgtcgtggacctaacgtaccggtccctaccgtacggtacccgttccgttccggtaccgggtccctccgggaacggtccgtacgggaacggtacgtagggacggtcttagtaacgttttaacgtacgtcgacgtacncttactattagtcggacgtacggacacgacgacgtaccgtaccgtaccctaggtcgtacgtaccggttccgggtccggggaccggggtaccgacgtaccggtccggtaccgttccgacggtccgaccggtaccgacggtcccgtcccgtccccg

SEQ ID NO: 237257 - DNA, 736 bp, Homo sapiens
  misc_feature: GYAE6OF02HSYON.5.24.C02.1.454.CMB.1.raw
  modified_base (214)..(214): a, c, t, g, unknown or other
  misc_feature (214)..(214): n is a, c, g, or t
  modified_base (261)..(261): a, c, t, g, unknown or other
  misc_feature (261)..(261): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacagggtcctgggcccaggctcgccctgactcacgcctccctccgcgtccgggtctccgtggacagtcagtcaccntcctcctgcactgaccaccagcagtgacggttggtggttacgaattntcgtctccgtaggtaccaacaaccacccgaacgaaacgacccccaactacactctagtttttacgacggtactactaccgccgtaccctcgtaccgggtcctgtactccgtcttctctcggaccttcgtaagtcctagacctaacgccgtacccgtacccgtcgtaccgtccgtcggtcggtccgtaccgaggtcgttgggaacggtgtagggtaccggtgttacgtaacgtttaacttacgttcgtacgtacggtacttaacaacttacgtacgtacgtacggactacggtaccaacggcccgtaacgttccccgtaagttcggtcgttaaccggttccgggtaccggggtaacccgggggaaccgttaacgggtacccggttaacccggttacccggtttaacggtaaccggttacccgggacccgtaacccccgggttagaccccccggttacccggtttaacccccccggg

SEQ ID NO: 237258 - DNA, 661 bp, Homo sapiens
  misc_feature: GYAE6OF02I7SXP.5.24.C02.1.454.CMB.1.raw
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctcgcgtccggtctccgtggacagtcagtcacctatcctcctgcactgacaaccagcagtgacgttggtggttacgaagttatgtctccgtaggtaaccaacaaccacccgaacaaaccgacccccaaatcaatacttattttagacgtcactacgccgtacctcgacgggtccctgactcgtcttctctcgctaccagtcacgaccaacgtccggcctaccgtgacccgttctcgtcgggcctcgacgtcgtaggacggagtggacggtctagtatttacgttacgtacgacctacgcttacattacgtgaccgacgcctaacgtcgaaccgtccgtacccgtaccgtagttacgtacgttaccgttaccggttcgggggaaccgggtaaccgtaacgtacccggttaccgtaccccggttacccggttaacggtacccgaaccggtaccccggtaaccggttcccgtacccccggttacccccgg

SEQ ID NO: 237259 - DNA, 628 bp, Homo sapiens
  misc_feature: GYAE6OF02GYO4D.5.24.C02.1.454.CMB.1.raw
  modified_base (253)..(253): a, c, t, g, unknown or other
  misc_feature (253)..(253): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctcctgcactgcaaccagcagtgacgttggtgtcgaagtntgtctctgtaccaacacacccgacaaacgccccaactcatctattttgacgtcacgtacgcgaccctcgacgggtccctgactcgtcttctcgtcgctaccagtctggaccaaccgtcggccctccgtcgacccgttctccgtcgggcctaccgaggtcgtaggacggagtggtagcgttagtatttacgtacgtgactacgtctatatgtcgacgacggtcacgtacgacgtacctaccgtacccgtagtcggttcgtacggttccgggttacggggaaccggggtaaccgtacggtccgtaccggtaaccccggttcggtaacgggtccctaaccggtaccccggtaacggtcccggtaccccgttcccccgg

SEQ ID NO: 237260 - DNA, 774 bp, Homo sapiens
  misc_feature: GYAE6OF02HOQ3A.5.24.C02.1.454.CMB.1.raw
  modified_base (183)..(183): a, c, t, g, unknown or other
  misc_feature (183)..(183): n is a, c, g, or t
tcagatcagacacgcacgaccggtgctcgatttagtacagatcgttagggaaagggggggggtctcagggaggcagcgctctcaggacgtcaccaccatggcctgggctctgctcctcctcaccctcctcactcgagggcacgagggtcctgggcccaggctcgccctgactcacgcctcccnccgcgtccgggtctccgtggactagtcacgtcaccatcctctcgacactcgaccaacagtacgtagtcggtacggttgggtggttacgaagttactgtccgtcgtacggtaaccaacaaccgacccgaacaaaccgaccccctaaactactacttacttacgttttacggacgtactaccgtacgccgtaccgtcggtaccgggtcccgtgtacgtccgtctttcgtcgtcgaccttacgaacgttcgtacggaacctaacggtacccggtcccgtaccgtaccgacccgttcgttccggtacgggtcctaccggtaacggtcgtaacggtaacggtagtacgggtacggtacgttaggttaactttacgttacgtaacggtaccgtacgtccttaacgtaacgtaagtcggtaacgacggtacgtaccggaacgtacggacccgtaaccgttaccgtagtacggttaacgtccggttaccgggggtaacggggtaccggggtaaactacgggtaccggtaccggtacccggttaaggtaccggacggtacccggtacccgggaaccggttcccgtacccggttacccggg

SEQ ID NO: 237261 - DNA, 635 bp, Homo sapiens
  misc_feature: GYAE6OF02GWGBR.5.24.C02.1.454.CMB.1.raw
  modified_base (228)..(228): a, c, t, g, unknown or other
  misc_feature (228)..(228): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagttatgtcctccgtcggtaaccaacaaccaccccgaacaaaccgacccccaaactccactactattttggacggtcactacgccgacccgtcgacgggtcctgactcgtcttctctggcctccgaagtcgtggaccacgccgccctcctcgaccgttcctcgtcggtacctccgacggtctaggacggtcgtaggcggtcgtgtaactttacttcgtgcagtctacatatgacgtacggaccagcacggctaccgtcccgtagtcgtacgtacgttccgggtacggggtaccgggggtaaccaacggttcccgtacgggttaacccgttaccggtacggtcccgaaccggtacccggacggttcccggacccgttaccccccggg

SEQ ID NO: 237262 - DNA, 815 bp, Homo sapiens
  misc_feature: GYAE6OF02GIMC9.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcgaggcacgagggtcctgggcccaggcctcgccctgactcacgccctccctccgcgtccgggtctccgtggacagtcacgtccaccatcctcctgacctacgtcgaccaaccgagctaggtggtacggtttggtacggtttaccgaagttacgtcgttcctaccgttacggtaacccaaccaaacccgaaccccgaaccaaaccgacccccctaaactacctattaccttagtttttacggacggttacctaaccgtaccggtacccgaaccccgttaccggtacggggttaccctacgtacgttccgttaccttcgtccgtacggtacccttaccgtacggttacgtccggtaccgaaccgtaccggtcccttacccgtacggtccccgttacgttccggtacggggtccctacccgggtacggtccggtaaggtacgggtaacgtacgggtacggttaccttaagggttaacttttacgtacggtcgtactacgtacctataacgtagtacgacggacggtacgacgaccgtacggccctaaccgtccctaggttcgtacttcggtacgggtaccggggtaccgggaaccggtaccggtaccgtaacccgggttccgttaaccggttaccggacccgggtaacgtaccccgggtaccggtacccggtccccgttaccccggg

SEQ ID NO: 237263 - DNA, 747 bp, Homo sapiens
  misc_feature: GYAE6OF02HZPGR.5.24.C02.1.454.CMB.1.raw
  modified_base (130)..(130): a, c, t, g, unknown or other
  misc_feature (130)..(130): n is a, c, g, or t
  modified_base (152)..(152): a, c, t, g, unknown or other
  misc_feature (152)..(152): n is a, c, g, or t
  modified_base (444)..(444): a, c, t, g, unknown or other
  misc_feature (444)..(444): n is a, c, g, or t
tcagatcagacacgcacgaccggtgctcgatttagtacagatcgttaggggaaagggggggtctcgaggaggcagcgctctcaggacgtcaccacatggcctggctctgctcctcctcgaccctcctacnctcgaggccacgacgggttccngggcccaggtctcgcccgtgacctcgacgcccttcccgtccggccgttcccgggtcctccgtaggaccagtccagtccactctcctccgtgcacgtcgaccaacacgcgaaggtccgtaggtttggtaggttaccgaaagttgtcgttaccgtcgttacggtaaccaaacgaacccgaaccccgaacgtaaaacccgaccccctaaatcgtaacctacgttagttttacggacgttacaaccgtaccggcctaacccgtaggtaccgggtcctacggactttaccgcttccncgtccggtactaccgaagtccgtagacctaaaccgccggtcctccgtaagtccgtcgtccgaccgggtctaccgaggtacctagggaacgtacggtacggccgggttatacggttaacgtttacgtttaacggccgtttacgaccgtaccgtaattaccgagtacgaacggaccggtacacgacgtaccgaccgtaaccgtcccgtagtaccggttcgaaccgttcgggccgggtacggaacgacgtaccgtacggtaccgtaccggtacgccgtacgccgtaacggccctcccgttacccgg

SEQ ID NO: 237264 - DNA, 625 bp, Homo sapiens
  misc_feature: GYAE6OF02FF2RT.5.24.C02.1.454.CMB.1.raw
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (255)..(255): a, c, t, g, unknown or other
  misc_feature (255)..(255): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctggcccaggctgccctgactcagccctcctccgcgtccggtctcctaggacagtcagtcaccatctcngcactgaccaacngcagtgtacggttggtaggtacgaagtntgtctcgtgtaaccaacaaccacccgaacaaccgacccccaatcatcttattttacgacgtactactaccgccgtacctcggacgggtccctagtacctccgtcttcctcgtcgcctactacgtcgtcgaccacgccggtcctcccgtacgtaccgtccgttccgtcggtcctaccggaggtcgtaggacggacgtaggacggtcgtaagttacttagtacgtcgacacgtcctataactggtacgacgacggagtacgccgtaacgtacctaccgtaccagtgtacgtacgtaccgggtcggacggtaccgagtccgtaacgaccgttacgtacgaccgtaccgaccgaccggtccgtcccgtaccccg

SEQ ID NO: 237265 - DNA, 570 bp, Homo sapiens
  misc_feature: GYAE6OF02HLAY5.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (436)..(436): a, c, t, g, unknown or other
  misc_feature (436)..(436): n is a, c, g, or t
  modified_base (455)..(455): a, c, t, g, unknown or other
  misc_feature (455)..(455): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctccgtggacagtcagtcaccatctcctgcactgcaaccngcagtgacgttggtcgttcgaagtntgtctccgtggtaaccaacaaccaccccgaacaaacgacccccaaactcactctattttgacgtcactacgcacctcgacgggtccctgactcgtcttctctgctcatcngcacncgcctcctgaccgtctcgtcggcctcgaggctgagagtgacgtctgtacttatactgcagctactatntcgacagcgacgacacgcnccgtcctagtcgtacgtacgttccggttcggggaccggggtaacaacgggtcgtacggtacccggtacgtaccggtacgaccggtaacccggtacggtcgtacccggtcccccgg

SEQ ID NO: 237266 - DNA, 716 bp, Homo sapiens
  misc_feature: GYAE6OF02FP3CY.5.24.C02.1.454.CMB.1.raw
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
  modified_base (346)..(346): a, c, t, g, unknown or other
  misc_feature (346)..(346): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccgggtctccgtggacagtcagtcaccatctcctgccactgccaaccngcagtgacgttggtgttcgaagtntgtctccgtgtaaccaacaaccaccccgaacaaaccgcccccaaactcatctattttcgacgtcactacgccgaccctcgacgggtcccngtactcgtcttctcgtcggtcctacctacgtctcggaccaacgaccgtccctccgtcgtaccccgttcgttccgtcgggtcctacccgaggtccgtaggacggtagtacgggacgtacgttacgtaatttacgttacgtcgtaccacgttaccttacgtaacttacgttcggaaccggtacggaccgaacggtaccgaacggtacccgtaacccgtccccgtaagttccggtaccgttaccggttccgggttacccgggggtaccggggtaaccgaaccggttcccggtaaccggttaaccccggtttaccggtaccggtaccgtaaccggtaccccggtaaccggtccccgttacccggtaccccccgg

SEQ ID NO: 237267 - DNA, 689 bp, Homo sapiens
  misc_feature: GYAE6OF02FFTJT.5.24.C02.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacgagggtcctgggcccaggctgccctgactcagccctcctccggcgtccgggtctcctggacagtcagtcaccatctcctgccatgcaaccngcagtgacgttggtgttcgaagtntgtctcctggtaccaacaaccacccgacaacgcccccaaactcatctatttttgagtcactacgcgacctcgacggggtcctgactccgtcttctcgttacggcttaccgaagtccgtacggtacaaaccgaccggtcctccccgtacgacccgttctccgttcggggcctccgtaacggtcctacgggtacggacgttacggacggtcgtacgttaacgtttaacgtacgttcgtacgacggtacctacgtaattacgtcgtaaccgacggactaacgggccaacgtacccgtaaccgttacccccgtagttacggtaccggttacgttaccgggttaccggggaacccggggggtaaccaacggtcccgtaaccggtacccgttacgttaccggacgtaaccggacccgtacggtcccgtcccggtacccccgg

SEQ ID NO: 237268 - DNA, 699 bp, Homo sapiens
  misc_feature: GYAE6OF02FFTSS.5.24.C02.1.454.CMB.1.raw
tcagatcagacacgcacgaccggtgctcgatttagtacagatcgttagggaagggggggtctcaggaggcagcgctctcaggacgtcaccaccatggcctgggctctgctcctctcaccctcctcactcaggcacaggtcctggcccaggctgccctgactcacgcctcctccgcgtccggtctccgtggactagtcagtcaccgatcctcctgcctatcgaccaaccgagccagttcgtacgttggtcgttacgagttatcgtctaccgtgtaaccaacaacctacccgacaaccgtacccaaactcactcgtattttagacgtactactacgccgtacctcggacggtcctagtacgtcgtacttctcgtacgctacgtacgtctcgacaacgtccggtcctaccgtcgtacccgtcgtccgacgtcctcgacgtcacgtacggagttcggacgtcttacgtacttaactcgtacgtacacgtctaaacgtgtacgtaccggtaacgtacggacgtccggtaacgaacgacccgttaccgtaacccgttagtacggttaccgttaccggtttacccgggttaccgggggaccgggggtaaaccaaccgggttccggtaaaccccggttaccggtaccggttaacggtaccgacccggttaaccggaacccgtccggttacccccgtttaacccccgg

SEQ ID NO: 237269 - DNA, 657 bp, Homo sapiens
  misc_feature: GYAE6OF02FIEB6.5.24.C02.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
  modified_base (268)..(268): a, c, t, g, unknown or other
  misc_feature (268)..(268): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccggtctcctggacngtcagtcacatctcctgcctactcgaccaaccngcaggttgtaaccggtttggtcggttacgaaagttntcgtctcctggtaaccaacaaccacccccgaactaaaccggccccccaaactccatctatttttcgagtacacgtacgcgacctcgacgggtccctgactcgacttctctgctcaagtctcggacaacgtacggccctccgtgacccgttctctccgggcctaccgaggtcctagtacgggaatggacggtctacggtaatttaacgttacttgctacgtctactatactcgactacggacctagccacgaccttacgtacccagttcgtacgtacgttcccggtacgggggtaccggggtaaacctacggccgttaaccggacccggttaccgttacgggtacccaacccggtaccccgtaacggtcccgttaccccggtccccccgg

SEQ ID NO: 237270 - DNA, 815 bp, Homo sapiens
  misc_feature: GYAE6OF02G49YM.5.24.C02.1.454.CMB.1.raw
  modified_base (201)..(201): a, c, t, g, unknown or other
  misc_feature (201)..(201): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccgggtctccgtggacngtcagtccacatcctcctgcactcgaccaaccagctaagtcggtacggtttgggtacggttacgaagttatcgttcctccgttcggtaacccaaaccaacccaaccccgaacaaacccgacccccaaaacgtccaacttaccttacgtttttacggacgttacctaaccgttaccgccgtacccgtcggacggggttccctaggtacgttccgtactttccttccgtcggtccttaccgaacgttccgacggaccaaccgtaccggtccctacccgtacgtacccgttcgtccggtccgggtcccgttaccggacggtaccgtacgggaacggtagtacgggtacggtacgttagttaacgtttacgtttaaccgtcgtaccgtacggtaccttacgtaacgttacgtaccggacggtaacgggtaccgtaggaccgtaacggtaccctaaccggttaacccctaggttccgtaccgttaccggttaccggggtcccgggggtaaccggggtaacctaacgggtcccgtaccggtaaccccggtttaccggtaaccgggttacccgaacccggtaaccccggtaaccggtccccggtaccccggttacccccgg

SEQ ID NO: 237271 - DNA, 630 bp, Homo sapiens
  misc_feature: GYAE6OF02FS5QI.5.24.C02.1.454.CMB.1.raw
  modified_base (254)..(254): a, c, t, g, unknown or other
  misc_feature (254)..(254): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgccactgccaaccagcagtgacgttggtgttcgaagtntgtctcctggtaccaacaaccacccgacaaacgaccccaaactcatctattttgagtcactacgccgaccctcgacgggtccctgactcgtcttctctgtctacagtcgcgacacacgcctcctcgacctctcgtcggcctccgacgcgtaggaggatggacgctagtatttacgttactcgatacgtctacgtatagtcgacgaggacgagtaccgacgtaccgtaccgtacccctagttcgtacgtacgttccggttaccgggggtacccggggggtaaccggtaacggtacccgttaccggtaccccgggttaccgttaccgggtacccgaaccggtaccccggtaccggtccccgtccccggtcccccccgg

SEQ ID NO: 237272 - DNA, 625 bp, Homo sapiens
  misc_feature: GYAE6OF02GOZPV.5.24.C02.1.454.CMB.1.raw
  modified_base (251)..(251): a, c, t, g, unknown or other
  misc_feature (251)..(251): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggcctgccctgactcagcctccctcgcgtccggtctcctggacagtcagtcaccatctcctgcactgcaaccagcagtgacgttggtgttcgaagtntgtctcctgtaccaacaacacccgacaacgacccccaactcatacattttgagtcactacgcaccctcgacggggtccctgactcgcttctcgtggcctccaagttcgtacggaccaaacgcggccctcccgtcgacccgttcctcgtcgggcctcgacggcgtagaggtagtcggaggcttaggtaactttacgttacgtggactagtccttacacttagtacgcgtaaggacgacgactcggaaacctccggtaccccagttacgttacgtcgttaccgggttccggggaccgggggaacaacggtccgtacggtacccggtaccggtacggtaccgaccggtacccgaggttccccgtccggttccccccg

SEQ ID NO: 237273 - DNA, 692 bp, Homo sapiens
  misc_feature: GYAE6OF02FYUAE.5.24.C02.1.454.CMB.1.raw
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (564)..(564): a, c, t, g, unknown or other
  misc_feature (564)..(564): n is a, c, g, or t
tcagatcagacacgcacgaccggtgctcgatttagtacagatcgttagggaaaggggggggtctcgaggaggcagcgctctcaggacgtcaccaccatggcctggctctgctcctcctcaccctcctcactcagggcacgaggtcctggcccaggctgccctgactcagccctccgtccgcgtccggtctccaggcagtcagtcaccntctcctgcactgactaacngctagtgacgttggcggttacgaagttacgtgtcctccgtaggtaccaaacaaccgtaaccccgaacaaaccgaccccaaactcgacctactacgttttacgacgtcaaccgttaccgcgaaccccgtcgtaccggggtcccttgaccttcggactttcctacgtaccgtcctaccgtaacgttcgtccggtaccaaaccgtacccggtaccctacccggttcgaaccccggttcctaccgggttacgccccgttaccgtacggtcgtacgacggacgtacggtacgcgttacgtatttacgtacgtagtacgtagaccttgactacgtcggaacgnggtacgacgtgacgtacgacgtaccacgtcgtaacgtggttaccacggggtcccgggaacgtaccggtacttcggtacccgttacggtttacgcggaaccgtacccggtacgtccgtcccgttacccg

SEQ ID NO: 237274 - DNA, 792 bp, Homo sapiens
  misc_feature: GYAE6OF02I1AJ3.5.24.C02.1.454.CMB.1.raw
  modified_base (242)..(242): a, c, t, g, unknown or other
  misc_feature (242)..(242): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcgaggcacgagggtcctgggcccaggctcgccctagactcacgcctccctccgcggtccgggtctccgtggacacgtcacgtcaccatcctcctgcacttcgaccaaccngtcgagtcgtacggttgggtacggttacgaagttcgtcgtcctaccgtacggtaaccaaaccaaccgaacccgaaacaaacccgaccccctaaactcctagttaccttagttttagaccggtacctacgtaccgaccgtaaccgtcggtaccggggtacctcggtactaccgttcttactccgtacggtacctacgtaacgtcgtacgaccgtaaccgtccggtcccttacccgttacgtccgttccgtcggttccgggtcccgtaccgacggtacgtacgggaaggtacgtacgggacggttcgttaacggtacgtttaacgtacgtcggtacacggttctaacgtacgtacgtcggtaacggcggacgaacgtcggtaaccgtccgtacgttacccgtaggttaccggttacgtaccggttaccggggttccgggggtaaccgggggtaaccctacgggtaccggtaacccgggttacgggttaaccgttacgggtaacccgaccgggttaacccgggacccggtaccccggttaccccggtcccggg

SEQ ID NO: 237275 - DNA, 1049 bp, Homo sapiens
  misc_feature: GYAE6OF02GI8V1.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctcccccgcgtccgggtccgtcctcgtacgacgtcgtacgtacgtacccaacctacttcccttccgtcgacctaccgtcgaacccaaaccgacgtaccgtaggtaccggttacgggttcgggttacgggttaacggtaaaggttgttccggttcccttccggttaccggtaaaacccaaaaccaaaccccccggaacccccgaaaaacgaaaccccccggaaacccccctaaactacctaaccgtacctttttaaggtttacggaaccgttaaccctaaccggtacccggaccccgtaccccgttacggggtaccccggttaccgtagtaccgtccgttccttcgtccggtccggttaccctaaccggtaacgtttccgggaccgaaacccgtaaaccccgggtacccgttcccccgttacccgtacccgggttaaccccgtttcccgttaccggggttcccgggtaccccgttaaccgggtaccgggttaccgggtacggggtaaaccgggttaggtaacgggggtaccggttacggttaaacgttttaaacgttttaaccgtttacggtacccggtaaccgttaccggttacccgttaatttaaaccggttaacggttccggaaaccggggtaaccggaaccggtacccggtaacgtaacccggtaacccgggttaaccccccgttaacccgtacggtttacggtaacccggtttaccgggttttcccgggggtaacccggggggggtacccggtaaacccgggtaaccggtcccggtttaaacccgggtaccccggtttaaccgggttaccggtaaccgggtaccccggaaaccccggggtacggttcccccggaccccccggtttcccccggg

SEQ ID NO: 237276 - DNA, 565 bp, Homo sapiens
  misc_feature: GYAE6OF02IQJEF.5.24.C02.1.454.CMB.1.raw
  modified_base (257)..(257): a, c, t, g, unknown or other
  misc_feature (257)..(257): n is a, c, g, or t
  modified_base (369)..(369): a, c, t, g, unknown or other
  misc_feature (369)..(369): n is a, c, g, or t
tcagatcagacacgcacgaccggtgctcgatttagtacagatcgttagggaaaggggggggtctcaggaggcagcgctctcaggacgtcaccaccatggcctgggctctgctccctcctcaccctcctcactcaggcacagggtcctgggcccaggctgccctgactcagccctccctccgcgtccgggtctcctggacagtcagtcaccatcctcctgcactgaccaaccagcagtgacgttggtggttcgaagtntgtctcctgtaccaacaaccacccgacaaacgccccaaactcatctattttgaggtcactacgcgaccctcagggtcctgatcgtcttctctggctccgaagtctggcaacncggcctcctcgaccgtctcgtcgggctccgaggctaggacggagtcgaggctgaatttacgttacgtgtacagtctcgactatgcgaggcagcgacgctaccgtcccagttcgtgtacgtcgtaccgggacggggacctaacggtcgtacggacccgtcgtacggtacaccgacccgacggtccgtccgtccccgg

SEQ ID NO: 237277 - DNA, 677 bp, Homo sapiens
  misc_feature: GYAE6OF02IMHOD.5.24.C02.1.454.CMB.1.raw
  modified_base (195)..(195): a, c, t, g, unknown or other
  misc_feature (195)..(195): n is a, c, g, or t
  modified_base (258)..(258): a, c, t, g, unknown or other
  misc_feature (258)..(258): n is a, c, g, or t
tcagatcagacacgcacgaccggtgctcgatttagtacagatcgttagggaaaggggggggtctcaggaggcaagcgctctcaggacgtcaccaccatggcctgggctctgctcctcctcaccctcctcactcaggcacaggtcctggcccaggctgccctgactcacgcctccctcgcgtccggtctcctgacngtcagtcaccatcctcctgcactcgccaaccagcagttcgacggtttggtggttacgaagttntcgttcctaccgtcggtaaccaaccaaccaccccgaacaacccgacccccaatcactacttagttttagacgtacactcgccacctcgacgggtccctgactcgtcttcgtcgtcgctacgacgttcacgacacgaccgtccctaccgtcgtacccgttcctcggtcggtcccgtacggacgtccgtaggacggtagtcggacggtcttagttacgtttaccgttacgtgaccgtacgtccttacgtaattacggcgacggtaggacgtacgacgaacgtcctaacccgtcccgtagtaccgttacgttcgggtaccggttacccgggggacggggtaacctaccggtacgttcccggtacccgttaacgtaccgggtaccaccggtaccccggaggtccccgtcccggttacccccgg

SEQ ID NO: 237278 - DNA, 632 bp, Homo sapiens
  misc_feature: GYAE6OF02HGW00.5.24.C02.1.454.CMB.1.raw
  modified_base (175)..(175): a, c, t, g, unknown or other
  misc_feature (175)..(175): n is a, c, g, or t
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctctcactcaggcacagggtcctgggcccaggctgccctgactcagcctcccncgcgtccgggtctcctggacagtcagtcacctatctcctgcactgcaaccngcagtgacgttggtggttcaagtntgtctcctggtaccaacaaccacccgacaaacgcccccaaactcatctattttgacgtcactcgcgacctcgagggtccctgactcgtcttctcgtcgctccaacgtctggaccaacaccggtcctccgtcgaccgtcgtcgtcgggtctcccgagggtcctaggacgggtactcggacggtcttaggtatttaacgttaccgtcggactcggtacctactaagttagtcggacgtagggtacacggacgaacgccgtaccgtaccctagttacgtacgtacgttccgggttacggggaccggggttaaccgacggtacgtaccgtacccggttacgtacggtacgaccggtacccgaacggtaccctcccggtacccccgg

SEQ ID NO: 237279 - DNA, 615 bp, Homo sapiens
  misc_feature: GYAE6OF02JGX6V.5.24.C02.1.454.CMB.1.raw
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
tcagatcagacacgcacgaccggtgctcgatttagtacagatcgttagggaaaggggggggtcgtcaggaggcagcgctctcaggacgtcaccaccatggcctgggctctgctcctcctcaccctcctcactcagggcacagggtcctgggcccaggctgccctgactcagccctccctccgcgtccggtctcctggacagtcagtcaccatctcctgcactgcaacngcagngacgttgtggtacagtatgtctcctggtaccacaacacccgacaaacgcccccaaatcatcatttttgaggtctactacgccgaccctcgacgggtccctagactccgctttctcgtcggtcctccaacgtctggtaccaacgaccggtccttcccgtacgtacccgtctccgtcgggcctccgaggcctagacggagtggacggtctgtatttagtactcgctaacgtctacagttatcgacgtacggcacgacgacgcctaaccgtccctagtgtacgattccggtccgggacgggggaaccctaacggtccgttaccggacccgttaccgtacggttacccaccggtacccggtaacggcccgttaccggtccccccgg

SEQ ID NO: 237280 - DNA, 693 bp, Homo sapiens
  misc_feature: GYAE6OF02JTSSZ.5.24.C02.1.454.CMB.1.raw
  modified_base (572)..(572): a, c, t, g, unknown or other
  misc_feature (572)..(572): n is a, c, g, or t
  modified_base (604)..(604): a, c, t, g, unknown or other
  misc_feature (604)..(604): n is a, c, g, or t
tcagatcagacacgcacgaccggtgctcgatttagtacagatcgttagggaaaggggggggtcgtcgaggaggcaggcgctctcaggacgtcgaccaccatggcctgggctctgctcctcctcaccctcctcacctcagggccacacgggtcctgggcccaggctgccctgacctcagcctcccgtccgcgtccgggtccttaccgtcgggacacgttccacggtccacctactcttcccgtgctaaccgtcaccaacccaggccaggtcgtaaccggttggtcggttaccgaattacgtcgttactccgtcggtaaccaacaacgaacccccgacgtaaaccacccccaaacttacactactagttttacgaacggtcctaacgtaccgccgtaccgtcgaccgggtccccgtagactccgtccgtcttcctcggtacctccgtaacgtccttcggacctaaccgacgggtaccctcgtacggtaccctacgtccgtccggggtcaccgtggactgggacgtactcgggtacgcgtgaacttacgttacgtacgcgacgtctcctagtacncgtagacgtcgacgtacacgcgtacaccgtancgacgtaatcggtcggtaccggggacctaagggcctacggaaccgtccgttacggacgccgtaacccgacggtaccggccgttaccccg

SEQ ID NO: 237281 - DNA, 649 bp, Homo sapiens
  misc_feature: GYAE6OF02IRX3N.5.24.C02.1.454.CMB.1.raw
  modified_base (479)..(479): a, c, t, g, unknown or other
  misc_feature (479)..(479): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctctcactcagggcacagggtcctgggcccaggctgccctgactcagcctccctccgcgtccgggtctcctggacagtcagtcaccatctcctgcactgccaaccagccagtgacgttggtgttcgaagtctgtctccgtcggtaccaaccaaccaccccgaacaaccgacccccaaactcactctattttgacggtcacctacggccgtaccctcggacgggttcccctgtacttccgtcttcctcgtcggtcctaccgacgttctcggacaacgccgtccctaccgtcgacccgtctcgcggtctaccgaggtcctaggacgcgtaggcgtctagtaattacgttactcgacgngtcctatagtacgtagcgacggacagcctacgaccgaccgttacccgtagtacgttacgtacgttccgggtaccggggtaccggggaccgtaacggtccgtaccggacccggttaccggtacggtacccggtaccgtacccggtaaccggtccgtcccccggtaccccgg

SEQ ID NO: 237282 - DNA, 676 bp, Homo sapiens
  misc_feature: GYAE6OF02JTDSV.5.24.C02.1.454.CMB.1.raw
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
  modified_base (497)..(497): a, c, t, g, unknown or other
  misc_feature (497)..(497): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgcccctgactcgacgccctccctccgcgtccgggtcctccgtggacagtcagtcacntctcctgcactgaccaaccngccagtgtacggttgggtcgttacgaagttatcgttctccgtaggttaacccaaactaacccgaccccgaacaaaaccgcccccctaaaactccaactactagtttttacggacggtacctaacgtaccgaccgaccctcggaccgggttccctgactccgtctttcctcgtcggcctcgtaagtcgcggtacaaccgaccgtccctacccgtgtacccgtctcgtacggctcccgtacggctaggacgtagtcggacggtntagtacgttaattcggagtctacgtctacgtatacgtcggaacgtcggacgtacgtacacggtacgtacccgtcccgtagttccgtataccggttcggttaccggggacggggtaactacgtcggtaccgaccgttacggtacggaccacggtacccacggtaccctcccggtaccccg

SEQ ID NO: 237283 - DNA, 671 bp, Homo sapiens
  misc_feature: GYAE6OF02GTUAP.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgaggtcctgggcccaggctgccctgactcagccctccctccgcgtccggtctcctggacagtcagtcaccatcctcctgcactgacaaccagcagtgacgttggtcggtacgaatatgtactcgtacggtaaccaaacaacccacccgaacaaaaccgaccccctaaaatctaagtacttagttttagacgtacaactaacgccaccgtcggacggtaccctaggatccgtcttactcgtacggtcctaacgagtcgtggaacctaacgcccggtcctcccgtagaacccgttcttacggccgtctccgacgtacgtagaggtacgtaggacgtcgtagtatttaacgtagtcgacgtacgtcttacgtatgtacgacgaagactacgacgacgtacgtaacgtaccgtagtacgtacgaggttaccggtaccggggtaacggggaaccttaacggtccggttaaccgcccggtttaaccgtacggtaccgtacccggaaccccgtaggttaccccgtcccggtaaccccgg

SEQ ID NO: 237284 - DNA, 772 bp, Homo sapiens
  misc_feature: GYAE6OF02JXFEM.5.24.C02.1.454.CMB.1.raw
  modified_base (612)..(612): a, c, t, g, unknown or other
  misc_feature (612)..(612): n is a, c, g, or t
  modified_base (635)..(635): a, c, t, g, unknown or other
  misc_feature (635)..(635): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcaggcacagggtcctgggcccaggctcgccctgacctcacgcccttcccgtccgcggtccgggttcctccgtgggaacctaggtacctacgtaccacctaacttcccttcctacggctaccgttcgacccgaaaccaggtacaacggttgtaccggtttgggttcgggttaccgtaaagttcgttcgtccgtaccgttacggtaacccaaactaacccgaacccgaaaccgaaacccaacccccaaactacctactcttagttttcgacgtacctacgtaccgccgtaccccgtaggtaccggggtaccctagtaccgtaccgtcctttccgtacggttaccggtcctaacgaaaccgtttccggtaacggaacctaaaccggtcccggtaccctccgtacgtcccgttaccgtcgcgggtaccctacggcgtacgttcgggacgtacgggtcgacgggtcttaggtaacttagttaccngtacgtacgtactactagtacgngaccgttagacgtacgacgtaacggctaccgtacccgtgtaacgtcgttacgtcgggttacgggaaccgggtccaacggtccgtaacgtaccggtaccgtaacggccgaacgacccgtcggtaccgtcccgtcccgg

SEQ ID NO: 237285 - DNA, 669 bp, Homo sapiens
  misc_feature: GYAE6OF02IMKRF.5.24.C02.1.454.CMB.1.raw
  modified_base (263)..(263): a, c, t, g, unknown or other
  misc_feature (263)..(263): n is a, c, g, or t
  modified_base (347)..(347): a, c, t, g, unknown or other
  misc_feature (347)..(347): n is a, c, g, or t
tcagatcagacacgcacgaccggtgctcgatttagtacagatcgttaggggaaaggggggggtctcaggaggcagcgctctcaggacgtcaccaccatggcctgggctctgctccctcctcaccctcctcactcgagggcacagggtcctgggcccaggctgccctgactcagccctccctccgcgtccggtctcctggacagtcagtccaccatcctcctgcactgaccaaccagcagtgtacgttgggtgttacgaagttntgtcctcgtcggtaaccaacaaccacccaacaaccgaccccaatcatctattttgagtctacaccgccgacctcgacgggtccngactccgtcttctcgtcgctaccgtacgtctacgaccaaccgccgtccctaccgtcgtacccgttcgttccggtcgggtccctcggacggtccgtaggaggtacgtgggacgttcgtagttaacgtttaacgttacgtcgtaccagttccttacgtagtacgtacgtacggacgtacgacgaccgacgtacctacccgtaacccgtgttaccggtactacggttcccgggtaacgggggaccggggtaacctacggccgttaccggtaccgttaccggtacgtaccggaccggtacccgaacggtcccgtacccgtccccgg

SEQ ID NO: 237286 - DNA, 699 bp, Homo sapiens
  misc_feature: GYAE6OF02G70XD.5.24.C02.1.454.CMB.1.raw
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
tcagatcagacacgcacgaccggtgctcgatttagtacagatcgttagggaaaggggggggtctcaggaggcagcgctctcaggacgtcaccaccatggcctgggctctgctcctcctccaccctcctcactcagggcacagggtcctgggcccaggctgccctgactcagcctccctccgcgtccgggtctcctggacagtcagtcaccatcctcctgcactgccaaccngcagtgtacggttgggtgttagaagttntgtctcgtaggtaaccaacaaccaccccgaacaaaccgacccccaaactcatcttagttttggacgtctacgtaccgccgtaccctcggacgggtccctagacttcgtccttctcgtcggtacctaccgacgttcgtacggacctaaccgaccggtcccttacccgtacgtacccgttccgtcggtaccgggtccctaccgtacggtccgtagggaacgggtacgtagggacggtacgttagttacgtttaacttacgtcgacgtacgtcctacgtaactacgtacgacgtacgggacacgcgtacgtactacccgttaccctaggttcgtacgttacgttccgggtcgggggtaacccggggacgtaacggtaccgtaccggtaccgttaccgacggtaccgaccggtacccggtacggtcccgtccccggtaccccgg

SEQ ID NO: 237287 - DNA, 613 bp, Homo sapiens
  misc_feature: GYAE6OF02FSDNH.5.24.C02.1.454.CMB.1.raw
  modified_base (203)..(203): a, c, t, g, unknown or other
  misc_feature (203)..(203): n is a, c, g, or t
  modified_base (354)..(354): a, c, t, g, unknown or other
  misc_feature (354)..(354): n is a, c, g, or t
  modified_base (525)..(525): a, c, t, g, unknown or other
  misc_feature (525)..(525): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcagggcacagggtcctcgggcccaggctgccctgacctcagccctccctccgcgtccgggtctcctggacngtcagtcaccatctcctgcactgaccaaccagcaggtgacggttggtggttacgaagtatcgtctcctggtaacccaaacaaccaccccgaacaaaccgacccccaaatcatctattttgacggtcacgtaccgcgaccctgacgggtccngactcgtcttctctcgctaccgacgtctcggacacgcgtccctccgtcgacccgtctccgtcgggtcctccgacggtcgtggacggagtcggacggtcttaggttaacttacttacgtgaccgtacgtctacatctcggacgtagcagctacgcgaccgtcccgagttcgngttcgtccgggtcgggaccggggtacacggtccgtacgttacccgtcggtacggccgtacccgaccggacgtcccgtacccgtccccg

SEQ ID NO: 237288 - DNA, 865 bp, Homo sapiens
  misc_feature: GYAE6OF02IY1RF.5.24.C02.1.454.CMB.1.raw
  modified_base (236)..(236): a, c, t, g, unknown or other
  misc_feature (236)..(236): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctctcactcgagggcacgagggtcctgggcccaggctgccctgactcagcctccctccgcgtccgggtctccgtggacagtcagtcaccatcctcctgcctactcgaccaaccngcgagtcggtacggtttgggtcggttacgaaggttagttcgtccttccgttacggtaacccaaaaccgtaacccgaacccccgaaaccaaaacccggtacccccccaaaaaccttcctaaactttaccgtttaacttttttacgggaacggttaccgtaaaccgttaccggacccgtaacccccggttacccggtaaccggggggtttcccccgttacggaacgtttcccggtcttttcccggttccgtcggggtaccctttacccgtaaacgtttccgtacggtaaccctaacccgtacccggtacccttacccccgtaccggtaacccccggtttccgttcccggttaccggggtaccctacccggggtacgggtaccgtttacggggaacgggtacggtacgggaggtaccgttagttaacgtttaacgttaccgtcggtaccttacgtcgttaccttaagtactcggacggacggtacgacgtcgaaggacccgtaccgttacccgtcgttagtacgtaccgttaccgggtccggggtaccggggtaacctacggtacggtccggtacccgttaccgtacggtaccggacccggaccggtaccggtcccgtaccccggtcccccg

SEQ ID NO: 237289 - DNA, 630 bp, Homo sapiens
  misc_feature: GYAE6OF02F3ICR.5.24.C02.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
  modified_base (484)..(484): a, c, t, g, unknown or other
  misc_feature (484)..(484): n is a, c, g, or t
tcagatcagacacgcacgaccggtgctcgatttagtacagatcgttagggaaaggggggggtctcaggaggcagcgctctcaggacgtcaccaccatggcctgggctctgcctcctcctcaccctcctcactcgagggcacgagggtcctgggcccagggctcgccctgactcagccctccctcgccgtcggtctcgtggacngtcagtcaccntcctctgcactgccaaccngcagtgacgttggttggtacgaagtntcgtctcctggtaaccaacaaccacccgaacaaaccacccccaaactcatcttagttttgacggtctacgtacgccgaccctcgacgggtcctgctacgtcttcctcgttcgcctaccaagtcgtacggaccaacgccggtccctccgtacgtccctaccgtccgtaccgggcctccgaggactcggtaagtagtcggacggtccgtagttaacttactacgttnccggtaatctagtacttacgcgacacggctagcacgtccgtaaccgcctagtcgtacgtagttccgggtacgggaccgggaacacggtacgtaccgtaccgtcgtacggtacgaccgtacccggacggtccctacccggtccccgg

SEQ ID NO: 237290 - DNA, 725 bp, Homo sapiens
  misc_feature: GYAE6OF02HWMDX.5.24.C02.1.454.CMB.1.raw
  modified_base (140)..(140): a, c, t, g, unknown or other
  misc_feature (140)..(140): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcaggcacgngggtcctgggcccaggctgccctagactcacgcctcccgtcgcgttccggtctccgtggacagtcagtcactatcctcgtgcactgaccaaaccagcaagttgacgttgggtgttacgaagtatcggtctcgtaggtaaccaacaaccacccgaacaaacgacccccaaactcactctattttgacgtactacacgccaccgtcgacgggtcctagctacgcttacgctggacctaccgtaagttcgtacgcaaacaccggtaccgtcctacgtaccggtccttcggtcgggaccttaccggacggtcgtacggacgggtaacgtaggacggtacttacgtaacgtttactttacgtagtaaccgtacggtaccttaaccgaatttacgtacggaacgtacggacgtacgtacgaccgtaacgaccgttcccgacgttacgtagtaaccgtttccgggttacgggggtaacccggggtaacggtaacccgtcccggtaaacccggtttacccggtaaccggttaacggtacccgtaacccggtaacccggaaaccggttccccgtaacccgtttacccccccggg

SEQ ID NO: 237291 - DNA, 873 bp, Homo sapiens
  misc_feature: GYAE6OF02FRAYV.5.24.C02.1.454.CMB.1.raw
tcagatcagacacgcacgaccggtgctcgatttagtacagatcgttaggggaaaggggggggtctcaggaggcagcgctctcaggacgtcaccaccatggcctggctctgctcctcctcaccctcctcactcagggcacagggtcctgggcccaggctgccctgactcagccctcctccgcggtccggtctccgtggactagtcacgtccaccatcctcctgccacgtcgaccaaacccgagcctaggtcgtaccggttgggttcgggttacgtaagttacgttcgttccgttacccgttagggttaaaccccaaaccgaaacccccaaacccccgtaaacccaaaaaccccggtaacccccccctaaaaaccttacctaacctttaccgtttaacgtttttttacggaacggttacccgtaacccgttaacccggtaccccggtaaccccgttaccgggtaaccggggttccccttagtaccgtccgttcctttccgttcgtaccggtacctacccgtaacgtccgttacgggacctaaaccggcccgtaccctccccgtacgtacccgttccgttccggtcggacccgtccggacgggtcgtacggtacggacggttacggacggtccgttaagttaacgtttacgttacgttcgacgtaacgttccttaacgtaacttcggtaccggaacgtaccggaccgtacggtaccgaaccggacccgttaaccgtacccccgtaggttacgttacggtccggtttacgggtccgggggaacccgggggtactaaccggtcccgggtaacgttaccccggtacggtaccggaccgtaccggtacccggaccggtacccgttaccccggtcccccgg

SEQ ID NO: 237292 - DNA, 874 bp, Homo sapiens
  misc_feature: GYAE6OF02JJSN9.5.24.C02.1.454.CMB.1.raw
  modified_base (237)..(237): a, c, t, g, unknown or other
  misc_feature (237)..(237): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctcctccggcgtccgggtctccgtggacacgtcagtccaccgatcctcctgccactcgaccaaccngcagttcgtacggttggtaggttacgaagttatcgtccttccgtacggtaacctaaccaaaccgtaacccccgaacgtaaaacccgaccccccgtaaaactccgaacttaccgttaacgtttttacggaacggttaccgtaaccgttacccggaccgtaacccccgttaccgggaaacccggggggtttcccctacggtaaccgtttcccggtaccgttttcccgtccggttccggttacccgttaacccggtaaaccggtttccgttaccgggtaacctaaaccccggtacccgggttccccctttaccccggtaccgttaccccggttacccgttacccggtacgggttcccgtacccggtaacgggttccgtaacgggtaaccgggttacggtacggtaacgggtcgttaacggttaaacctttacggttaaccgttcggaacctaccggttaccttaacgttaacttacgtacgtcggaacggttaccacggtacgtacgaccgttacctaccccgtagtcgtaccgtacgttaccgggtaccggggacccgggtaacaaccggttacgtacccgtacccggtacgtacggtaccgcccgtacccggaaccgttcccgtaccccgtaccccgg

SEQ ID NO: 237293 - DNA, 709 bp, Homo sapiens
  misc_feature: GYAE6OF02F10YB.5.24.C02.1.454.CMB.1.raw
  modified_base (202)..(202): a, c, t, g, unknown or other
  misc_feature (202)..(202): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctggccctgactcagcctccctcgcgtccgggtctaccgtggacngtcagtcaccatctctgcactgccaacagcagtgacggttggtcggttacgaagtctgtctccgtaggtaccaacaaccaacccgaacaaaccgaccccaaacgtcactacttattttacggacgtcactacgccgtaccgtcggacgggtcctagtacgtcgtccttctcgtcgtcctacgtacgtcgtacggactaacgaccggtcctacccgtagtacccgttctacggtccggtccgtccgtacgtcgtacggaggtacgtaggacggtacgttacgtaatttaacgttaacgtggactacgttactacgttaacgtacgtacgggaacctacgggacgacgtacgacggtacccgtaccgtacccgttagtcggttacgaccgggttttcgggaaccgggggtaccggggtaaaccgtacggtccgggttaaccgtcccggtttaaccggtcggtaaccggtaacccggacccggtaacggtcccgtcccggttacccccgg

SEQ ID NO: 237294 - DNA, 725 bp, Homo sapiens
  misc_feature: GYAE6OF02HHBMI.5.24.C02.1.454.CMB.1.raw
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccgggtctccgtggacagtcacgtcaccatcctcctncactgaccaacngcagtcgtacggttgggtaggttacgaagttagtcgtcctcctacggtaaccaacaaccaccccgaactaaacccgacccccaaactctattacttagttttaggacggttacaccgtaccgaccgtaccccgtcggacgggttaccagtacgtccgttaccttcctcgtcggtacctaccgtaagttccgtacgaccgtaaaccgccgtcccttacccgtcgtacccgttcgtcgtccgggtcctaccgaggtcccgtaggaacgacgtacggtacggtactaacgttacgtttaacgttcgtacgtaacgtcggtacctattaactacggtacggacgacggtaccgacgtagacccggtacctaccgtaccccgtgttcggtaacgtcgttaccggggtcggggaccgggtaactaccggtcgtaccggtaccggttacggtaccggacctacccggtaccgtaccggttccccgacccggtaccccgg

SEQ ID NO: 237295 - DNA, 701 bp, Homo sapiens
  misc_feature: GYAE6OF02FVXBI.5.24.C02.1.454.CMB.1.raw
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
  modified_base (276)..(276): a, c, t, g, unknown or other
  misc_feature (276)..(276): n is a, c, g, or t
tcagatcagacacgcacgaccggtgctcgatttagtacagatcgttaggggaaaggggggggggtctcaggaggcagcgctctcaggacgtcaccaccatggcctgggctctgctcctcctcaccctcctcactcagggcacgagggtcctgggcccaggctgccctgactcccagccctccctcgcgtccgggtctcctggacagtcagtcaaccntcctcctgccactcgaccaaccgngccagtggtaccggttgggttagggttacgaagtntgtcctcctagggtacccaaaccaaccaaccccgaacgaaaccgacccccaaaactcctactacttacgtttttaggacggtacaaccgtaaccgtaccgacccgtacgtaacggggtcccttagactccggtctttcctcgtcgcctacaagtctcggacaaccgaccgtcccgtcctacggtacccgtctcggtacgggtccctacggcggtacgtagggacgggtatacggggtaggccgttaggttaactttactaccgtgtaccgagttaccactaatcgtacggacgtagggccaggtcgacgtcccgtaccgccgtagtcgtagtaccgttcgggtccggggaaccggggactaacggccggtccggaccgtacggttcggtacctaacggcccggaacggtccgaccccggtcccgg

SEQ ID NO: 237296 - DNA, 576 bp, Homo sapiens
  misc_feature: GYAE6OF02FI25O.5.24.C02.1.454.CMB.1.raw
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (257)..(257): a, c, t, g, unknown or other
  misc_feature (257)..(257): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagccctccctcgcgtccgggtctcctggacagtcagtccaccatctccngccactgcaaccngcagttcgacgtttggtggttcaagttntgtctcctggtaccaacaacaccccgacaaacgcccccaaactcatcatttttgaggtcactacgcgaccctcacggggtccctgactcgcttctctggctcatctgcaacncggcctcctcgaccgtctcncggctcnggcngagntgcgngtgtattatactgcagctcgatacgtacgcgtaggccaaggcgacgtcgaccgtccccaattcggacgttacgtccggttcgggaccgggggtacctaacggcgtaccggtaacccgttccgtaacggtccgaccggacccggaacggtcccgtaccgtacccccgg

SEQ ID NO: 237297 - DNA, 630 bp, Homo sapiens
  misc_feature: GYAE6OF02I5S9L.5.24.C02.1.454.CMB.1.raw
  modified_base (200)..(200): a, c, t, g, unknown or other
  misc_feature (200)..(200): n is a, c, g, or t
  modified_base (398)..(398): a, c, t, g, unknown or other
  misc_feature (398)..(398): n is a, c, g, or t
  modified_base (446)..(446): a, c, t, g, unknown or other
  misc_feature (446)..(446): n is a, c, g, or t
  modified_base (474)..(474): a, c, t, g, unknown or other
  misc_feature (474)..(474): n is a, c, g, or t
  modified_base (490)..(490): a, c, t, g, unknown or other
  misc_feature (490)..(490): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacngtcagtcaccatctcctgcactgacaaccagcaggtgacgttgggtcggttacgtaatacgtgtccttccgtacggtacccaaaccaacccaaccccgaacaaaaccgacccccaaactcaacttacttaattttcggacgtcctactacgccgacctcgacgggtcctgtactcgtcttctcgtcggctacgagtcnggacacgcgcctccgtcgaccgttctcgtcggcctcgcgcgtagaggntggcggtctagttattacttacgtcganacgtctactattacgngcgacgtcacggactacgaccgtaccgtacctagttcgtgttaccggtccgggttacggggccggggtaaccgtacgcggtccgtacccgtaccggttacggccgtaaccgaccccggtacgtcccgtcccggtccccgg

SEQ ID NO: 237298 - DNA, 958 bp, Homo sapiens
  misc_feature: GYAE6OF02H2H9Q.5.24.C02.1.454.CMB.1.raw
  modified_base (205)..(205): a, c, t, g, unknown or other
  misc_feature (205)..(205): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcaggcaccgagggtcctgggcccaggtcctgccctgactcacgccctccctccgcgtccgggtctccgtggacncgtctacgtccacctatcctctgcctacgtacgaccaaaccagtaccgtaaggttacggtaaccggttttgggtacgggttaccgtaaaggttacgttcgttaccgttaccgttaccgggtaacccaaaaccgtaaccccgaacccccgtaaaccgaaaaccccgtacccccctaaaactactaaacttacctttacggttttttaccggaacggttaccgtaaccgtaacccggtaccgtaacccccggtacgggttaacccggggtttaccccttacggaaccgttccgttaaccgtttcccgttcgtaccggttaccctaaccggttaaaccggttccttaacggggaacccttaaaccccggtacccggtaccccgtttacccgtaacggtccccgtttacccgttccggtaaccggggttaccccttacgggtacggtaccggtttacgggaaacgggttacgtaacggggaacggtttacttaacgggtaaacttttaaccgtttaaccgtcgggtaacctaaccggttccttaaacttaacggtagttaccgacggaccgtaccggttaaccgacggtaacgacccggttaaccctcccgtatacggtaccgttacggtttcccgggaacgggggttacccgggaaacgtaacccggttcggtaacccgggttaaccccgttacggtaacgggtaccgtaacccgggtaccccggtaacgggttccccgttaccccgttccccggg

SEQ ID NO: 237299 - DNA, 876 bp, Homo sapiens
  misc_feature: GYAE6OF02J3H0A.5.24.C02.1.454.CMB.1.raw
  modified_base (249)..(249): a, c, t, g, unknown or other
  misc_feature (249)..(249): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggcctcgcccctgacctcacgtccctcccgtccgcgtcccgggtctccgtggactagtccagtccaccatcctcctgcctactcgaccaaccgngctaggtcgtacggttggtacggttacgaagttcgtcgtacctccgtacgtaacccaaccaaccgaaccccgaacgaaaccccgtaccccctaaactcgtaacttccttagttttacggacgtacctaacgtccggacccgtacccgtcgggtaacccgggttccctaggtacccttccggtcctttccgtccggtaccggtaccgtaccgtaaccggtccgttaccggaacctaaacccggtcccggttacccttaccggtaccgtaccccgtttcgtaccggttcgggcccgttaccggaacggttccgaacggttacggtaacggttccggacggttacgttaacggtttaactttaacccgtcggttacgacccggttacttaccgtagttaacgttaggtcccggaaacgtcgaccgtaccggtaaccgtacccgttaaccgttacccgtaccgttaggttacccggttagttaccccgggttacggggttaccccgggggtaaaccgtaccggttacctaacgggtttacccccccggttagttaaccccggttaacggttaccccgacccggtaaaccggtcccccgggttaaccccgttcccccggtttaacccccggg

SEQ ID NO: 237300 - DNA, 635 bp, Homo sapiens
  misc_feature: GYAE6OF02FIAMA.5.24.C02.1.454.CMB.1.raw
  modified_base (196)..(196): a, c, t, g, unknown or other
  misc_feature (196)..(196): n is a, c, g, or t
  modified_base (229)..(229): a, c, t, g, unknown or other
  misc_feature (229)..(229): n is a, c, g, or t
  modified_base (260)..(260): a, c, t, g, unknown or other
  misc_feature (260)..(260): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctctcactcagggcacagggtcctgggcccaggctgccctgactcagccctcctcgcgtccggtctcctggacngtcagtcaccatctcctgccactgaccaaaccngctagtgtacggttggtcggttacgaaagtntcgtctcctggtaccaacaaccaccccgacaaacgccccaaactcatctattttgagtcactacgccgacctcgacgggtcctgtactccgtcttctctcggctccgaagtctcggacaactacggcctccgtacgacccgttcgtcgtacgggcctaccgtagtccttaggaggactggaggtctgtaacttaacttacgtacggactacgtcctacgtaattacgtacggacgtaacggacacggtagtaccgacctacggtacccctagttggacgttaacgttccgtacggggtaccggggaaacaccggtaccgtaccgtacccgtacggtaccggtacaccggtaccgaacgtccgtacgtccccccgg

SEQ ID NO: 237301 - DNA, 651 bp, Homo sapiens
  misc_feature: GYAE6OF02I1W4D.5.24.C02.1.454.CMB.1.raw
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
  modified_base (500)..(500): a, c, t, g, unknown or other
  misc_feature (500)..(500): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacgagggtcctgggcccaggctcgccctgactcagcctccctccgcgtccgggtctcctggacagtcagtccaccatcctcctgcactcgaccaaccagcagtcgtacggttggtggttacgaagttatgtccttccgtacggtaacccaaacaaccacccccgaacgaaaacccgacccccaaactcacttacttagttttcggacggttcaccgtaccgccgacccgtcggaccgggtcctgactctcgttctcgtcgtctacagtcgtcggaccacgccgcctccgtcgaccgtctcgtcgcctcgagtcgtaggaggtntaggngtntagtaatttacgtactgacgactctataatntagccgtagacagacctacgtaccgaccgtaccagttcgtctaccggttccggtaacgggggacccggggtaacacggtccgttaccggtacccggtaccgtaacggtccggaacccggtccggaaccgttcccgtaccccgtaccccggg

SEQ ID NO: 237302 - DNA, 672 bp, Homo sapiens
  misc_feature: GYAE6OF02JSOY2.5.24.C02.1.454.CMB.1.raw
  modified_base (200)..(200): a, c, t, g, unknown or other
  misc_feature (200)..(200): n is a, c, g, or t
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
  modified_base (508)..(508): a, c, t, g, unknown or other
  misc_feature (508)..(508): n is a, c, g, or t
  modified_base (662)..(662): a, c, t, g, unknown or other
  misc_feature (662)..(662): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcaggcacgagggtcctgggcccaggcctgccctagactcagcctccctccgcgtccggtctccgtggacngtccagtcacatccncctgacactgaccaaccgagccgaagtgacggtttggnggttacgaagttgtcgtctccgtacggtaacctaacgaaccaccccgaacaaaccgaccccctaaactcacttacgtatttttacggacgttacacgtaccgccgtacccgtacgtacgggtccctagtacgttccgtcctttaccgtcgttcggtaccctaccgtaacgttaccacggtaccaaaccgtaccggtcctaccgtacgtcccgtcgttaccgtcgggtcctaccgaggtccgtaggaacggtacgngtaacggcgtagtacttactagacgtcacgtctacgtatatcgacgtacggctaacgtacgcgtcctaaccgtccgattacgccgttagttccggacggtaccggggactacgtcgtaccgtaccgtcgtacggtcgaccgtaccacggtaccncccgtacccg

SEQ ID NO: 237303 - DNA, 880 bp, Homo sapiens
  misc_feature: GYAE6OF02HAK5E.5.24.C02.1.454.CMB.1.raw
  modified_base (699)..(699): a, c, t, g, unknown or other
  misc_feature (699)..(699): n is a, c, g, or t
tcagatcagacacgcacgaccggtgctcgatttagtacagatcgttagggaaaggggggggtctcaggaggcagcgctctcaggacgtcaccacatggcctgggctctgctcctcctcaccctctacactcagggcacgagggtcctgggcccaggctgccctgactcagcctcctccgcgtccggtctaccgtggacacgtcacgtccacacttcctccgtgctacgtccgaccaaaccccgagtccgaaggttcggtaacggtttgggttacgggttaaccggtaaagttcgttcggttacccttccgttaccggtaaaccctaaaaccaaaccccgaaccccccgtaaaacaaaaaccccgacccccctaaaacttccgtaacttaacctttagtttttacggtaacggttacctaaccgttacccggacccgtaaccccgttaccgggtaccggggttacccgttggtaacgttcccgttacgtttccgtccgtcggaccttaaccgtaacgttaccggtcggaacctaacccgcccggtaccctttcccgtaccgtcccgtttacgtcggtacgggtccctaccggaggccgttacggagggttaacgcggtaacggttcttaagttacgttttaaaccgttcgaccgtaccggtagtaccctagttaacgtagtccgggtacgaaccgggtanaaccggtactaaccggtacccgttaaaccgggttcccttagggttacgtttacgggttaacgttcccggggggttaacgggggacccgggaacgttaacgggcccgttaaaccgggcgtttacccggtaacgaaccggttaaccgggcccctaacgggtccccgttacccgggtaccccgg

SEQ ID NO: 237304 - DNA, 800 bp, Homo sapiens
  misc_feature: GYAE6OF02HX6EH.5.24.C02.1.454.CMB.1.raw
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcaggcacagggtcctgggcccaggctgccctgactcagcctccctccgcgtccggtctcctggacngtcagtcaccatctcctgcactgaccaaccngctagtcgtacgttggtgttacgaagttatgtctccgtaggtaaccaactaaccaccccgaacaaaccgacccccaaactacactactatttttcgacgtcactacgcctaccctcgacgggtccctagactcgtcttcctcgtcgtcctaccgtagtctcggacaaccgccggtccctcccgtcgtacccgttccgttaccgtcgggtccctaccgacggtccgtacgggaacggtacgtacggacggtacgttacggtaacttttaaccgtttaaccgttacggtaccgtaccgttcttaacgttaactacgttaccggacgtaacggtaccgaacggtacctaaccgggtaccctaacccggttacccccgttaaggttaccggttaccgttaaccgggtttcccgggttacccgggggggaacccggggggtaaacccggttaaaccgggttacccggttacccgggttaacccccgggttaccggttaacccggggtacccggtaaaccccgggtacccccgggtaaccgggtccccccggttacccccgggttaaccccccccggg

SEQ ID NO: 237305 - DNA, 658 bp, Homo sapiens
  misc_feature: GYAE6OF02FJ8PE.5.24.C02.1.454.CMB.1.raw
  modified_base (206)..(206): a, c, t, g, unknown or other
  misc_feature (206)..(206): n is a, c, g, or t
  modified_base (241)..(241): a, c, t, g, unknown or other
  misc_feature (241)..(241): n is a, c, g, or t
  modified_base (258)..(258): a, c, t, g, unknown or other
  misc_feature (258)..(258): n is a, c, g, or t
  modified_base (359)..(359): a, c, t, g, unknown or other
  misc_feature (359)..(359): n is a, c, g, or t
  modified_base (422)..(422): a, c, t, g, unknown or other
  misc_feature (422)..(422): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgcccctgacctcacgccctcccgtccgcgtcccgggtctccgtggacngtcagtcaccatcctcctagccactgaccaaaccngcaggtgacggtttggnggttacgaagttgtgtcctccgtaggtaccaacaccaccccgaacaaccgacccccaaatctactctattttgagtcactacgcgaccctcgacgggtccngactcgtccttctcgtcggcctacgagtctcgacgaacgaccgtccctccgtacgccccgttntcgtcggccctccgaggtcgtaggtaggacgtagggacgtccgtagtaacgtttacgttacacggtccgtacgtctaaccgtagtacgtacggtacgacggtacgttaccgacgtacgtaccgaccgttcccgaagttacgtcggtaccgttcgggtacgggaccgggtaactacggccgtaccggtacccgtacggtacgtccgaacggtcccgacggtacctcccgtaccccgg

SEQ ID NO: 237306 - DNA, 700 bp, Homo sapiens
  misc_feature: GYAE6OF02IOT13.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctcgcgtccggtctcctggacagtcagtcaccatcctcctgcactgaccaaccagctagtgtacgttggtggttacgaagtatgtctctggtaccaacaaccaccccgacaaacgacccccaaactcactactagttttcgacgtactacgtacgccgaccctcgacgggtccctagactcgtccttctcgtcggcctccgtaagtcgtcggacctaacgaccggcccttacccgtacggcccgttcctccggtaccgggtccctaccggtacgggtcctagggaacggtagtcggacggtcgtagttaacgtttacttccgtagtcgtacgtacgtacctaagtacttacggacgtacggacgtaccggactacggacccgtaccgtaccccgtgttaacgtcgttaaccggttccggggttaccgggggaccgggggtaaacctaccggtacgttaccggtacccggtaccgttaccgggacgacccgtaacccggtacggtcccgtccccggttacccccgg

SEQ ID NO: 237307 - DNA, 619 bp, Homo sapiens
  misc_feature: GYAE6OF02GCVE1.5.24.C02.1.454.CMB.1.raw
  modified_base (199)..(199): a, c, t, g, unknown or other
  misc_feature (199)..(199): n is a, c, g, or t
  modified_base (254)..(254): a, c, t, g, unknown or other
  misc_feature (254)..(254): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacngtccagtccaccatctcctgccactgcaaccagcagtgacgttggtgttcaagtntgtctcctggtaaccaacaaccaccccgaacaaaccgacccccaaactcatctattttgagtcactacgcgaccctgacgggtccctgactcgcttctctggctccaagtctggaccaacgaccggccctccctgaccgttctcgtcggcctccgagctggacgtagtgaacggtctagtatttattactgtacacgccttagacttagtcgacgtaggaccaggcgaacgaccgtaccgtccctaaggttcgtagttccgttaccggttacgggggaccgggggtaacctaacggccgttaccggacccgtacgttacggtaccgacccggtaacccgaacggttcccgtacccggtcccccgg

SEQ ID NO: 237308 - DNA, 629 bp, Homo sapiens
  misc_feature: GYAE6OF02HYBG9.5.24.C02.1.454.CMB.1.raw
  modified_base (198)..(198): a, c, t, g, unknown or other
  misc_feature (198)..(198): n is a, c, g, or t
  modified_base (230)..(230): a, c, t, g, unknown or other
  misc_feature (230)..(230): n is a, c, g, or t
  modified_base (408)..(408): a, c, t, g, unknown or other
  misc_feature (408)..(408): n is a, c, g, or t
  modified_base (473)..(473): a, c, t, g, unknown or other
  misc_feature (473)..(473): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctcgcgtccgggtctcctggacngtcagtccaccatcctcctgcactgccaaccngcaggtgacgtttgggtggttcgaaagttgtgtctccgtacggtaccaacaaccaccccgacaaacgacccccaaactcaattctattttgacggtacactaccgccgaccctcgtacggggtccctagacttccgctttctcgtggcctaccaagtctggccaactccgccttcccncgtcctccgtcgtcgggtctccgagcgtgaggcgtggagtctagtatttacgttacgtcgcgtanctactactagtcgacgacgtcgacgcgacgtaccgaccgtcccgaggtcgtacggttaccgttcgggttaccggggccggggtaaccgaacgtcgtaccggtaacccgtccgtacggtaccgaccggtaacccggacgtccgtcccgtacccccgg

SEQ ID NO: 237309 - DNA, 637 bp, Homo sapiens
  misc_feature: GYAE6OF02FYFR5.5.24.C02.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcagggcacagggtcctgggcccaggctgccctgactcagcctcctccgcgtccggtctcctggacagtcagtcaccatctcctgcactgccaaccngcagtgacgttggtggttcaagtntgtctcctggtaaccaacaaccaccccgaacaaaccgacccccaaactcactctattttgacgtcactaccgccgacctcgacgggtcctgactcgcttctcgtgcctacgaacgtctcgacctaacgaccggtccctccgtacgacccgttcgtccgtcgggcctccgaggtctaggacgtacgtaggacggtcgtagtacttagtacgtgcgtacgtctcgtaatagtcgacgacggacgtacgacacgtaccgtaccgtaccctagttgtacgtaccgttccgggttacgggggaccggggtaaaccgaggttcccggtaacggtacccgttccgtacggttaccgtaaccggacccgtaacggtcccgtccggtacccccg

SEQ ID NO: 237310 - DNA, 677 bp, Homo sapiens
  misc_feature: GYAE6OF02F4X7O.5.24.C02.1.454.CMB.1.raw
  modified_base (232)..(232): a, c, t, g, unknown or other
  misc_feature (232)..(232): n is a, c, g, or t
  modified_base (261)..(261): a, c, t, g, unknown or other
  misc_feature (261)..(261): n is a, c, g, or t
  modified_base (329)..(329): a, c, t, g, unknown or other
  misc_feature (329)..(329): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (403)..(403): a, c, t, g, unknown or other
  misc_feature (403)..(403): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctccgcgtccgggtctccgtggacagtcagtcaccatcctcctgcactgaccaacngcagtgtacgtttggtggttacgaagttntgtctccgtacggtaaccaaacaaccacccgaacaaacccgacccccaaactctatcttagttttcgngtcacgtacgccaccgtacgacgggtcctgtactccgtcttcncgtcgctacagtcncgacacgccgtcctccncgtaccctcgtcgtcggctccgngtcngagntgagntagtatacgtcngacngtctactacgtagtcgacgtacggacacggacgtaccgaccgttaccgttacccctaggtttaccggtacgtttcccggttaccggggttacccgggggaaacccggggttaaccgtaaaccgggttcccggtaaccccggtacccggtttaccggtaaccggtcccggtaaaccggtaccccggtaaccggttcccccggttacccccggtaccccccggg

SEQ ID NO: 237311 - DNA, 707 bp, Homo sapiens
  misc_feature: GYAE6OF02FQEY7.5.24.C02.1.454.CMB.1.raw
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (229)..(229): a, c, t, g, unknown or other
  misc_feature (229)..(229): n is a, c, g, or t
  modified_base (263)..(263): a, c, t, g, unknown or other
  misc_feature (263)..(263): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctcaccctcctcactcgagggcacgagggtcctgggcccagggctgccctgactcagcctcctcgcgtccggtctcnggacagtcagtcacntctcngctacgtgcaaccgngctagtcgtacggtttgggtaggttacgaagttntcgtctccgtaggtaccaaacgaacctaacccgacaaaccgacccccaacgtctactacttagttttcggacgttccacgtaccgcgtaccccgtcgaccgggtcctagtactccgtcttccgtcgtcgtcctacgtagtcgtacggactaaccgacgcctaccgtacgtacccgttcgtcggtaccgggtctaccggacggtcgtacggacggtaacgttcggacggttccgtacgttaacgtttaacgtacgttcgcgtacgttctacgtacttagtcggtacgaccgggtacacggtacgtaccggtaccttacccggtaacctgggttacgtacgttaccggttccggtaccggggaccgggggtaccaacgtccggttaacggtaccctcggtacggttccgaacccggtaccggtaccgtccggtcccgttaccccgg

SEQ ID NO: 237312 - DNA, 888 bp, Homo sapiens
  misc_feature: GYAE6OF02HUT9H.5.24.C02.1.454.CMB.1.raw
  modified_base (277)..(277): a, c, t, g, unknown or other
  misc_feature (277)..(277): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcaggcacagggtcctgggcccaggctcgccctgacctcacgccctccctccgcgtccgggtctccgtaggacagtcagtccaccatcctcctgcctacgtcgaccaaccagactaggtgtaccggttgggtcggttacgaagttntcgtaccttccgtacggtaacccaaacctaaaccccgaacccccgaaacgaaaaccccgacccccctaaaactaccaacgttaacctttacgtttttacggaacgttacctaaaccggttaaccggaccccgtaacccggtacccgggtaaccgggggttccccttacggtacgttccgttaccgttaccgttccggttaccggtcccttaaccggtaaggtttcccgtaacgggaacccttaaacccgggtcccggtaccccttaccccgtaccggttcccttaccgggttcgttcccggggtaccctaccggaccgggtccgtagggtacggtaggtcgggtacgtacgttacgttaactttaaccggttacgaacggttaccgtccgtaacgttaacgttaaccgtacggtacgtaccggacggaccgtacgcccggactaacccggttaccgtaaccccgttagtcggttaccgtccgggtttccgggggaaccccgggggtaacccggggtactacccgggttaaccggtacccggttaacccggtcggtaacccggttcgaacccggtaacccggtacccggtcccggttaccccggtcccccgg

SEQ ID NO: 237313 - DNA, 678 bp, Homo sapiens
  misc_feature: GYAE6OF02JFC93.5.24.C02.1.454.CMB.1.raw
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (260)..(260): a, c, t, g, unknown or other
  misc_feature (260)..(260): n is a, c, g, or t
  modified_base (351)..(351): a, c, t, g, unknown or other
  misc_feature (351)..(351): n is a, c, g, or t
  modified_base (525)..(525): a, c, t, g, unknown or other
  misc_feature (525)..(525): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacgagggtcctgggcccaggctcgccctgactcagccctccctccgcgtccggtctcctggacagtcagtccaccatcctccgtncactcgacaaccngcagtgtacggttggtgtacgatntgtctctgtaccaacaaccacccgaacaaaccgacccccaatcactcttagttttacgacgtcactaccgccgtacctcggtacggtcccngtacgtccgtctttccgtcgttcggcccttaccggaacgtttcgtaccggaccaaaccggcccgtcccgttaccctaccggtacccttccggttcccgtcgggtccctaccggacggtcgtagggacgtaagtgacggttctagttactttactacgtcggtactacggtctanagttacgacggtcgacgacgacggtaccacgtccgtaacccttccgggattcggacgttccgtcggggtaccggggaccgggtaacgaccgtcggtaccgtaccgtccggttacggaccaccgggtaccgtaccggtccctccccgtaccccg

SEQ ID NO: 237314 - DNA, 805 bp, Homo sapiens
  misc_feature: GYAE6OF02JQLOG.5.24.C02.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcacgggcacgagggtcctggcccaggctgccctgactcacgcctcctccgcgtccggtcctcgnggacngtcacgtcacnctctctgcacngaccaaccngcatcggcgttggtcgtacaagttctgtctccgtgtaaccaaccaaccgacccaacgaaccgaacccctaactctactactacgttttagacgtaccgtacctaccgaccgtacccgtaccggtacggttacccgtacgtacgtcccgttacttccgttacgtaccggtcctaccgtacgtacgtaccggtaacctaaccggtcccggttaccctacccgttaccgtaacccggtttacccgtacccggttcccgggacccgttaacgggtaccgttccggtaagggtacggtaccccgttaaggggtacgtacgttaacgtttaaacgtttagttaccggtacgtcggtaacgttcctaacgttaacgtacgtaccggtaacggacggtaccctaacggccgtaaccgtcccggtaaccgtacccgtacggttccgttaacgtccgggttaccggggtaacggggtacccggggtaaccaacggtttccccggaacccgggttacccggttacggttacccggaaccggtcccgtaaaccgggttaccgtaccccgtcccccggttacccggg

SEQ ID NO: 237315 - DNA, 926 bp, Homo sapiens
  misc_feature: GYAE6OF02IOMLQ.5.24.C02.1.454.CMB.1.raw
  modified_base (147)..(147): a, c, t, g, unknown or other
  misc_feature (147)..(147): n is a, c, g, or t
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
tcagatcagacacgcacgaccggtgctcgatttagtacagatcgttagggaaaggggggggtctcaggaggcagcgctctcaggacgtcaccaccatggcctggctctgctccctcctcaccctcctcactcaggcacgagggtccngggcccaggctcgccctgacctcagccctccctccgcggtccggtctccgtggacagtcagtccacctatcctccngctacgtcgaccaaaccgngacctaggtggtaccggtttggtacgggttacgaaagttcgttcgttaccttaccgttacggtaacccaaaacctaaaccccgaaccccgaaaccgaaaaccccgacccccctaaaaacttcctaacttacgtttaacgtttttacggaaccggttacctaacccggtaccggtacccgtaaccccgttaccggaaccgggggtttcccctaggtaaccgttccgttcctttacccgttaccgtcggtaacccgttaccgtaaaacgtttcccgtacggaaccctaaaccggtacccgggtaccccttccccgtaacgtaccccgttccgttaccggttccgggtaccctaccggtacgggtccctacgggtaacgggtaacgttacgggtacggtaccgttagttaacgtttttaaaccgtccggtttgaccgttaacggtccttaaccgtaaacgttaccggtggaccggtaacggtaccgtagggaacccaaggtaccccgtacccgttaaccccttaggttaccggttaaggttaccggtttaccccggggtacgggggtacccgggggaaccttaaccggggttccgttacccgggtaaccccggttttacgggtaaccggtaccgggtaacccgtaaccccgggtaacgggttaccccgttaccccgggtacccccgg

SEQ ID NO: 237316 - DNA, 587 bp, Homo sapiens
  misc_feature: GYAE6OF02FRS8C.5.24.C02.1.454.CMB.1.raw
  modified_base (258)..(258): a, c, t, g, unknown or other
  misc_feature (258)..(258): n is a, c, g, or t
  modified_base (321)..(321): a, c, t, g, unknown or other
  misc_feature (321)..(321): n is a, c, g, or t
  modified_base (426)..(426): a, c, t, g, unknown or other
  misc_feature (426)..(426): n is a, c, g, or t
tcagatcagacacgcacgaccggtgctcgatttagtacagatcgttaggggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctccgtggacagtcagtcaccatctcctgccactgccaaccagcagtgacggttggtggttcgaagtntgtctcctggtaccaacaaccaccccgacaacgcccccaaactcatctattttgagtcactancgaccctcgacgggtccctgactcgtcttctctgcctaccaagtccgtcggcaaaccaccggtccctccctagacccgttctcgtcggcctccaggctagaaggntggaggctagacttactactcgcacgctcatactgacacggtacagacacgactacgtccctatcgtacgtagttccgttacgggacgggggaccaacggtccgtacgtaccgttacctaggtaccgtaaccgtacccgaacggccctaccggtcccccgg

SEQ ID NO: 237317 - DNA, 213 bp, Homo sapiens
  misc_feature: GYAE6OF02HRHUP.5.24.C02.1.454.CMB.1.raw
  modified_base (199)..(199): a, c, t, g, unknown or other
  misc_feature (199)..(199): n is a, c, g, or t
  modified_base (212)..(213): a, c, t, g, unknown or other
  misc_feature (212)..(213): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagccctccctcgcgtccgggtctcctggacngtcagtcacactnn

SEQ ID NO: 237318 - DNA, 707 bp, Homo sapiens
  misc_feature: GYAE6OF02HSPYI.5.24.C02.1.454.CMB.1.raw
  modified_base (269)..(269): a, c, t, g, unknown or other
  misc_feature (269)..(269): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcacgccctccctccgcgtccgggtctccgtggacagtcagtccaccatcctccgtgcacctcgaccaaccagctaggtcgtacggttggtgttacgaagtntcgttctcgtacgtaaccaacaaccacccgaacaaaccgaccccaatcatacttagttttacgacgtacacgtaccgccgtaccctcggtacgggtcctagacttcgtccttcgtcgtcgtcctacgaacgttcgtacggaccaaccggtacccggtcccttacccgtacgtacccgttcgttccggtccgggtccttacccgaggtaccgtagggtacggtacgtacgggacggtacttgtaactttacgttacgtacgactacgtacttacgtaatacgtcgtacgtacggaccgacgtacgacggtcctaccgtaccctagtcggttacgtacgttaccgggtaccggggaccgggtaaccgaccgtcggtacccgtaccgttaccggtaccgaccgtacccgtaccggaccggttcccgtacccggtaccccgg

SEQ ID NO: 237319 - DNA, 789 bp, Homo sapiens
  misc_feature: GYAE6OF02HDSOD.5.24.C02.1.454.CMB.1.raw
  modified_base (230)..(230): a, c, t, g, unknown or other
  misc_feature (230)..(230): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcacatcctcctgcactgctaaccgncagtgacgttggtggttcgaatatgtctccgtggtaccaactaaccaccccgaacaaacgcccccaaaagtccaatctattttagacgtacactaccgcgacctcgacggggtccctgacttcgactttctctggacctccgaaacgttctacgggtactaaaccgaccggtaccccttccccgtcgtaacccgttcctccgtacggggtcctacccgtaacgggtccgtacggagggtacgtacgggacgggtaccgtagggttaacttttaacgttaaccgtaggtacccggtaacgtcccgtttaacgacgtttaaattcgggaaccgtacggggtaaccgtacgggaaccctaagggttacccgtaacccggtttacccccgaagtttacgggtacgttaaaccgttccgggttttacccgggggaacccggggggggttaacctaaaccggggtcccgtaaccggggtaacccccgttttacccggttaacgggttacccgtaaccgtaaccccgggtaaaccggtccccggtacccggttaaccccccccggg

SEQ ID NO: 237320 - DNA, 663 bp, Homo sapiens
  misc_feature: GYAE6OF02F4YDS.5.24.C02.1.454.CMB.1.raw
  modified_base (229)..(229): a, c, t, g, unknown or other
  misc_feature (229)..(229): n is a, c, g, or t
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcgagggcacgagggtcctgggcccaggcctcgccctgactcagccctccctccgcgtccggtctcctggcagtcagtcacatctcctgcactgacaacngcngtgacgttggtgtnagtntgtctcctgtaccaacaaccacccgaacaacgaccccaaactcatctatttttacgaggttccacgtaccgccgacccgtcgtacggggtccctgactcgtccttctcgtcgtcctaccgaacgttcgtacggcaaaccgccggtcccttcccgtcgtacccgttccgtacgtcgggtacctccgaggtcctaggaacgggtctaggacggcgttagtaagtttactacgtggacctcgaccgtactaacgttacgtcgaccgtacggaccgtagacgaccgtacgaccgttccctagttaacgtcgtaccgtaccgggttaccggggtaacccggggaactaaccggaccgtaccggtacccgttacggaaccgttcaacccgggaccaccggtcccgtcccggtaccccgg

SEQ ID NO: 237321 - DNA, 760 bp, Homo sapiens
  misc_feature: GYAE6OF02FWK08.5.24.C02.1.454.CMB.1.raw
  modified_base (631)..(631): a, c, t, g, unknown or other
  misc_feature (631)..(631): n is a, c, g, or t
tcagatcagacacgcacgaccggtgctcgatttagtacagatcgttagggaaaggggggggtctcaggaggcagcgctctcaggacgtcaccaccatggcctggctctgctcctcctccaccctctcactcagggcacgagggtcctgggcccaggctgccctgactcagtccctcctccggccgtccgggtcctccgtggacagtcagtccacctatcctcctgcctacgtcgaccaacctgacaggttggtacggttgggtcggttagaacgttgtcgtcctccgtaggtaacccaaacgtaacccaccccgaacaaacccgtaccccaaactctactcttaattttcggacgtcctaacgtaccgacgtaacctacggacggggttccctagaccgttcgtccttccgtcgacggttcctaccgaagttccggtacgactaaccgaccggttcctcccgtcgtacccgttcctacggtccgggactccggtacggcgttacggacggtacggtcggaaggtcccgtaagttacttaaccgttacgcgtaaccggtacttaccttacgtaacgttacggtcggtaacggtcgtacgaacgtacgtaaccgaccgttaccgttaacccgngtttacggacgttccggttaccgggtacccggggaccgggtaacttacgggtccggtaccggtacccggttggaaccggtacccgtaacccggacggtaacccggttccccgaccccgggttaccccgg

SEQ ID NO: 237322 - DNA, 1043 bp, Homo sapiens
  misc_feature: GYAE6OF02FOV5Q.5.24.C02.1.454.CMB.1.raw
tcagatcagacacgcacgaccggtgctcgatttagtacagatcgttagggaaagggggggggtctcaggaggcagcgctctcaggacgtcaccaccatggcctgggctctgctcctcctcaccctctcactcgagggtcacgagggtcctgggcccaggtcctcgtccctgtaccgtaccacggtcccttcccctccggaccggttccccgggtcttcccgagggtaacctacggttccgaacgtcccaaccctaagtcccttcgtcggacctacgtcgacctaaaccccgagaccgtaaggtcggttaaccggttggggttacgggttaacgtaaacggttgttaccgtccgttacccgttaacgggttaaacccctaaaaccgtaaacccccggtaaacccccgtaaaaccgtaaaacccccggtaaaccccccctaaaacccggttaccttaaaccgttaccgttttaaaccggttttttaacgggaacggttaacccgtaacccggttaacccgggaccccggtaaccccggttaccgggtaccgggtttaccccgtaacgggttaacccgttccggttaaccgtttccggtaccggttccggtacccgttaacccggtaacggttccgtaaccgggaacccttaaaccgggtaccccgtacccgttccccgttaaccgggtaaccccgttccggttaccggtccgggtacccctacggggtaccggtcgtacggggtaaccggttacggtacgggtaacgggttacccgttacggtttaaccgttaaaccggttaccgtaccggttaaacgggtcctttacccttaaagggttaccgtaacggtacggtacccgtaagggtaaccctaccgggtacgaaccgttaacccgttacccgggtacctagtttaccggacgtttaaccggggttccgggtacggggaacccggggtaactacggtacccggtaccggtacccggttaccgtacggtacccgtaccggaccggtaaccggtcccgttaaccccgggtccccgg

SEQ ID NO: 237323 - DNA, 881 bp, Homo sapiens
  misc_feature: GYAE6OF02FP06A.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcacatctcctgccactgacaaccagcgagtggtacggtttggtggttacgaagttagtgttctcccgttaggtaacccaaccaaccgaacccccgaacaaaacccgaccccccaaaactccgtaacttactttaacgttttttacggaacggttaccgtaaccgtaacccggtacccgtacccccgttaccgggtaaccggggggttccccttaacggtaacgttccccgggttaccttttacccgttccggttccgggtaccctttaaccccggaacggtttcccgtacgggaccctaaaacccggtacccgtcccccttaccccgttaccgggtaccccgttccgttaccggttcggggtccccttaccgggacgggtacgttaggggtaaacggtacggttacgggtaacgggtacctttaggttaactttttaacttaaccggttctaccgtaccggttaccttaaccgtacgttacgtaccggtacggtaacgggccgtaacggaccgtacggaccgttacccggtacccctagggttcgtaacggtaccgtttaccggggttacggggacccggggaaccgtacgggttacccgttaccgggtacccgtaccggtttacggacccggtacccggtaacccggaaccggttcccgtacccggttcccccgg

SEQ ID NO: 237324 - DNA, 811 bp, Homo sapiens
  misc_feature: GYAE6OF02IFJ6U.5.24.C02.1.454.CMB.1.raw
  modified_base (142)..(142): a, c, t, g, unknown or other
  misc_feature (142)..(142): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcgagggcacngggtcctgggcccaggctcgccctgactcacgccctcctccgcgtcccgggttctccgtggacagtcagtaccaccgtatcctcctgacctactcgacctaaccgagtccgaggtcggtacggtttgggtaggttacgaaggttacgttcgttaccgttacgtaccggtaaccaaaccgaaaccccgtaaccccggaaacctaaaacccgaacccccctaaagtacctaactttacgtttaagtttttacgggaacggttaccctaacgtaaccggtaccgtaacccgtacggtaccggggttacctcggtacttccgtaccttccgttaccgtcggtaccctaccgtaaggttaccgtaccggaccaaaccgtacccggtccccttaccgtaccgtaccgttccgtaccggtcgggtacccgttccgacggtccgtaagggtacgtgtacggacggtagtacggttaactttacgtttacgacggtacgttacacgttaacttatacggtaacgccgtagaccgacgtaacaccggtacccgtaaccgtaccgtaggttacgtaccgttacggttccggggaacggggtaaccggaacggtaacgtcccggcggttaaccgtcgtacggttacacccgggacgtaccggttcccacccggttccccgg

SEQ ID NO: 237325 - DNA, 786 bp, Homo sapiens
  misc_feature: GYAE6OF02I0UIB.5.24.C02.1.454.CMB.1.raw
  modified_base (177)..(177): a, c, t, g, unknown or other
  misc_feature (177)..(177): n is a, c, g, or t
  modified_base (187)..(187): a, c, t, g, unknown or other
  misc_feature (187)..(187): n is a, c, g, or t
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
  modified_base (511)..(511): a, c, t, g, unknown or other
  misc_feature (511)..(511): n is a, c, g, or t
tcagatcagacacgcacgaccggtgctcgatttagtacagatcgttagggaaaggggggggtctcaggaggcagcgctctcaggacgtcaccaccagtggcctgggctctgctcctcctcaccctcctccactcgagggcacgacgggtcctcgggcccaggctcgccctgacctcncgccctcccncggccgtccggtctcccgtaggacncggtctacgtcctaaccntcctccgtacgccaactcgaccaaccgacgccgaaggttcgtaacggttgggtacgttacggaacgttatcggttcgttaccgtaacggtaaccaaaccgaaaccctacccggaacaaacccgaaccccctaatccgtacttaccttagttttacgacgtactaccgtaccaccggtacctcgaccgggtccgacgacgttccgtcttcctacgtaccgtcgtacctaacggtcgaccggactacgaccgtcaccgtcgaccgtcgtacgtcgacctccgnggtccgtaggaggtacgtacgcgttagtacgttacgtacttcgacgttcgaccgtacttaacgacgttaacgtcgccgtaaagccggaccgtagtacccggacgttaaccccgtacgttacgttacgtgggttaaccccgtttgggggaaccccggggtaaaccggccgggttaaccggaccgttaacccccgggttccggttaaccggaccccggtttcggaaccccggtaaacccgggtcccggttaccccgggtaccccggttaaccccggg

SEQ ID NO: 237326 - DNA, 812 bp, Homo sapiens
  misc_feature: GYAE6OF02G8MAY.5.24.C02.1.454.CMB.1.raw
  modified_base (237)..(237): a, c, t, g, unknown or other
  misc_feature (237)..(237): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgacgggtcctgggcccaggctcgccctgactcacgcctccctccgcgtccgggtctccgtggacagtcacgtcactatctcctgcactcgaccaaccngcagtcgtacgttgggtggttacgaagttgtgttcctccgtacggtaacctaaccaaccacccgaacaaccgacccccaactcactactagttttacgacggtaccacgtaccgccgtacccgtcgtaccgggtcctcgactcgtcctttctcgtcggtacctaccgacgtcgtacggacctaacgacccgtcccgtcccgtccggtacccgttccgtaccggtccgggtccctaccggtacgggtaccgttacgggaagggtacgtacgggtacggtcttacgttacttttaacgttacctcggtaacccgtacgtaccgttactaagttcgtacgggtaccgtacggtaccgacggtaccgtaccgtaccggttaacccggttaccctacggtttacggttaccggttaccggttacccgggggtacccgggggggtaacccggggtaacccggtaacggttaccccggggttacccgggttaacccccgggttaccggttaccgggtaacccggtacccgggtaaccccggttaacccggttcccgggttaccccccgttacccccccgggg

SEQ ID NO: 237327 - DNA, 740 bp, Homo sapiens
  misc_feature: GYAE6OF02JYI1M.5.24.C02.1.454.CMB.1.raw
  modified_base (122)..(122): a, c, t, g, unknown or other
  misc_feature (122)..(122): n is a, c, g, or t
  modified_base (226)..(226): a, c, t, g, unknown or other
  misc_feature (226)..(226): n is a, c, g, or t
tcagatcagacacgcacgaccggtgctcgatttagtacagatcgttagggaaagggggggtctcaggagcagcgctctcaggacgtcaccaccatggcctggctctgctcctctcacctctnactcaggcacacgggtcctggcccaggctcgccctgacctcagcctccgtccgcgtccggtctcctggacacgtcacgtcaccatctcctgcgactgaccaacngcctagtcgtacggttggtcgttacgaagtagtcgtcctccgtggtaccaacaccgtaacccgacgtaaacgacccccaaacgtcaacgtctattttacggcgtacaccgtaaccggtccacccgtacggtaccggggtaccccaggttaacctccgtaacgttcctcgtacgcttacccgaaggttctaccggacaacccgtaccgggccctccgtacgaccgttcgtcgacggttcccacggacgtcgtacgtagggtactacggacggtacctaggttaacccgtaatttccggtcggtaaaccgtcggtccttaacgaaacgtttaacggccgggttaacgacgggttaccaacggtacccgtaagggtacctaaacccgtcccgttataacgttaccggtccggttccggtaccggggttacggggaaccctaaggtccgttaaccggttccgtaccggtacgggttacccacggtacccggtaacggtccgtaccccggttacccggg

SEQ ID NO: 237328 - DNA, 752 bp, Homo sapiens
  misc_feature: GYAE6OF02H5CZR.5.24.C02.1.454.CMB.1.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
  modified_base (447)..(447): a, c, t, g, unknown or other
  misc_feature (447)..(447): n is a, c, g, or t
  modified_base (522)..(522): a, c, t, g, unknown or other
  misc_feature (522)..(522): n is a, c, g, or t
  modified_base (543)..(543): a, c, t, g, unknown or other
  misc_feature (543)..(543): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcacccctcctcactcgagggcaccagggtcctgggcccaggctcgccctgactcacgccttcccgccgcgtccgggtctcctggaccngtcagtcacctntcctcngctctcgaccaaccngcgagtcggtacggtttgggtggttaccgtaagttcgtcgttctccggtaacggtaacccaaaccgaaaccccaaccccgaaacgaaaacccctacccccctaaactccgtaaacttcttaacgtttttacggacggtttaccacgtaccggacccgtcccgtacggtccggggttacctgacgtcgttctctacgtcgctaccgtntcgtaggaccacgtaccgtcctccgtacgtccgtcgtcgtaccggcctacgcggctacggaggtgtaggcggttntaggtttaactagttaacgcnccgtacgtacttacacgtaggttccgacggcggtaacgacgtacggaccggtctacccgttaccggtaagttcgggttaaccgtccgttaccggggtaccccgggggtaagggtacccctaagggtcccgttaacccggttaccgggtaccgttaacgggaccgtaaccccggttaccggtaacggtcccccggtacccgttcccccgg

SEQ ID NO: 237329 - DNA, 593 bp, Homo sapiens
  misc_feature: GYAE6OF02ISMNT.5.24.C02.1.454.CMB.1.raw
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (252)..(252): a, c, t, g, unknown or other
  misc_feature (252)..(252): n is a, c, g, or t
  modified_base (333)..(333): a, c, t, g, unknown or other
  misc_feature (333)..(333): n is a, c, g, or t
  modified_base (403)..(403): a, c, t, g, unknown or other
  misc_feature (403)..(403): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctctcactcgagggcacgagggtcctgggcccaggctgccctgactcagtcctccctccgcgtccgggtctcctggacagtcagtcacntctcngcnctgcacagcagtcgacgttggtgttcgaagtntgtctctgtaccaacaaccaccacaacgaccccaatcattactattttgacggtacacgtacgcctacctcgacgggtccngactctcttctctcgctactacgtctcgacacgacgtccctccgtcgtaccgtcgttcgtcgggctccgnggtcgtagacggtgtaggagtcgtagtacgtttcgtatcgactatcgtctatacgtcgcaggcgacgagacgaccgtacccgtaccgtgacgttacgtaccggttcggtaccggggacggggaacctacggtaccgtcggtaccgttaccgttacgacggtacccgacggacgtcccgtacccgtcccgg

SEQ ID NO: 237330 - DNA, 752 bp, Homo sapiens
  misc_feature: GYAE6OF02G0TBS.5.24.C02.1.454.CMB.1.raw
  modified_base (251)..(251): a, c, t, g, unknown or other
  misc_feature (251)..(251): n is a, c, g, or t
  modified_base (554)..(554): a, c, t, g, unknown or other
  misc_feature (554)..(554): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcgagggcacgagggtcctgggcccaggctgccctgactcaggcccttccccgtccggcggtccgggtcctccgtggaccagtcagtccacctatcctccgtgccactcgaccaaaccgngacctaggtcggtacggtttgggttacggttacgaaagttcttacggttcctaccggttacggtaacccaaaaccaaccccgaacccccgaaacaaaccccgaccccctaaaatccgtaacttacctttagttttacggacgttacaaccgttaccgaccgtaccccgtcgggtcgggtaccctaggtacttaccgtctttacctcggtcggtacctaccgtagtacgttaccggactaaaccgtacccggtccctaccgtacggtacccttcgtccgtcgggcctacgacggtctaggagtntcgtacggtcgtagtacttaacgtacgtacgactacgtactactaagtacgtagaccgtggactacgtacaaccgtcgaccgttaccgtagtcggttctacggttcgggtaccggggaccgggtaacgacgttcggtaccggttaccgtacgtaccggtaccgaacggtaccggtaaccgtcccgtcccggtacccgg

SEQ ID NO: 237331 - DNA, 674 bp, Homo sapiens
  misc_feature: GYAE6OF02G0YC5.5.24.C02.1.454.CMB.1.raw
  modified_base (180)..(180): a, c, t, g, unknown or other
  misc_feature (180)..(180): n is a, c, g, or t
  modified_base (220)..(220): a, c, t, g, unknown or other
  misc_feature (220)..(220): n is a, c, g, or t
  modified_base (267)..(267): a, c, t, g, unknown or other
  misc_feature (267)..(267): n is a, c, g, or t
  modified_base (385)..(385): a, c, t, g, unknown or other
  misc_feature (385)..(385): n is a, c, g, or t
  modified_base (519)..(519): a, c, t, g, unknown or other
  misc_feature (519)..(519): n is a, c, g, or t
  modified_base (545)..(545): a, c, t, g, unknown or other
  misc_feature (545)..(545): n is a, c, g, or t
tcagatcagacacgcacgaccggtgctcgatttagtacagatcgttagggaaaggggggggtctcaggaggcagcgctctcaggacgtcaccaccatgcctgggctctgctcctcctcaccctcctcactcgaggcacgaggtcctgggcccaggctgccctagacctcacgccctcccnccgcggtaccgggtcctcccgtaggctagtcagtcaaccnttcctcctgcactcgacaacctgcagtgtacgttggtcgtacgaatntcgtctcgtcgtaaccaacaacgaccccgtaagaaaccgcccctaaatctatcttatttacgcgttacactaccggcctaaccgtcgtacgggtctacggtctccgtacgttctccgngtccttaaccgacgttgcgtaaccacgtccgcctaccggtcgaccgttcaccggttcggcctcggacggtcgaacgtaggtcgtacggtacggtcgttagttaccttacggtacgtcggatcgtaccgttaacncttacgtgaccggagtaaccgttacncgtacgacccgttactgggtaccgttacgtcgttaccggggtacgggaccggtaacggtaaccgcggttaacccacgggtacttccggacgaccggttaccggaacccggttccgtacccgtccccggg

SEQ ID NO: 237332 - DNA, 767 bp, Homo sapiens
  misc_feature: GYAE6OF02FVA5U.5.24.C02.1.454.CMB.1.raw
tcagatcagacacgcacgaccggtgctcgatttagtacagatcgttagggaaaggggggggtctcaggaggcagcgctactcaggacgtcaccaccatggcctgggctctgctcctcctcaccctcctcactcagggcacgagggtcctgggcccaggctgcccctgactcagccctcctccgcgtccggtctccctggactagtcacgtccacctatcctccgtgcctacgtcgaccaaccgagactacgtgtacggttgggttaggttacgaagtcgtacgttccttaccgttaggtaaccgtaaccaaccgtaaacccccgtaaccgaaaacccggtaaccccctaaaacttccgtaacttacgtttaacgtttttacggacggttaccgaccgttaaccggcccggtaccccgttacggtaccgggggttacccctggtaaccgttcgtccgtttcctacgtaccggtacctaccgtaacggttccgttacggaccgtaaccgtacccggtacccgttccccgttaaccggcccgtttcccgtcggtccggtccgtaccggtacggtcgtacggacggtagtacggaacggtcgtaacgttattacgttacgttcgaacgcgtctactagttacgacgtacgtacggacgcgcgaccgtcgtaccgtcctagtgcgttacgtcggttcgggaccgggtaacgtaccgtcgtaaccgtacggtacgacgtccggtaaccgtccggaccgtccgtccgtccccgg

SEQ ID NO: 237333 - DNA, 787 bp, Homo sapiens
  misc_feature: GYAE6OF02FQ3DM.5.24.C02.1.454.CMB.1.raw
  modified_base (147)..(147): a, c, t, g, unknown or other
  misc_feature (147)..(147): n is a, c, g, or t
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
tcagatcagacacgcacgaccggtgctcgatttagtacagatcgttagggaaaggggggggtctcaggaggcagcgcgtctcaggacgtcaccaccatggcctgggctctgctcctctcaccctctcactcagggcacgagggtccngggcccaagggctgcctagactcagccctcctccgcgttccggtctccgtaggacagtcagtcaaccatctccngctaactnccgaacngcagtgacgtttggtggttacgagtatgtctcgtaggtaccaacaacgaccccgacaaacgacccccaaactcaatctagtttttcgacggttactacgtaaccgccgtaacccttacggtacggggtccctggaccttcgtccgtttcgtcctcggtacctaccgtaacttcgtcggacgtaaccgaccggtccctcctaaccggttcccgtcgttccggtccgggaccgttaccggtacgggtaccgtcgggaaggtaacgtcgggtaacggtcgttaaggtaatttacggttacttccggaagaccttacgtttaccgatttacgggtacgtacgaacggaacacggacgaacgggtcttaacccgggtacccttaaggttggtttaacctggtttaacccggggtaacccggggggtaccgggggggtaacccttaacggggttccggttaaccccggttaccgggttaaccccggtttacggtaacccgggtacccgggttaacccggtaaacccgggttaccgttacccccgggttccccccggg

SEQ ID NO: 237334 - DNA, 894 bp, Homo sapiens
  misc_feature: GYAE6OF02JAKQN.5.24.C02.1.454.CMB.1.raw
  modified_base (233)..(233): a, c, t, g, unknown or other
  misc_feature (233)..(233): n is a, c, g, or t
  modified_base (268)..(268): a, c, t, g, unknown or other
  misc_feature (268)..(268): n is a, c, g, or t
  modified_base (305)..(305): a, c, t, g, unknown or other
  misc_feature (305)..(305): n is a, c, g, or t
tcagatcagacacgcacgaccggtgctcgatttagtacagatcgttagggaaagggggggggtctcaggaggcagcgctctcaggtacgtcacccaccatggcctgggctctgctcctcctcaccctcctcgacctcgacgggcacgtagggtcctcgggaccccagggtcctcggcccgtgaacctcgacggtccctcccgtccggtcggtcccgggtcctccgtagggacnggtcacgtcaccactcgtcctgcctactgccaacnggtcagttcggtaccgttgggtcggttacgaacgttntcggtctccgtacggtaacctaaccaaccacccgaacaaaccccgaccccaacttaccgattcttacgttttagacgttccaccgtccgcctaccgcggtacgggtcctagtcgtacctcgttcctcggtaccgcctaccgtaaccgtccacgggaactaaccgcccgtccgtcccgtaacgtccctacgtacggtccgggtacctacgggtacggtacgtcgggaaaccgttcggtacggtaagtccgtttaacgttacgtttaaccgtaccggttcggttaacccgcgttaacttaaccgttagtacccgggtggtaaacccgtacggggaaacccgttacggtaacccggttaacccggtaacccggttaacccccggttacccgggtaacggtttaaccgttaccccggggtttaagggttacccgggggtaaaccccggggggttcggggttaaaaaccccggtcccgggtttacggggttaacccgggtacccgggttaccccggttaacgggttaacccccgggttacccggggtaaccccaaccggggttttacccccgggacccccgttttacccggggg

SEQ ID NO: 237335 - DNA, 967 bp, Homo sapiens
  misc_feature: GYAE6OF02JDRP9.5.24.C02.1.454.CMB.1.raw
  modified_base (203)..(203): a, c, t, g, unknown or other
  misc_feature (203)..(203): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgaggcacagggtcctgggcccaggctgcccctgactcagccctcccgtccgcgtccggtctccgtaggacngtcagtccaccactctacctgcctactcgacctaaccagccgaagttcggtaccggttttgggtacggttaacctaaaaggttctttcggttccttaccggtggtaaacccaaaccgaaaccccgacccccgaaactaaaaccccggtaccccccctaaaaattacccgtaacctttaccgtttaaccgtttttgggaacccggtaccgttaaccccgtaccggtccccgtaaccccgttcgggttaaacccggggggtcccctacggtacttcccgttcccgtttccgttaccggtaccgttcccgtaacggtaaccgtttccgttaccggaaccctaaaacccggccccggggttaacccttcccgttacccgggaaccccgtttcccgtaacggttcccgggtcccgtacccggtacgggtaccgttacgggtaaccgggttaggtaccggtacgggttacgttagtttaaccgttttaagtttaccggtacggttaaccggttaccggttacccgttaaaccgttacttaaaccgggtcgttaaccggaacgggtaacccgttacggaaccgtacccgtaaccgggttaccctaacccggttaccggttacggtacggttacccgttttaaccggggtcccggggggaacccgggtaaccgtccggttaccggttcccggttaaccccggttacggtaccccgggtttaccgaaaccccggtccgggaacccggttccgtcccccgggtttaaccccggg

SEQ ID NO: 237336 - DNA, 793 bp, Homo sapiens
  misc_feature: GYAE6OF02GPZJ2.5.24.C02.1.454.CMB.1.raw
  modified_base (646)..(646): a, c, t, g, unknown or other
  misc_feature (646)..(646): n is a, c, g, or t
tcagatcagacacgcacgaccggtgctcgatttagtacagatcgttagggaaagggggggggtctcaggaggcagcgctctcaggacgtcaccaccatggcctgggctctgctcctcctacacccctcctcactcgagggcacgacgggtcctcgggacccagggcctcggccctgacctcacgtccctccctccggccggttccgggtcctccgtaggactacgtccacgtccaacctctcctcctgcctacgtcgaacccaacgagacgtagttcgtacggtttgggtacggtaacgtaacggttcttcgttccgtcgttaaccggtaaacccaaaccgaaaccccgtaccccgaaaaccgtaaaccccgaccccctaaacgtcctaacttacgtttaacgtttcggaacggttaccaccggtaccgaacccgaccgtaccgggtacgggttccctaggtccgttacgtccgttacgtaccgttcggacccgtactaacggtccgtacgaaaccgtaccggtacccctacccgttccggaacggttacccctcgttaaccgggtccgaacccgttacggtccggtacggtacggaacggttggtaccgtggtaacctgtaacttaccgtacgtacggactcgtntacgtacgtcggccgacgcggacacgtacgccgtaccgacctcgtagtccggtagtaccgtcggggtaaccgggcggtaaccgtaacgtccggtaacccgtcgtacgtccgacggtacccgaccggacgttacccggcccgtcccgg

SEQ ID NO: 237337 - DNA, 820 bp, Homo sapiens
  misc_feature: GYAE6OF02JDQIW.5.24.C02.1.454.CMB.1.raw
  modified_base (243)..(243): a, c, t, g, unknown or other
  misc_feature (243)..(243): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcgagggcacagggtcctgggcccaggctgccctgactcagcctccctccgcgtccgggtctccgtggacagtcaggtccaactatcctcctgaccacgtcgaccaaacccnggaccacggtcgtaacggtttggttacggttacgaaagttcttcgtaccttaccgttacggtaacccaaaccaaccgaaccccgtaacgaaacccgaccccccaaactccgtaacttacgtttaagtttttaggacgttacctaaccgtaccgaccgtacccgtacggaccggggttaccctgtacgtccgttccgttaccgtcgtcggtaccttaccgtaacgttctacggacctaccggacccgtccctaccgtacgtacccggttctacccgggtgggtacccttaccgggacggttcgtaacgggtacggtacgttacggggacgttacgttacgttaacgttttacgtaccgtacggtactaccgtacttaccgtaagttacggccgggttacggacggtaccgacggtaacgaccgtaccggttaacccgtaccttaaggttcgttaacgggttaccgtttcccggggtaaccggggggacccgggtaacctaacgggtccggtaacccgggtaccgtttacggtacggaccggacccggtaccggtacggtcccggtccccggtacccgg

SEQ ID NO: 237338 - DNA, 741 bp, Homo sapiens
  misc_feature: GYAE6OF02FZZ0V.5.24.C02.1.454.CMB.1.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtcccggtctcctggacagtcagtcaccatctctgcactgcaaccngcagtgacgttggtggttcaagtntgtctccgtggtaccaacaaccaccccgaacaaaccgaccccccaaatccattcttagtttttacgacgtccgtaaccgtaccggacccgtacccccgacggggtccctagacgtccgtcttccgtctcggtcctacctacgtcgtcggtaccgaacgtacccgtcccgtcccgtacgacccgtccttcgtcggtcccgtccgtcggtccgtggacggtactgggacggttcgtacgttaacgttagttaaccgtgtaccgcgtacttacctagtacgtgacgtacgacggtacgaccggaccgttaccgacccgtttacccggtaacgtacggtttacggttaccgttccggggttaccgggggtacccggggggtaaccgtaaccgggtaccgtaccgggttaccccggttaccggttaaccggtttcccggaaccggtaccccggtaacgggtaccccgttccccggtcccccccggtttaacccgg

SEQ ID NO: 237339 - DNA, 693 bp, Homo sapiens
  misc_feature: GYAE6OF02FL09G.5.24.C02.1.454.CMB.1.raw
tcagatcagacacgcacgaccggtgctcgatttagtacagatcgttagggaaagggggggggtctcaggaggcagcgctctcaggacgtcaccaccatggcctgggctctgctcctcctcaccctcctcactcaggcacagggtcctgggcccaggctgccctgactcagccctccctcgccgtccgggtctccgtggacagtcagtccacatctcctgcactgaccaaccagccagcgtacgttggtgtacgaagtatgtctccgtgtaccaacaaccacccgaacaaacgaccccaaactcaatcctattttcgacgtacacgtacgccgacctcgacggtccctgactccgtcttctcgtcgacctacaacgtcgtacggacaacaccgtccctacctcgtaccgtctacgtcgggactaccgaggacctaggacgggtatacggacggtacgttagtaacgtttaacgttaacgttcgacgtaacgtcttactaagttacgtacgtaccgaagggtacacgtaccgaagtcgtaaacccgtcccgtaaacgtagtacgttacgttccgggtttaaccggggacccgggggtaaactaaaccgggtcgtaaccgggttaaccccggttacgttaacggtaccgaaaccgggttacccgaaacggggttcccttaccccgtaaccccccgg

SEQ ID NO: 237340 - DNA, 730 bp, Homo sapiens
  misc_feature: GYAE6OF02HCCF6.5.24.C02.1.454.CMB.1.raw
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (274)..(274): a, c, t, g, unknown or other
  misc_feature (274)..(274): n is a, c, g, or t
  modified_base (486)..(486): a, c, t, g, unknown or other
  misc_feature (486)..(486): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcactcagggcacacgggtcctgggcccaggcctcgccctagacctcagtccctcccctccggccgtccgggtctccgtggacngtcagtccacntcctcncgcactcgacaaccngcagtcggacggttgggtggttaggaagttntagtccttacgtacgtaaccaaaccaaccccgaacccgaacaacccgacccccaactctaactacttagttttggacgtctaccaccgtaccgtacccgtcggtacgggtaccctgtacgtccgttccttcgtccttacggccctaacaggtccgtagacccaccgtccggtccctacccgtacgtcccgttcgccggtcggtccctaccgnggtctacgggaggtagacgggtagtctacggttaactttacgtacgtacctagtcgtactacgaacttcgacgacgtaccggactaacgtcgacggtactccccgttaccgaggtccgttagtccggttaccggggtacccggggtacgggaacccgaccggttaccggttaccccgtacggtaccgttaaccggaccgggaacccgttaccggtacccggtcccggtttaccccgtccccggg

SEQ ID NO: 237341 - DNA, 717 bp, Homo sapiens
  misc_feature: GYAE6OF02HYFQ2.5.24.C02.1.454.CMB.1.raw
  modified_base (130)..(130): a, c, t, g, unknown or other
  misc_feature (130)..(130): n is a, c, g, or t
tcagatcagacacgcacgaccggtgctcgatttagtacagatcgttagggaaaggggggggtctcaggaggcagcgctctcaggcgtcaccaccatggcctggctctgctcctcctcaccctcctcactnagggcacgacgggtcctgggcccaggccttacgccctaggacctcgacgccctcccgtccggtaccgtccgggtctaccgtcggacagtcacgtccactatctactcgacactgacaacagacacgtagtacgttggtacgttacgtaagtactgttccgtacgtacgtaaccgaacctaaccaccccgtaacaaacccgtaccccctaaagtcctatacttagttttacgaacggttaccacgtaccgccgtaccccgtacggtaccgggtccctacggtaacgttcccgtacttccgtcgtacggtaccttaccgaagtctacgacctaccgaccgtaccctaccgacggtaccctcgtacggtcgtacctacggacgtcgtaggaggacgtgacgttgtaagtaccttagtcactatcgtacttcgaaattccgtaggacgaacgtacgtacgaccgtagaccgtaaccgtctaacgtcgtacgttaccgtaccggggttaccggaccggggaaactaccgtccgtaccggtaccgttaccgacgtaaccgtaccgaccgtccggtacccgtccgtaaccccgg

SEQ ID NO: 237342 - DNA, 868 bp, Homo sapiens
  misc_feature: GYAE6OF02H8PFT.5.24.C02.1.454.CMB.1.raw
tcagatcagacacgcacgaccggtgctcgatttagtacagatcgttaagggaaagggggggggtctcaggaggcagcgctctcaggacgtcaccaccatggcctgggctctgctcctcctcaccctcctcactcgagggcacgagggtccgtcgggcccaggcctcgcccctgacctccgacgtccccttccccgtcccggccggttcccgggtaccttcccgtagggacctaggttccacgtacccaacctacttccttcccgtacgcctaacgttcgaccctaaaccaggccgtaagtcggtacggtttgggttacggttacgaagttgttcgtccgttacgtcggtaaaacccaacctaaaccgacccccggtaaaaccaaacccgaccccccgtaaaactctaaacttacgtttaacgtttttacgaacggttaccctaacgtaccggacccgtaccccgtaccgggtaccgggttccctacggtactccgttcgttctccggtcgtaccctaccgtaagttccgacggaacccacgtaccgtccctccccgtagtacccttccgtaccggtcggccccgttacgtcggtacgtacgggtacggtacgtacggggtacgttccgttacggttaacgttttacgtaaccgtcgtccgtaaacgtacccgttacgttaactacgtcggaccgtaagggtaccgacgtaccggacctaccggtacccgttaccctgttaccgttagttccgttaccggggttacccgggggaaccgggtctaaccgggtacgtcccggttacggtaccccgggttcgtaacgtaccccggtacccggtaacggtcccgttacccggttacccccggg

SEQ ID NO: 237343 - DNA, 755 bp, Homo sapiens
  misc_feature: GYAE6OF02GVJUJ.5.24.C02.1.454.CMB.1.raw
  modified_base (141)..(141): a, c, t, g, unknown or other
  misc_feature (141)..(141): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgaggcacgngggtcctgggcccaggctcgccctagactcacgcctcccgtccgtcgtccgggtctccgtggactgtcagtaccacctactctcctgcctactacgaccaacgagaccgtagtacggtacgtttacgggtggttaccgaagttacgtacgtccttaccgtacggtaaacccaaaccgaaaaccccgacccccgtaaaccgaaaccccgaaccccctaaactcgtaccttacgtttacgttttacggaccgttaccgtaacgtacccgccgtaacccgtcggtaccgggtcctagtcgttaccgtcttcgacgtcggtactcgtacgtcacggacaccgtcgacctcgtcgtactcgtcgtaccggtctaccgtgtacggtggaacgtgtacgggaacttgtaacgttactttacgaccggtccgtacgtactacttaagtacgtacggtaggaaccgttacggacgtaccgcgacgtaacccgtccgttctaggtagtaaccgttcgggtaccgggtaacggggaccggtaaccgtacggttaccgacccgggttaaccggtaccggtaacaccggtaacgcccccggtttaggtaccccgtcccggtaccccg

SEQ ID NO: 237344 - DNA, 792 bp, Homo sapiens
  misc_feature: GYAE6OF02JTT8K.5.24.C02.1.454.CMB.1.raw
  modified_base (155)..(155): a, c, t, g, unknown or other
  misc_feature (155)..(155): n is a, c, g, or t
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
tcagatcagacacgcacgaccggtgctcgatttagtacagatcgttaggggaaaggggggggtctcaggaggcagcgctctcaggacgtcaccaccatggcctgggctctgctccgtcctcaccctcctcactcagggtccacgacgggttccgngggaccctaggctcgccctgacctcacgccctcccgtccgtccggtcccgggtctccgtcggtaccncggtccacgtccaaccnctcctcctggccacgtcgaccaaccgtcgacgacgtcgtacggttacggtcggttactagtactcgtcctaccgtacgtaaccaaccgtacctacccggaacaaccgacccccaaacgtcaacgttcttaagtttcggacggtacctaccgaccgtccgtacctacgggccggtctagtactccgttacgtctacggcgaccttacggagttccggaacgttaaccgcggtaacccgtccgtaccggtacgtacccgttacgtcggtaccggttccgacgtacggtacgtacggtaacggtacggtaacgggtacgtaccggttacgttaacgttaacgtaccgtacggttacgtacggtaacttaccggtaacttacgtacggttaccgaggtaacctcgtaaccgtacgtaccggtaccgtccgtacggttcgtaacggttccggtcgggttaccgggccgggtaacggaccggttaacggttcccggtaaccgtaccgggtacggtaaccgtaccggaacccggtcggttaccccgccccggttacccgg

SEQ ID NO: 237345 - DNA, 725 bp, Homo sapiens
  misc_feature: GYAE6OF02H0C5W.5.24.C02.1.454.CMB.1.raw
  modified_base (199)..(199): a, c, t, g, unknown or other
  misc_feature (199)..(199): n is a, c, g, or t
tcagatcagacacgcacgaccggtgctcgatttagtacagatcgttagggaaaagggggggggtctcaggaggcagcgctctcaggacgtcaccaccatggcctgggctctgctcctcctcaccctcctcactcagggcacagggtcctgggcccaggcctgccctgactcagcctcctccgcgtccggtctctggacngtcacgtcaaccatcctctgcactgaccaccagcagtcgacgttggtgtcgagtatgtccgtctacgtaaccaactaaaccgaccccgaacaaacccgaccccctaaactccactcttaattttggacggtccaacgtccggacctacccgtcgacggggttccctagacgtccgtacctttccgtcgtcggtacctaccgtaacgttcgtacgaccaaccgaccggtcccctaccccgttacgacccgttccgttaccggtcgggacccttacccgtagggtaccgtagggaacgggtaggttacgggacgttacgtttaagtaacgttttaaacgttacgttacgaccgtacgtaccttaccgtattacgacgtacggacggctacgaccgacgccgtaccgttcccgaagttcgtacgggtacgtttacccgggtccggggaccggggtaaaccacgggtccgttaccggtaccgtaccgtacggaccgaccgtaacccggagttaccccgtcccgtaccccg

SEQ ID NO: 237346 - DNA, 958 bp, Homo sapiens
  misc_feature: GYAE6OF02I1JQF.5.24.C02.1.454.CMB.1.raw
  modified_base (144)..(144): a, c, t, g, unknown or other
  misc_feature (144)..(144): n is a, c, g, or t
  modified_base (690)..(690): a, c, t, g, unknown or other
  misc_feature (690)..(690): n is a, c, g, or t
tcagatcagacacgcacgaccggtgctcgatttagtacagatcgttaggggaaagggggggggtctcaggaggcagcgctctcaggacgtcaccaccagtggcctgggctctgctcctcctcaccctcctcactcgaggcacgngggtccgtcgggcccgaggtctcggtccctacggacctcaccgtccccttcccccgtccggtccgggttccccggggttccttcccggtacgggacgtacgttccgaacggttccaaccctacttcccttaccggtcgacctccgtactaaccgaacccgacgacgtaaggttcggtaccgggttttagggggttaccgttaaccggtaagttcggttaccgttccggttaccggtaaaccggttaaccccaaaaacccgaacccccggtaaaccccgtaacccgaaaaacccccggtaaccccctaaaccttacgtaaccttttaccgttaacgtttttacgggaacgtttaccctaaccgtacccgggtacccggttaacccccgtggggtacccgggtttaacccgaggttaccgttccggtttaccttacggtcccggttaccgacccgtttaccggtaaggtccggtttaacgacccggttaccggaacccccggtttcccctccgttacccggttacccgttagccggggtttaaccccnccggtaccggtcggtaccgggtacggtacgggtacggtacgggttacgtacgttaacgttacgttaccgttacgtcgtaaccgtagtacgttagtacggttacgcggtaacgtccgtacgaccgaccgtccgtaacccgtaccgtttaccgagttacggtaccgtaccgggtacccggacggggtaaccggtaccggaccgttaccggtacccggaccgttaccggtaccggaccggaccggaccgtaccggtcccggtcccgtccgg

SEQ ID NO: 237347 - DNA, 820 bp, Homo sapiens
  misc_feature: GYAE6OF02HM1X1.5.24.C02.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
tcagatcagacacgcacgaccggtgctcgatttagtacagatcgttagggaaaggggggggtctcaggaggcagcgctctcaggacgtcaccacatggcctgggctctgctcctcctcaccctcctcactcagggccacgagggtcctgggacccagggctcgccctgacctcacgccctcccgtccgcgttccggtctccgtggacngtcagtcaccntctctgctacgtnccaacgngcagtcgtacggttggtcggttacgaaaggttctcgttccttccgtacggtaaccaaccgtaaccgaccccggaaccaaaccgacccccaaactcgtactacttacgttttagacggtacctaaccgtaccgccgtaaccccgttcggaccggggttcccgtagtaccttcgttccgttcgtacgtcggaccgttaccgaacgttccgccgtaaccgaacccgtacccggtcccttaccccgttaccgtacccggtttccacggtttcccggtcccgtccggtaacggtcccgtagggaacggtaggtccggtaaaggtaccgttaaggttacgtttaacgttcgccggtacgtacgtctaaccgttaagttcgtaccgtacggacgggtaccaggacctaaccggtaccccgtacgtacccgttagtaccgtttacgaccgggttttacgggtacccgggggtaacccggggtaacctaccgggtacccgttacccggttaacccgggttacccgggttaacgggacccgtaaccgggaacccggtttacccggccccgggtttaaccccgtccccgggg

SEQ ID NO: 237348 - DNA, 1198 bp, Homo sapiens
  misc_feature: GYAE6OF02GSZA2.5.24.C02.1.454.CMB.1.raw
tcagatcagacacgcacgaccggtgctcgatttagtacagatcgttagggaaagggggggggtctcaggaggcagcgctctcaggacgtcaccaccatggcctgggctctgcctcctccctcctccctcctcactcggacggcacggacggtccggtcggaccgacgtcgtcgtacctcgacctcgacctcccgtcccgccggtccggttccggtcctcgtacggtacacgtacgtaccgtactacctacttccttccgcgtaccgaaccgtaccgaacccgaaaccggtacgtacggtaacggttcgggttacggggtttcggggttaccggttaacggttaaggttacgttaccggttacccgttacccggttaaaccgtaaaaccccgtaaaaaccgtaaaaccccccgtaaacccccggtaaaaccccgaaaacccccggtaaacccccctaaaacgttaccgttaaccgtttaaccggttttaaccggttttaaccggggtaaccggtttacccggtaaacccgggttaaccccggttaacccggacccccgggttaaccgggttaccccggggttaaccgtacccgggttaccttaccccggtttacgtttacccggttccggtacccggttacccggttaaccgttaaccggggttaccgtaacccgggtaacccggtaacccccggggtaccccgttcccgggttaccccgtttaccccggggtaccccgttacccggggtttcccgggtacccgggtttaccccggttaccggggtaaaccggggttccggttaaaaccgggggttaccgttaaacgggggtacggggttaacccgggtttaccggttttaaacggtttaaccggtttttaaaccgggtaacccgttaccgggttaaaccggtttacccggtaaccccggttttaagtaacggtttaaacccgggtcccgtaaacgggggtcccggtaaaaccccggtacggtaacccgggttaacccggtacccgttacccgggttaaaccggtttccgggttaaaccgttcggggttaacccggggttaccggggggtacccggggtaaacccgggggtacttaacccgggtaccggttaaccccgggtaaccgggtccccgttaagggtacccccgggtaaccggacccgggttaaccccgtttccccggggttaa

SEQ ID NO: 237349 - DNA, 814 bp, Homo sapiens
  misc_feature: GYAE6OF02HRDZL.5.24.C02.1.454.CMB.1.raw
  modified_base (257)..(257): a, c, t, g, unknown or other
  misc_feature (257)..(257): n is a, c, g, or t
  modified_base (651)..(651): a, c, t, g, unknown or other
  misc_feature (651)..(651): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcacccttcctcacctcgagggcacgacggggttccgtgggccctaggctcgccctgactcgacgtccctccctccgccggttccgggtctccgtcggacacgtcacgtccacctatcctcctgccactcgaccaccgancgtaggttcggtacggttggtacggttacgaagttcgtcgttccgtccgtacggtaaccaaccgtaaccgaaccccgaaccgaaaccggtaaccccccaaactacctacttaccgtttatttttacgggacgttaccgtaaccttaacccggccgtaaccccgttaccgggaccgggtttcccgtcgtacgttccgactttcgtaccgtccgaccgtcgtaacgttccgcggtaaccaccgaccgtccgttcccgtacgtacccgttcgtaccggtccggtacccgtacgtacgggtccgtaggtaacggtacggtacggtacggttccgtaacgttaaagtttacccgtacgttcggtaacctaccgggtacttacgtaatacgtacgtacgngaaccgtcgacggttacgaaccgttccctaccggtatcggttaacgttcgggtaccgttaacggggggccggtaacgaaccggttcgaaccggttacccgggtaacctacggggttacccgaccggtaccggtttacccgcccgggttaacccgtcccccggg

SEQ ID NO: 237350 - DNA, 854 bp, Homo sapiens
  misc_feature: GYAE6OF02IHVGG.5.24.C02.1.454.CMB.1.raw
  modified_base (626)..(626): a, c, t, g, unknown or other
  misc_feature (626)..(626): n is a, c, g, or t
tcagatcagacacgcacgaccggtgctcgatttagtacagatcgttagggaaagggggggggtctcagggaggcagccgctctcaggacgtcacccaaccatcggccgtgggctctgcctcctcctcaccctcctcactcgaggcacgaggtccgtggccaggctcgccctgactcacgcctcccgtccgcggtccggtcctccgtggacagtcacgtccaccgtatcctcctgcctacgtcgacccaaccgtagtccgaggttcggtaaccgggtttggttacgggtttacgaaagttacgttccgttccgttacccggttaacggtaaaccctaaaaccgaaacccccgtaaacccccggaaaacctaaaacccccggtacccccctaaaacgttacaaccgtttaaccgtttaacggtttttacgggaacgttaccaaccggtaccggtaaccccgtaccccggttaccgggtaaccccggggttcccctaggttaaccgttccgttaccttccgttcgacggtacctacccgtaaggttccgacgaccaacccggtaccgtcccttaccgccgtacccggtctccggtacgtcctacgacgtcgtagacggtctaggacgtntacgtattacgtacgtgacctacgtctactagtcgaccggacgtacgtcaaccggtcaccgtaccgtaacccgttccgtagttaaaccggtcgttaccgggttacccgggacgggggtaacccgggcctttaaccgggtacccgtttacgggaacccgtttaacgggtaacccggtaccgaaacccgggttccccgaaccgggttaccccgttccccgttaccccggg

SEQ ID NO: 237351 - DNA, 782 bp, Homo sapiens
  misc_feature: GYAE6OF02JVV24.5.24.C02.1.454.CMB.1.raw
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (643)..(643): a, c, t, g, unknown or other
  misc_feature (643)..(643): n is a, c, g, or t
tcagatcagacacgcacgaccggtgctcgatttagtacagatcgttaggggaaagggggggggtctcaggaggcagcgctctcaggacgtcaccaccatggcctgggctctgctcctcctcaccctcctcactcgagggcacgagggtcctcgggcccaggctcgccctgactcgagccctccctccgcggtccggtcctccgnggacngtccagtccactntcctctgcnctcgaccaacngactaggtcgtacggttgggtcggttaacgtaagtcttcggttctaccgtacgtaaaccaaccgtaccaaccccgaacgaaacccgaccccctaacgtactacgttacttaagtttacgaacggtacctaaccgtaaccggtaccgtacccggtaccggtaccggggttacccgtagtaccgttaccgttacgttaccgtccggttacggtacccgtaccgttaaacggttccgtaacggaaccgaacgtaccggttaccctaccggtaccgtacccgttccgtccgggtacggtcccgtacggaacggtcgtacggtcggtaagcgtaggtaccttagttacgttaaccttggtacgaccgtagtactacgtactacgccgtagtaccggagacccgtanaccggtacgttaccgtcccgttaaggtcccggttaagtcccggttcgggtaaccggggacggtaaccggtaccgtacgtacccgtacggtacccgtacggtacggaaccgtaccggtacccgttccgaccccggtcccg

SEQ ID NO: 237352 - DNA, 663 bp, Homo sapiens
  misc_feature: GYAE6OF02J0PWH.5.24.C02.1.454.CMB.1.raw
  modified_base (255)..(255): a, c, t, g, unknown or other
  misc_feature (255)..(255): n is a, c, g, or t
  modified_base (404)..(404): a, c, t, g, unknown or other
  misc_feature (404)..(404): n is a, c, g, or t
  modified_base (416)..(416): a, c, t, g, unknown or other
  misc_feature (416)..(416): n is a, c, g, or t
  modified_base (442)..(442): a, c, t, g, unknown or other
  misc_feature (442)..(442): n is a, c, g, or t
  modified_base (454)..(454): a, c, t, g, unknown or other
  misc_feature (454)..(454): n is a, c, g, or t
  modified_base (462)..(462): a, c, t, g, unknown or other
  misc_feature (462)..(462): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (487)..(487): a, c, t, g, unknown or other
  misc_feature (487)..(487): n is a, c, g, or t
  modified_base (511)..(511): a, c, t, g, unknown or other
  misc_feature (511)..(511): n is a, c, g, or t
tcagatcagacacgcacgaccggtgctcgatttagtacagatcgttaggggaaagggggggggtctcaggaggcagcgctctcaggacgtcaccaccatggcctgggctctgctcctcctcaccctcctcactcagggcacgagggtcctgggcccaggctcgccctgactcgacgtccctcccgtccggccggtccgggtcctccgtggacagtcacgtccaaccacttcctccgacgctactcgaccaaccgngcaggtcgtagttgggtggtacgaatgtcgtctccgtagtaaccaacaaccgtacccgaacgaaccgaccccaactctacttcgttagtttggacgttccacgttaccgccgtaccgcggtaccgggtcctagctcgtcttctcgtacncgtactacgtcncgacaccgcgtccgtactcgcgttcncggtcgctacgngacgtcgngagnggacgntagtattactacgtntcgctacgtctacgtgtacgacgnggtacgacgccgtacgcgtaccgtaccgtacgtacgtacggtacgtccggggtacgggacccgggtaggttaacccggtccggtaccggttaaccggtaccgtacgggtaccggaacccggttcccggaaccggcccgttccgttaccccgg

SEQ ID NO: 237353 - DNA, 717 bp, Homo sapiens
  misc_feature: GYAE6OF02HMNO9.5.24.C02.1.454.CMB.1.raw
  modified_base (587)..(587): a, c, t, g, unknown or other
  misc_feature (587)..(587): n is a, c, g, or t
  modified_base (629)..(629): a, c, t, g, unknown or other
  misc_feature (629)..(629): n is a, c, g, or t
tcagatcagacacgcacgaccggtgctcgatttagtacagatcgttagggaaagggggggggtctcgaggaggcagcgctctcaggacgtcaccaccatggcctgggctctgctcctcctcaccctcctcactcgagggcacgagggtcctgggcccaggctcgccctgactcacgccctccctccggcgtccgggttcctccgtggacagtcagtcacctatcctcctgacctactcgaccaaccgaggctagtcggtacggtttgggtacggttacgaaagttcgttcgttaccgttccgttaacggtaaacctaaacccgaaaccccgtaacccccgaaacgaaacccgtaccccccaaaacttctacttaacctttaagttttcggacggtacctaaccgtaccggaccctaccccggtggtaaccgggttcctgaacgttcccgtccgtttctccgttccggtcctaaccggtagtccgtacgaccacgtacccgtcctccgtaccgtccgtccgtcgtacggtcccgacggtacgtcgtgtaacgcgtgggctacgtagtactttactgactcgcgtactntacgtgccgaggcgactacgaccgctaccgtacgtacgtgtntcggtacgtacggggtcgggacggactcggtacgtaaccgtcccgtaggtaccgacggtaccgaccggtaccgtccgtacccggtccg

SEQ ID NO: 237354 - DNA, 856 bp, Homo sapiens
  misc_feature: GYAE6OF02FRVZE.5.24.C02.1.454.CMB.1.raw
  modified_base (710)..(710): a, c, t, g, unknown or other
  misc_feature (710)..(710): n is a, c, g, or t
  modified_base (742)..(742): a, c, t, g, unknown or other
  misc_feature (742)..(742): n is a, c, g, or t
tcagatcagacacgcacgaccggtgctcgatttagtacagatcgttagggaaagggggggggtctcaggaggcagcgctctcaggacgtcaccaccatggcctgggctctgctcctcctcaccctcctcacctcagggccacgtacgggtcctgggccccagggtctgccctgacctcagccctccctccggcgtccggtctcctggacagtccagtccaccattccgtacctgaccactgacctaaacccaggctaaggttcggacggttttgggtacggtttacgaaaggttcttcggtccttacccgtcggttaaacccaacctaaacccgaacccccgaaccaaaacccggacccccccaaaacttccaacgttcctttaacgtttttcggaacggttcctaaccggtaacccgccgtaaaccccgttaccggtacggggttaccccgtacgttaccgttaccgttcctttaccgttccgtcgggtaccctaacccgtaacggttccggtaccggtaaccaacccggtacccggtcccgttaccccgttacggtacccgttaccttccggtacgggtccctacccgtacgggacgttagggaacgggtacgtagggtaaccggttcttaagggttaactttaacggttaccgtcggtaaccgtacgttacccgtaattaacgttacgtaccggtacaaccgggtanaacccggtcaagtacccggtactaccccggtntcggttaacggcgtttacgggtacccggggcgggtaaacccgtacggtcgtaccgtacccggttaacgccggttacggacccggaacccgagggttacccctcccggtaccccg

SEQ ID NO: 237355 - DNA, 706 bp, Homo sapiens
  misc_feature: GYAE6OF02GZROJ.5.24.C02.1.454.CMB.1.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (508)..(508): a, c, t, g, unknown or other
  misc_feature (508)..(508): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtcggtctcctggacagtcagtcaccatctctgcactgccaacngcagtgacgttggtgttcgaagtntgtctcctgtaccaacaaccacccgacaaccgcccccaaatcactcttagttttgacgtcactacgtccgacctcggtacggggtccctaggtactccgtctttcctcgtggtccctaccgtaagtcgtacggaccaaccgtacccggtcccttcccgtacgtacccgtttcctccggttccgggtccccttaccgacgggtacgtacgggtaacggttaggtacggtacggtcgtaggtttaacttacgtttaccggnggttaccacggttccctagtaaacgtgtacgacgtacggcgtaacgcgtaacgcctaccgtacccgtagttacgttacgaccgtttccgggtaccggggaacccggggtactaacggtcggtttaacccggcccggtttaccggtaccggaccggtacccgttaacccggacccggttaccgtccccggttacccccg

SEQ ID NO: 237356 - DNA, 618 bp, Homo sapiens
  misc_feature: GYAE6OF02F7SE6.5.24.C02.1.454.CMB.1.raw
  modified_base (238)..(238): a, c, t, g, unknown or other
  misc_feature (238)..(238): n is a, c, g, or t
  modified_base (495)..(495): a, c, t, g, unknown or other
  misc_feature (495)..(495): n is a, c, g, or t
  modified_base (519)..(519): a, c, t, g, unknown or other
  misc_feature (519)..(519): n is a, c, g, or t
tcagatcagacacgcacgaccggtgctcgatttagtacagatcgttaggggaaagggggggggtctcaggaggcagcgctctcaggacgtcaccaccatggcctgggctctgctcctcctcaccctcctcactcagggcacagggtcctgggcccaggctcgccctgactcacgccctccctccgccgtccgggtctcctggacagtcagtcaccatcctcctgccactcgacaaccngcagtgtacggttgggtcggttacgaagtattgtcctaccgtaggtaaccaaacaaccaccccgaacaaaccgacccccaaactcatactacgttttgacggtcacgtacgcgaccctgacggggtcctgactcgtcctctcgtcggctacctaagtctaggcaaacgccggtcctccctcgtacccgtcgttaccgtcggcctccgtacggacggtcgaaggactcgggagcgtagtaacgtttactacgtcgacngttcctagtactagtcgacgagcngaccagcacgtcctatgacgtcttcggtaccgggcggggtaaccaggcctacgggacctacggtcgagacccgacccggcgtcccgtaccgtcccccgg

SEQ ID NO: 237357 - DNA, 537 bp, Homo sapiens
  misc_feature: GYAE6OF01DO1L3.11.65.F10.1.454.CMB.1.raw
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
  modified_base (505)..(507): a, c, t, g, unknown or other
  misc_feature (505)..(507): n is a, c, g, or t
  modified_base (509)..(509): a, c, t, g, unknown or other
  misc_feature (509)..(509): n is a, c, g, or t
  modified_base (513)..(522): a, c, t, g, unknown or other
  misc_feature (513)..(522): n is a, c, g, or t
  modified_base (524)..(537): a, c, t, g, unknown or other
  misc_feature (524)..(537): n is a, c, g, or t
tcagcgagagataccacgaccggtgctcgatttagctacgctctaaaggggaaaaggggctggtgttgggtctcacgtattgacaaatgatgggagtgacacaatccacgcggattctgtgaggggccgattcaccacttcgagagacaacgccaaagaacacggtatatctgcaaatgaaacagtctgagaggcgaagacacggcttgttttacttctgtgcaagaggtggctggtcgcatggtatttgatcgtcgtggggccaggggacaagtggtaaccgtctcttcacgcctccaaccgaacgggcccagtccggtccttcccccgtggccgccctgcctccgaggacgccaccgtccgagacgccaacgacgccgggtcccgtgggcctcggcccgttaggtaccgaaacggtaccttacctttccgtaacttcctcgtccgtcgtcggacggccgggtcgttggaccgaacgggcgactagtaggcagcgntnactncnnncncgcnnnnnnnnnngnnnnnnnnnnnnnn

SEQ ID NO: 237358 - DNA, 725 bp, Homo sapiens
  misc_feature: GYAE6OF01EE2NS.11.65.F10.1.454.CMB.1.raw
  modified_base (675)..(675): a, c, t, g, unknown or other
  misc_feature (675)..(675): n is a, c, g, or t
  modified_base (682)..(682): a, c, t, g, unknown or other
  misc_feature (682)..(682): n is a, c, g, or t
  modified_base (688)..(688): a, c, t, g, unknown or other
  misc_feature (688)..(688): n is a, c, g, or t
  modified_base (693)..(695): a, c, t, g, unknown or other
  misc_feature (693)..(695): n is a, c, g, or t
  modified_base (697)..(701): a, c, t, g, unknown or other
  misc_feature (697)..(701): n is a, c, g, or t
  modified_base (703)..(704): a, c, t, g, unknown or other
  misc_feature (703)..(704): n is a, c, g, or t
  modified_base (706)..(708): a, c, t, g, unknown or other
  misc_feature (706)..(708): n is a, c, g, or t
  modified_base (710)..(710): a, c, t, g, unknown or other
  misc_feature (710)..(710): n is a, c, g, or t
  modified_base (712)..(722): a, c, t, g, unknown or other
  misc_feature (712)..(722): n is a, c, g, or t
  modified_base (724)..(725): a, c, t, g, unknown or other
  misc_feature (724)..(725): n is a, c, g, or t
tcagcgagagataccacgaccggtgctcgatttagctacgctctaaagggaaaggggctggtgtggtctcacgtattgacaatgatgggagtgacacaatccacgcggattctgtggaggggccgattcaccacttcgagagacaacgccaaagaacacggtatatctgacaaatgaacagtcgtggaggaggacgaaagaccgacggtctttagttttaccttcgtggttcagaaggtagggtcggtcgtcgggtccgactagttaggtagttttggacttccgtacggtcgggggaccgaagggggtaactaacggtacggtaacccgttcttcgttaccgacgtccctacccgaaccggaacccgggtaccccgtacgttccccggttccccttccccccgtcgggtccccgtaccccggtcgtcccgtaccggaacggtaccgacccgtaaccccgtaccgggaacgaccgaccgacgtaccgggcccgggtcccggtacggggtccgttccgggtacccgtttcgggtaacccggaaaccggttaccgttttacccccgttttaaccgttaccgtttcccgttacccgttcgggtaccccggttacgggaccgggggtccccgggttaacgggtacgggaaccggaacgggtacccgtacgaagtccggngcgacgntgacgngcgcnnngnnnnngnncnnngngnnnnnnnnnnngnn

SEQ ID NO: 237359 - DNA, 791 bp, Homo sapiens
  misc_feature: GYAE6OF01EMBF3.1.28.C06.1.454.CMB.1.raw
tcagacgagtgcgtcacgaccggtgctcgatttagagctcacgtattgggtttgggggaggaactgctcagttaggacccagagggaaccatggaagccccagctcagcttctcttcctcctgctactctggcctcccagataccaccgggaagtaaattgtgttgacacagtctccagtcacgctgtctttgtcctcgaaggggaaacgacgccaccctctcctgcgacgggccagtcagtagttgttggcagccctagttacgccgtacggtaacccaaacgaacgaaaacccgtcggaccgacggtccctacccgacggccctaccgtaccacgttacctatacggacgttcggaacctacgtaacccgaaacggacggggccctaacgtcggacctactacccgagtcccgtaggttcaggtgacgtcgggtcggtcgtagggacacgtacttccacgtcacctacgactcgaacgaccgacgaccgtaagacgtaccgtaaggtaaacgtttcgttttaccgagtttaaccgttttacttacgttacggtaactaagtttaacgttaatttaaccgtaacccgttaaccggttaacggtacgggtttacccgggtaccggtaaccgggttaacggggaaccggttaaaacgggttagggtaaaaccccgttacggaaaaacccgttagggtttaccggtaccgggtacggttaaccggacccttaaacggttcctttacccggttacgttttaccgttaacccgttccgttacccccggttacccg

SEQ ID NO: 237360 - DNA, 182 bp, Homo sapiens
  misc_feature: GYAE6OF01B6L0U.1.28.C06.1.454.CMB.1.raw
  modified_base (172)..(182): a, c, t, g, unknown or other
  misc_feature (172)..(182): n is a, c, g, or t
tcagacgagtgcgtcacgaccggtgctcgatttagagctcacgtattgggtttgggggaagaggaagactgacggtcccccaggagttcaggtgctgggcacagcggccctgggctgcctggtcaaggactacttccacgcactcgtctgagcggctggcaaggcgcatagnnnnnnnnnnn

SEQ ID NO: 237361 - DNA, 587 bp, Homo sapiens
  misc_feature: GYAE6OF02I0R55.1.28.C06.1.454.CMB.1.raw
tcagacgagtgcgtcacgaccggtgctcgatttagagctcacgtattgggtttgggggactgatcaggactcctcagttcaccttctcactatgaggctccctgctcagctcttggggctgctaatgctctgggtccctggatccagtgcagagattgtgatgacccagactcctctctccttgtctatcacccctggagagcaggcctccatgtcctgcaggtctagtcagacgcctcctgcatagtgatggatacactatttgtattggttctgcagaaagccaggccagtctccacagctcctgagaggattgttaggtactttattactgcaatgacaaagatgaccaacaaagactccgtacccgtaaggtacgttttacgggaccgtacggggaaccaaaggcgtagggaacgtaacgtaacgaaaacggaacgttacggtacgggacttacggacctaacctacgttacttcgttactttacctacttcccgttcccgtaccctacttccttacgaaccgtcctaccgttccgttcgtacggacggcgggtaccggtaggaccgaacggtacgactaacg

SEQ ID NO: 237362 - DNA, 174 bp, Homo sapiens
  misc_feature: GYAE6OF02HDPG5.1.28.C06.1.454.CMB.1.raw
  modified_base (173)..(174): a, c, t, g, unknown or other
  misc_feature (173)..(174): n is a, c, g, or t
tcagacgagtgcgtcacgaccggtgctcgatttagagctcacgtattgggtttgggggaagaggaagactgacggtccccccaggagttcaggtgctgggcacagcggccctgggctgcctggtcaaggactacttccacgcactcgtcgagcgggctggcaaggcgcatagnn

SEQ ID NO: 237363 - DNA, 610 bp, Homo sapiens
  misc_feature: GYAE6OF02FV4XN.1.28.C06.1.454.CMB.1.raw
  modified_base (193)..(193): a, c, t, g, unknown or other
  misc_feature (193)..(193): n is a, c, g, or t
tcagacgagtgcgtcacgaccggtgctcgatttagagctcacgtattgggtttgggggagtcccagtcaggacacagcatggacatgagggtccccgctcagctcctggggctcctgctgctctggctcccaggtgccagatgtgacatccagttgacccagtctccatccttctgtctgcgtctggtggganacagagtcaccttcacttcgccgggcagtcgagggcagttgcgacttcttagcctggtatcagcaaaagccagggatcggccctaacgctcctcatcatgctcgcttccactttgctatggttggggtctcatcgtaagggttcggcggcgacggtcggagtcgtagggacagtattcgacctactacgtaactaaactttacccaaacctcgactacgacccttgacttgtagtttcgtactaccttttataccttgtacgtaacgaggttataacttaccgtttaccctacggttacgtttttagggaccggtacgggtacccgtaacgtcgtacggtacggtacgaaacggaccggttaacgtcgtaggtaccgtacggtacctaaccgtacgttcttaccggttccttacccg

SEQ ID NO: 237364 - DNA, 426 bp, Homo sapiens
  misc_feature: GYAE6OF01EIM55.16.24.C02.1.454.CMB.1.raw
  modified_base (331)..(331): a, c, t, g, unknown or other
  misc_feature (331)..(331): n is a, c, g, or t
  modified_base (420)..(426): a, c, t, g, unknown or other
  misc_feature (420)..(426): n is a, c, g, or t
tcagtgtactactccacgaccggtgctcgatttagtacagatcgttagggaaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctcaccaaggccatcggtctcccctggcgccctgctccaggacncacctccgagagcacagcggccctgggctgcctggtcaaggtactacgttccgagtagtacacgtgagcgggctggcaaggcgcatagnnnnnnn

SEQ ID NO: 237365 - DNA, 467 bp, Homo sapiens
  misc_feature: GYAE6OF01BN0TL.16.24.C02.1.454.CMB.1.raw
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (449)..(467): a, c, t, g, unknown or other
  misc_feature (449)..(467): n is a, c, g, or t
tcagtgtactactccacgaccggtgctcgatttagtacagatcgttagggaaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatccggtccttcccccgtggccgccctgcctccgaggcnccacctcgagngcacagccggcccgtgggctggcctggtacaaggtacctaccttaccgagtaacgtacacgtggagccgggcgtgggacgaagggccgacgagtagnnnnnnnnnnnnnnnnnnn

SEQ ID NO: 237366 - DNA, 449 bp, Homo sapiens
  misc_feature: GYAE6OF02JTWSV.16.24.C02.1.454.CMB.1.raw
  modified_base (436)..(437): a, c, t, g, unknown or other
  misc_feature (436)..(437): n is a, c, g, or t
  modified_base (439)..(449): a, c, t, g, unknown or other
  misc_feature (439)..(449): n is a, c, g, or t
tcagtgtactactccacgaccggtgctcgatttagtacagatcgttagggaaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaaggccccatcggtcttccccctggccgccctgctccaggacgccacctccgagagcacacgccggccctgggctgccctggtcaacggacctacttcccgagtacgtaccactggagccgggctgggcaaggcgcgatagnngnnnnnnnnnnn

SEQ ID NO: 237367 - DNA, 574 bp, Homo sapiens
  misc_feature: GYAE6OF02IGZEH.16.24.C02.1.454.CMB.1.raw
  modified_base (177)..(177): a, c, t, g, unknown or other
  misc_feature (177)..(177): n is a, c, g, or t
  modified_base (333)..(333): a, c, t, g, unknown or other
  misc_feature (333)..(333): n is a, c, g, or t
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
  modified_base (483)..(483): a, c, t, g, unknown or other
  misc_feature (483)..(483): n is a, c, g, or t
  modified_base (518)..(518): a, c, t, g, unknown or other
  misc_feature (518)..(518): n is a, c, g, or t
  modified_base (522)..(524): a, c, t, g, unknown or other
  misc_feature (522)..(524): n is a, c, g, or t
  modified_base (527)..(529): a, c, t, g, unknown or other
  misc_feature (527)..(529): n is a, c, g, or t
  modified_base (531)..(532): a, c, t, g, unknown or other
  misc_feature (531)..(532): n is a, c, g, or t
  modified_base (535)..(540): a, c, t, g, unknown or other
  misc_feature (535)..(540): n is a, c, g, or t
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
  modified_base (549)..(552): a, c, t, g, unknown or other
  misc_feature (549)..(552): n is a, c, g, or t
  modified_base (554)..(556): a, c, t, g, unknown or other
  misc_feature (554)..(556): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (565)..(565): a, c, t, g, unknown or other
  misc_feature (565)..(565): n is a, c, g, or t
  modified_base (567)..(568): a, c, t, g, unknown or other
  misc_feature (567)..(568): n is a, c, g, or t
tcagtgtactactccacgaccggtgctcgatttagtacagatcgttagggaaagggctggagtgggtctcaagtattagtgtgttggtggtctcacatattacgcagactccgtgaaggccggttcaccgtctccagacgacaatttaccaaagaaataccgactagtatcgtcganaatgaatggcctgaagacgaccgaagacgaccggtccgtctactactaggtgaaggaaaggaacgggtcggttgggtaactttacttaagttagtggtagtactagtgggtcggggacaaagggactaacgtgtccaaccgttcttacttccgacnccctaccgaacccgtacggaccctacgtcccgttcctccccggtacgcccgcctcgctacgacgacnccaccgtcgagacncgacacggcccggcgtaggtctcgtaccgtggtaacgagaccttacgtacgtaacgtacgtaacgtcgnggaccgtggtacgcggacggaagtccgaatagacngcgnnncgnnncnnctnnnnnngnactntannnncnnncncancgtncnntgtaga

SEQ ID NO: 237368 - DNA, 611 bp, Homo sapiens
  misc_feature: GYAE6OF01C1B8I.34.81.H04.1.454.CMB.1.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
tcagtacacgtgatcacgaccggtgctcgatttagtagtgtagattcgcggggagctcaggaggcagagcctggagcatctccactatggcctgggctccactacttctcaccctcctcgctcactgcacaggttcttgggccagtttcacgctgactcagccccatctgtgtcggagtccgtccggggaaagacggtaaagccatcctcctgccacccgnagcagtggcagcattacgccggntatgtgcagtgtaccagcagccgcccggctccttccccaccaccgtcactccgtagaagacactgaaacggccctacgtcggggcctgacgtccggttctcgtggcctccactccgacaccgtccctacctaactttcgtcgtccctaccctaacgacttctcgtcggactagaagactggacggacgaggtctacgactacgtactgtctagttcgtttcgacgggtccgactaccgttcgttggtcgggttcgttcgggcgggacgggaccgtaacgcgtacggacccgttacctaaggtcctaaccggcccgaaaggtccgtcccggacccccgttacgggtccctaccgttccgttacccccg

SEQ ID NO: 237369 - DNA, 719 bp, Homo sapiens
  misc_feature: GYAE6OF01CARWD.34.81.H04.1.454.CMB.1.raw
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
tcagtacacgtgatcacgaccggtgctcgatttagtagtgtagattcgcggggagctcaggaggcagagcctggagcatctccactatggcctgggctccactacttctcaccctcctcgctcactgcacaggttcttgggccagtttcacgctgactcacgccccatctgtgtcggagtctaccgggaaagacggtaagcatctcctgccacccgnagcagtggcagcattacgcgntangtgcagtggtaccagcacgcgcccggctcctcccccaccnccgcnctcgtgaacgacacgtacgaacgcctcgtcgggtcctagacgttcggttctacgtcggtcctactacgtccgtacctaccgttccctacctaacgtttccgtaccgtccccgttaccctaaaccgtactttccgtccgtacggaaccgttacggaaacgtacggttacggaacgggaccggtacggccgtacgtaaccttaacctacgtcgtacgttacgtttcggtttacgggacggtaccgaacttaccgtcggttacgggttcgggttacggttccgggggaccgggtaacgggtaaccgtaaaccggtccggtaacccggtacccgttaaccggttaacggtcccgtaaaccggaccccgtaaagggtcccccgtacccggtaccccccgttacggtaccccgttaaccgttccccggtttacccccgg

SEQ ID NO: 237370 - DNA, 722 bp, Homo sapiens
  misc_feature: GYAE6OF01EECVC.34.81.H04.1.454.CMB.1.raw
tcagtacacgtgatcacgaccggtgctcgatttagtagtgtagattcgcggggagctcaggaggcagagcctggagcatctccactatggcctgggctccactacttctcaccctcctcgctcactgcacaggttcttgggccagtttcacgctgactcacgccccactctgtgtcggagtcgtaccgggaaagacggtaagcatctcctgccaccgcagcagtggcagctagttacgtccggctagtgtgctaggtcgtaccagcaggccgcccgggtctcccttcccccacctaccgtcacgtccggtagaacgtaccacgtacggaaacggtcccttcggtcggggtcctggtacgttccggttctcgtcggtcctcgacgtccgactaccgttcctacgtaacttccgtccgtccctacccgtaacgtcttccgtctacggtactaacggaacgtaacgttcgggaacgggtaacggacggtacctacggtaccttaactaccgttagtacgttacggttttcgtttacgggacgggtaccgaaccgttacgttcggttcgggtttcgggttcgggttccggggacggggtaaccggggacctaacgggtccgttaaccggtacccgttaaccggtaaggtacccggaacggtaccccggtaacgggtccccgtccccggtacccccggtccggtccttcccgttcccggttcccccg

SEQ ID NO: 237371 - DNA, 202 bp, Homo sapiens
  misc_feature: GYAE6OF01CEVKM.34.81.H04.1.454.CMB.1.raw
  modified_base (162)..(162): a, c, t, g, unknown or other
  misc_feature (162)..(162): n is a, c, g, or t
  modified_base (200)..(202): a, c, t, g, unknown or other
  misc_feature (200)..(202): n is a, c, g, or t
tcagtacacgtgatcacgaccggtgctcgatttagtagtgtagattcgcggggagctcaggaggcagagcctggagcatctccactatggcctgggctccactacttctcaccctcctcgctcactgcacaggttcttgggccagtttcacgctgactcacnccccactctgtgtcggagtctccgggaaagcggtaagnnn

SEQ ID NO: 237372 - DNA, 712 bp, Homo sapiens
  misc_feature: GYAE6OF01DXLKR.34.81.H04.1.454.CMB.1.raw
  modified_base (216)..(216): a, c, t, g, unknown or other
  misc_feature (216)..(216): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
tcagtacacgtgatcacgaccggtgctcgatttagtagtgtagattcgcggggagctcaggaggcagagcctggagcatctccactatggcctgggctccactacttctcaccctcctcgctcactgcacaggttcttgggccagtttcacgctgactcagccccatctgtgtcggagtcgtaccgggaaagacggtaagcatctcctgtacccgnagcagtggcagctattacggtcgctatgtgcaggtgtaccagcacggccgccggtctcccctacccaccnccgtnactcgagacgacacgagaaccgtcctcggtccgggtcctagtcgttccgtctcgtcgtacctcgactccaccgtaccgttccctaacctactttccgacccgtaccctaccgtaaagtccttcgtcgtacggtacgtagaacgtacgtacggaggtacgacggtacgtacgtacgttacgttaccgtacgttacgttacggtttacgtttacgggaccgggtacgtaaccgttcgttcgggttggggttcggggtttcgggtaccggggtacggggtaccgggaaccggtaaccggtacgttacccggtaccggttaacccggtaaccggtaccggaacccggtccggaaaccggtcccgtaccccggttcccccggtaccggttacccgtcccgtttccccgttcccggttaccccccgg

SEQ ID NO: 237373 - DNA, 865 bp, Homo sapiens
  misc_feature: GYAE6OF01BE5AD.34.81.H04.1.454.CMB.1.raw
  modified_base (261)..(261): a, c, t, g, unknown or other
  misc_feature (261)..(261): n is a, c, g, or t
tcagtacacgtgatcacgaccggtgctcgatttagtagtgtagattcgcggggagctcaggaggcagagcctggagcatctccactatggcctgggcctccactacttctcaccctcctcgctcactgcacgtaggttcttgggcctagtttcacgctgactcacgccccatctgtcgtcggagtccgtacgggaaagacggtaagctactcctaccgtcgccacccgcagcgagtcggcagctacgttaccggtccggtnttagtgtcgacgtaggtcggtaccgagccgacggccggccccgggtccttccccgtttacccccccgaaacccgtaccccggttacctaaccggttacccggttacggaaaaccgtacccgtaaccggttaaccgggaaacccgggttcccccgtttacccgggttcccgggggttaccccccttagggttaaccgtttcccgggttttaccgtccggttccggtaccttacccgtaacgtcccgtaacccgtacccgtttaccccttaacctaccgtttacccgtccgttacccccttacccgtaaacgttacctaccgttcgtacggtaaccgttaggaaaccgtcgttagggaaccggtacggacggttccgttaacgtaaccgttaccgtaccgttacggttacttccgggttttagtttaccggggacggtaccgtaccgtacgttcgggtgggttcgggtttcggtacggggtccgggaaacggtaccgtacgggtccgtaaccggttacccgtaaccgtaacgtcccgaacggaccccgtaacggtccccgtaccggtcccccgttagtaccccgttccgtcccgtttaaccccccg

SEQ ID NO: 237374 - DNA, 530 bp, Homo sapiens
  misc_feature: GYAE6OF02GXVV7.34.81.H04.1.454.CMB.1.raw
  modified_base (214)..(214): a, c, t, g, unknown or other
  misc_feature (214)..(214): n is a, c, g, or t
tcagtacacgtgatcacgaccggtgctcgatttagtagtgtagattcgcggggagctcaggaggcagagcctggagcatctccactatggcctgggctccactacttctcaccctcctcgctcactgcacaggttcttgggccagtttcacgctgactcagccccactctgtgtcggagtctccgggaaagacggtaagcatctcctgcaccgnagcagtggcagcattacgtccggctatgtgcagtggtaccagcagcgcccgggctcttccccaccaccgtcatccgtgaacgacactgaaacggccctcgtcggggtccctggactcggttctcgtggctccatcgacacgtcctccaattctcgcctccctaacgatctctggactgaagactgaggacgaggctagacttactactgtcagttcttttggaggcgacacgtctggttgggttgttcgggcggacgggacaaggcgtcgaccgtcgtaagtcacgccgaaggctcgcccctcggtcactcgtccg

SEQ ID NO: 237375 - DNA, 564 bp, Homo sapiens
  misc_feature: GYAE6OF02GEN64.34.81.H04.1.454.CMB.1.raw
tcagtacacgtgatcacgaccggtgctcgatttagtagtgtagattcgcggggagctcaggaggcagagcctggagcatctccactatggcctgggctccactacttctcaccctcctcgctcactgcacaggttcttgggccagtttcacgctgactcagccccactctgtgtcggagtctccgggaaagcggtaagcatctcctgcacccgcagcagtggcagcattacgccggctatgtgcagtggtaccagcagcgcccgggctcttccccaccaccgtcactccgtgaacgaccactggaaacggccctcgtcggggtccctggactcggttctcgtcggctccatcgacacgtcctcaattctcgcctcctaacgtactctctcggactgaacgactgaggacgaggctgacttactacgttgtctacgttcgttttggacgggtcgactacgtcgtggttgggttcgttcgggcggtacgggaccaggtcgtcggaccgtacgtaagtccgacgacccgaaggcctccggtccccgtcggtctaccgtcgttcccgg

SEQ ID NO: 237376 - DNA, 575 bp, Homo sapiens
  misc_feature: GYAE6OF02FLOGK.34.81.H04.1.454.CMB.1.raw
  modified_base (215)..(215): a, c, t, g, unknown or other
  misc_feature (215)..(215): n is a, c, g, or t
  modified_base (239)..(239): a, c, t, g, unknown or other
  misc_feature (239)..(239): n is a, c, g, or t
tcagtacacgtgatcacgaccggtgctcgatttagtagtgtagattcgcggggagctcaggaggcagagcctggagcatctccactatggcctgggctccactacttctcaccctcctcgctcactgcacaggttcttgggccagtttcacgctgactcagccccactctgtgtcggagtctccgggaaagacggtaagcatctcctgcacccgnagcagtggcagcattacgtccggntatgtgcagtggtaccagcagcgcccgggctccttcccccaccaccgtcatccgtgaacgacactgaaacggccctctggggtccctgatcggttctctggctccatcgacacgtcctccaattctgccctccctaacgatctctggactgaagactgaggacgaggctgacttactactgtcagttcttttgagggcgactactcgttggttcggggttcgttcgggcgggtacggggaccgaacggtcgtacggtacccggtccgtaaggtccgaacggaccccgtaaggtccgtccggtacccccgtcgggtaccctaccgtccgttccccgg

SEQ ID NO: 237377 - DNA, 592 bp, Homo sapiens
  misc_feature: GYAE6OF02G44NB.34.81.H04.1.454.CMB.1.raw
  modified_base (239)..(239): a, c, t, g, unknown or other
  misc_feature (239)..(239): n is a, c, g, or t
tcagtacacgtgatcacgaccggtgctcgatttagtagtgtagattcgcggggagctcaggaggcagagcctggagcatctccactatggcctgggctccactacttctcaccctcctcgctcactgcacaggttcttgggccagtttcacgctgactcagccccactctgtgtcggagtctccgggaaagacggtaagcatctcctgcacccgcagcagtggcagcattacgtccggntatgtgcagtggtaccagcagcgcccgggctccttcccccaccaccgtcactccgtgaacgacacgtacggaaacggtccctcgtcggggtccctggacgtcggttctcgtggcctccatcgactacgtcctctaacttctcgccctccctaacgctctcgtgactgaacgacgtgaggacgaggtctagacttactactgtctagttcgtttggacgggtcgactacgtcgttggtcgggttggttcgggacgggtacgggaccaaggtcgtacggtacccggttcgtaacggtccgaaccgacccgaaggtcccgtccggtcccccgttcggtccctacctccgttcccgg

SEQ ID NO: 237378 - DNA, 546 bp, Homo sapiens
  misc_feature: GYAE6OF02FL9SY.34.81.H04.1.454.CMB.1.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (324)..(324): a, c, t, g, unknown or other
  misc_feature (324)..(324): n is a, c, g, or t
  modified_base (393)..(393): a, c, t, g, unknown or other
  misc_feature (393)..(393): n is a, c, g, or t
  modified_base (462)..(462): a, c, t, g, unknown or other
  misc_feature (462)..(462): n is a, c, g, or t
tcagtacacgtgatcacgaccggtgctcgatttagtagtgtagattcgcggggagctcaggaggcagagcctggagcatctccactatggcctgggctccactacttctcaccctcctcgctcactgcacaggttcttgggccagtttcacgctgactcagccccactctgtgtcggagtctccgggaagacggtaagcatctcctgcacccgcagcagtggcagcattacgccgntatgtncagtgtaccngcagccgcccggctcttccccccacaccgtcatccgtgaacgacactgaaacggccctgtcggggtccctgntcggttctctggctccatcacaccgtcctcaattctcgcctaccctaacgctctcgtgactgaagtacnggaggacgaggctggactactactgtcagttctttaggaggcgtactacgtcttgggtggttgtcgggnggtacggacgacgtcgtcgacccgttcacgtcgaacgtacccgaaggtcctacccgtccccgtacggtccaccgtcgttccccg

SEQ ID NO: 237379 - DNA, 682 bp, Homo sapiens
  misc_feature: GYAE6OF02IMENO.34.81.H04.1.454.CMB.1.raw
  modified_base (214)..(214): a, c, t, g, unknown or other
  misc_feature (214)..(214): n is a, c, g, or t
tcagtacacgtgatcacgaccggtgctcgatttagtagtgtagattcgcgggggagctcaggaggcagagcctggagcatctccactatggcctgggctccactacttctcaccctcctcgctcactgcacaggttcttgggccagtttcacgctgactcagccccatctgtgtcggagtctccgggaaagacggtaagcatctcctgcaccgnagcagtggcagcattacgtccggctagtgtgcagtggtaccagcagccgcccgggctctccccccacaccgtcactccgtgaacgacacgtaggaaacggtccctacgtcggggtccctgacgttccggttctctggtctccatccgactaccgttcctaccgtaattcctcgtccctaccctaaacgtcttctcgtcggacctacgaacgtactagggacggacggacggtctacgtaaccttaacgtaccgtgttaccgtacggtttactttttagggacggggccgtaacgtacgtttcggtccgggtttaggggttcggtttcccgggggacgggtaaccggggtaaccgaaggtaccggtaccggtaacccggttaaccgtaaccggttccgaaccggtacccggaaacggtccggttacccggtccccccgttacgggtaccctacccgtcgttaccccccg

SEQ ID NO: 237380 - DNA, 637 bp, Homo sapiens
  misc_feature: GYAE6OF02IKV3E.34.81.H04.1.454.CMB.1.raw
  modified_base (261)..(261): a, c, t, g, unknown or other
  misc_feature (261)..(261): n is a, c, g, or t
tcagtacacgtgatcacgaccggtgctcgatttagtagtgtagattcgcggggagctcaggaggcagagcctggagcatctccactatggcctgggctccactacttctcaccctcctcgctcactgcacaggttcttgggccagttttcacgctgactcagccccatctgtgtcggagtctccgggaaagacggtaagcatctcctgccacccgcagcaggtggcagctattaccgtcggctagtgtgcagtcggtaccngcagccgcccggctccttcccccaccaccgtcactccgtagaagacactagaacggtcctcgtcggggtccctgacttcggttcctcgtcggcctccgagtccgaactccgtccctactaacttctcggtaccccttccctaacgtcttcctcgtaggacgtcgtaaacgctaggaacggacgagggtctagtaacttacgttactgttccgtagtttacgtttcgggacgggtccgtaacttaccgtgtttagggttcgggttacggttacggggaccggtaacgggaacctaaggtccgtacggtacccggttacgtaacgtacgaccgacccgtaggccctaccggccccgttacggcctccgtcttccccgg

SEQ ID NO: 237381 - DNA, 702 bp, Homo sapiens
  misc_feature: GYAE6OF02IOQ08.34.81.H04.1.454.CMB.1.raw
  modified_base (306)..(306): a, c, t, g, unknown or other
  misc_feature (306)..(306): n is a, c, g, or t
tcagtacacgtgatcacgaccggtgctcgatttagtagtgtagattcgcgggggagctcaggaggcagagcctggagcatctccactatggcctgggctccactacttctcaccctcctcgctcactgcacaggttcttgggccagtttcacgctgactcagccccactctgtgtcggagtctccgggaaagacggtaagcagtctcctcgtacccgcagcagtggcagcattaccgccgctatgcgcaggtcgtaccagcacggccgccggcttccctccccactcgtcacgtccgagaacgacncgtaacgaccgtcctaggtccggtacctgtacgttccgttctcgtactccgactcgtcgtacctccgttaccttacgtaacgtttccgtaccgtaccccttaacccgaactcgtttccgttccgaaggtacctaacgtaacgggttaacgagggaacggacggtacgttacgtacgtaaccttacgttccggtacttaccggttaacgtttcggttacggaccgggtactaccgttacgttggtttacggggtggtttccgggtcgggaaccgggacgtaaccgtacgtaccggttaccgacccgtttacgaacgggtcccgaaacgtaccccggacggtccccttcccggttacccgtccgtaccgttaccctttcccggtacccctacccccgg

SEQ ID NO: 237382 - DNA, 864 bp, Homo sapiens
  misc_feature: GYAE6OF02HCAUU.34.81.H04.1.454.CMB.1.raw
  modified_base (585)..(585): a, c, t, g, unknown or other
  misc_feature (585)..(585): n is a, c, g, or t
tcagtacacgtgatcacgaccggtgctcgatttagtagtgtagattcgcggggagctcaggaggcagagcctggagcatctccactatggcctgggctccactacttctcaccctcctcgctcactgcacaggttcttgggccagtttcacgctgactcagccccatctgtgtcggtagtcgtaccggggaaagacggtaagctaagtcctacctgaccacccgcgaacgccgtaaggtcggaccaggtacctacgtttacccgggtcccgggtatttaagttcggtcgtacgacggttaccgggtaaccaaggccgtaacgggccccgggtccccggggtcctttacccccgttaccccccacccgttacccggttacacggttccccggttagaaacggaacctaccgttaaagggaaaccgggtcccctttcgggtacggggtttcccctaggttccgttccgggttttctaaccggttccgggacctacgtacgaccgtacgtcccggttaccaacccttacgtccttccgcccctacctccaatttctcggtactacggttacacgtaagcgtgaacggngtacgctacggtaacttacgtttcgtacgttacttacggtttaccgttaaggtacgggttacgtaacggtaacgttttaaaggttccgttttcggggtttaccggtacgggtttaaccggggaacgggggttacccggacggtaaccgggttccggtaaaacccgggtcccggtttttaccgggggtaaccgaacccggttaacccgtaaccccgggttaccggtaacccccgttcccccgggggtttcccccgttttaaccgggacccctttacccgg

SEQ ID NO: 237383 - DNA, 414 bp, Homo sapiens
  misc_feature: GYAE6OF01BC0CY.45.42.D09.1.454.CMB.1.raw
  modified_base (387)..(387): a, c, t, g, unknown or other
  misc_feature (387)..(387): n is a, c, g, or t
  modified_base (391)..(414): a, c, t, g, unknown or other
  misc_feature (391)..(414): n is a, c, g, or t
tcagacgcgatcgacacgaccggtgctcgatttagacacatacgcagggaaagggccgattccaccatctccagagacaattccaagaacacgctgtatctgcaaatgaacagcctgagagctgagggacacggctgtcttattactgtgcgaaagataccggaaattactatgataccactggtcaccgtgactacgtggggccagggaaccctgggttacctctcctcagcttcaccaagggcccatccggtccttccccctaggccgtccctcgcctcccgtaggactccaccctcggtcgggggccacgagccgggcccgtgggggcctggcccgtggtccaaggactacttcctatgctagtctgagcgggctggcaggcgnatgnnnnnnnnnnnnnnnnnnnnnnnn

SEQ ID NO: 237384 - DNA, 572 bp, Homo sapiens
  misc_feature: GYAE6OF01BKMCS.45.42.D09.1.454.CMB.1.raw
  modified_base (200)..(200): a, c, t, g, unknown or other
  misc_feature (200)..(200): n is a, c, g, or t
  modified_base (347)..(347): a, c, t, g, unknown or other
  misc_feature (347)..(347): n is a, c, g, or t
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccagggganacagccaccctctcctgcagggccagtaggagtgtcagtaagtacttaggctggtaccaacagaaacctggccaggcctcccaggcctcctcatccatgatgcatccaacgcgggtccctgggccgtcccagacctacgggttccgnggcaggtcgggtctggggacaggtacgttcactctcgaccgtcagcagccgtggcgtccgtgagtgtatttgctagtttacttcgtgtcagcgagtccgttccgccacgccgtctccgtacggtttccgggccgggggtaccgtaggggtcggaggtagtcggaggtacggtaacgtggtggcgtcgacgtaccgacgttctcgttccttctcgtccgttccccg

SEQ ID NO: 237385 - DNA, 442 bp, Homo sapiens
  misc_feature: GYAE6OF01CVB2O.45.42.D09.1.454.CMB.1.raw
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (392)..(392): a, c, t, g, unknown or other
  misc_feature (392)..(392): n is a, c, g, or t
  modified_base (427)..(442): a, c, t, g, unknown or other
  misc_feature (427)..(442): n is a, c, g, or t
tcagacgcgatcgacacgaccggtgctcgatttagacacatacgcagggaaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccagggaaccctggtcaccgtctcctcagcctccaccagggccccatcggtccttcccctggcgccctgcctccaggacncacctccgagngcacagccggccctgggctgcctggtcaaggctacttccncgatcgcgtctgagcgggctggcaaggcgcatagnnnnnnnnnnnnnnnn

SEQ ID NO: 237386 - DNA, 492 bp, Homo sapiens
  misc_feature: GYAE6OF01BHCOE.45.42.D09.1.454.CMB.1.raw
  modified_base (355)..(355): a, c, t, g, unknown or other
  misc_feature (355)..(355): n is a, c, g, or t
  modified_base (465)..(492): a, c, t, g, unknown or other
  misc_feature (465)..(492): n is a, c, g, or t
tcagacgcgatcgacacgaccggtgctcgatttagacacatacgcagggaaaggggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctatttctgtgccagggggacatctatgagtctggttcgtagtgtaatcaactactactacctcatggacgtctggggcaaagggacctcggtcaccgtctccgcagcttccaccgaggcccatcggtcttcccctggcgcctgcctccaggnccacctcgtgggggcacgaggccggcccgtgggctcggcccgtggtaccgaaggtacctacttcctcgatccgcgtcgtgaggcgggctgggacaagggccgacagtagnnnnnnnnnnnnnnnnnnnnnnnnnnnn

SEQ ID NO: 237387 - DNA, 801 bp, Homo sapiens
  misc_feature: GYAE6OF01BMTOT.45.42.D09.1.454.CMB.1.raw
  modified_base (203)..(203): a, c, t, g, unknown or other
  misc_feature (203)..(203): n is a, c, g, or t
  modified_base (317)..(317): a, c, t, g, unknown or other
  misc_feature (317)..(317): n is a, c, g, or t
tcagacgcgatcgacacgaccggtgctcgatttagacacatacgcaggggaaagggggaggaactgctcagttaggacccagacggaaccatggaagccccagcgcagcttctcttcctcctgctactctggctcccagattccacgggagaaatagtgatgacgcagtctccagccaccctgtctgtgtctccaggggaaangtccaccctctcctgcagggccagccagagtgtcagcagcgtacttagcctggtaccagcaacgaaaccgtggccaggcctccaggcctcctcatctagtcggtcgcctttccnccgacgggtcccacgttcggtactcccgagtcctacggttcaggttcggcgtagggttcggggtaccgtcggggtaacctacggtccggtttttaacctccgttaccgaacccctagttacccaaaccgtaccggtacccctaccgtacggtttaccttacggtaaacgtttacgtttttacgacctttaaggtttttacctttaaccgtttacgtaacccgtaaacccgtagtttaaacgttaaacgtttaacggttacgggttaccccgttaccgggtttaccggggttaaccggtttacccggggtaacccggtaaaacgggggtaacccgtaaacggggttaacgggtaaaaaccggttaaccggtaaaaaccggttaaaccgggttgggttacgggaccgtttacggacccgtaaccgtaaacgttttccgtaccggttttactttaccccgtacgtttaccccgttccccgttacccg

SEQ ID NO: 237388 - DNA, 821 bp, Homo sapiens
  misc_feature: GYAE6OF01A6IFE.45.42.D09.1.454.CMB.1.raw
  modified_base (620)..(620): a, c, t, g, unknown or other
  misc_feature (620)..(620): n is a, c, g, or t
tcagacgcgatcgacacgaccggtgctcgatttagacacatacgcagggaaagggggaggaactgctcagttaggacccagacggaaccatggaagccccagcgcagcttctcttcctcctgctactctggcctccagtacttccgacgggagaaagtagtgatgacgcagtcctccacgcccacctgtctctcgtctccggagggacacacgccctaccctctacgtcgacgacgggtcctaggtaggtagtcgttacgaaggttaacgttacggttacggtacgttacgggaaaccctaaacggaaccgtaaaccgtcgggacgaaccggtccgtacccgacggtacccttcccgtactactacccgtaagtcggtaacctcggacctaacgtaacccgaacggtccggtccgtaccggtaccgtacccgtaacgtacgtcggtttcgacggtcgtacggttcgggtcgtacgggacaggttacgtaaccgtcgtacccgttaccgaccggttaacgaccggtacggtaacccggttcggtacccgggtttaccacccgggtagttacgttagtttacccgttgtaacggtttaactttccgtagttccgtagtaccncgttacgtccgtcaccgtaccgtcgtaaccgttcggtaccgggggttaccgggggtacggtacggtacggggtacgtaacggttacggacgggtaaaccggtaccgttaacggtcgggtaccggtaccgttaacccgggacttcccgtttaaacggttccgttaacgtcccgtttcccggtaaccgtttccgtacccccgg

SEQ ID NO: 237389 - DNA, 766 bp, Homo sapiens
  misc_feature: GYAE6OF01A0N4S.45.42.D09.1.454.CMB.1.raw
  modified_base (202)..(202): a, c, t, g, unknown or other
  misc_feature (202)..(202): n is a, c, g, or t
  modified_base (459)..(459): a, c, t, g, unknown or other
  misc_feature (459)..(459): n is a, c, g, or t
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatgtgatgacgcagtctccagccaccctgtctgtgtctccgaggggaaancgtccaccctctcctgcgagggccagccaggagtgtcagccagcgtacttagccgtggtaaccagaccgaacgtaaacccgtgggacccacggccctacccgaggtcccctacctactacgtcgtacgtgggtcctcctttccctccggaccgggtaccctacggttcggtaacctccccgaggtcccgtaaggtttccgaggtcggaccgtagggttcggggtaccgtggggaacctacggtttacccgttttacncccgttaccaacccgtagttacccgaacgtccgtacgtcccgtagtccgtacgttaccgtaggttaaacgttagttttacggtacgtttacgtttttacgtttccgttagtttaccgtaagtaccgtacgttaacgttacgtaacgtttaacggtcgttaacgttcggttaaccgtttagggtttccggaaccggtaacggggtaaccgtaacggtaacggttaacggtaaacgttaccggaaaacggttccgtaacggtacgggtacctaacggacccttaacgtacccgttcgttcgtttacccg

SEQ ID NO: 237390 - DNA, 430 bp, Homo sapiens
  misc_feature: GYAE6OF02HE7RW.45.42.D09.1.454.CMB.1.raw
  modified_base (425)..(430): a, c, t, g, unknown or other
  misc_feature (425)..(430): n is a, c, g, or t
tcagacgcgatcgacacgaccggtgctcgatttagacacatacgcagggaaaggggctggagtgggtgggtctcattagaagcaaagcttctgggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccagggaaccctggtcaccgtctcctcagcctccaccaagggcccatcggtcttccccctggccgccctgctccaggagcacctccgagacgcacagcggccctgggctgcctggtcaaggctacttcctcgatcgcgtctgagcgggctggcaaggcgcatagnnnnnn

SEQ ID NO: 237391 - DNA, 739 bp, Homo sapiens
  misc_feature: GYAE6OF02G67BX.45.42.D09.1.454.CMB.1.raw
  modified_base (202)..(202): a, c, t, g, unknown or other
  misc_feature (202)..(202): n is a, c, g, or t
  modified_base (311)..(311): a, c, t, g, unknown or other
  misc_feature (311)..(311): n is a, c, g, or t
  modified_base (417)..(417): a, c, t, g, unknown or other
  misc_feature (417)..(417): n is a, c, g, or t
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccaggggaaanagtccaccctctcctgcagggccagccagagtgtcagcagcgacttagcctggtaccagcaacgaaacctggacccaggcctcccgaggcctcctcatcctatgggtcnccttccgtccgagggccctacgttggtactccccaggacccgtaggtttaccaggttcggcgtagggttcggggtcgttaggggacctagggttccgtttttaccnccgttaccaacccgtattaccccgaaacgtaccggtccccttaccgtaacggttccttaacgggtaaacgtttacgttttttacggaccgttttaaggtttttaactttaccgttaggttaccctaaaccgttaagtttaacttaaagttaacggttcggtaccccgttaccggtacgggttaccgtttccgggaacccgtaaaggggtacccgtaaagggtacggtaaactaccggtaaacgttaacgtacgggtacggtccgtacgaccctaaccgtagttccgttacggttaccttaccacgtttcccttaccccgtac

SEQ ID NO: 237392 - DNA, 436 bp, Homo sapiens
  misc_feature: GYAE6OF02IK36B.45.42.D09.1.454.CMB.1.raw
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
  modified_base (423)..(436): a, c, t, g, unknown or other
  misc_feature (423)..(436): n is a, c, g, or t
tcagacgcgatcgacacgaccggtgctcgatttagacacatacgcagggaaaggggctggagtgggtgggtctcattagaagcaaagcttctgggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccagggaaccctggtcaccgtctcctcagcctcaccagggcccatcggtcttcccctggccgccctgctccaggncacctcgagngcacagccgcctgggctgctggtcaaggactacttcctcgatcgcgtctgagcgggctgggacagggcgcatacgnnnnnnnnnnnnnn

SEQ ID NO: 237393 - DNA, 598 bp, Homo sapiens
  misc_feature: GYAE6OF02IRX3U.45.42.D09.1.454.CMB.1.raw
  modified_base (311)..(311): a, c, t, g, unknown or other
  misc_feature (311)..(311): n is a, c, g, or t
tcagacgcgatcgacacgaccggtgctcgatttagacacatacgcagggaaagggggaggaactgctcagttaggacccagacggaaccatggaagccccagcgcagcttctcttcctcctgctactctggctcccagataccaccggagaaattgtgttgacacagtctccagccaccctgtctttgtttccaggggaaagagccaccctctcctgcacgggccagtcagggtgttaacagctacttagcctggtaccaaacaaaaacctggccaggctcccaggctcatcatctatgacgcatcgaacngggccacgtggcactcccagccaggttcaggtgcaggtgggtctgggacagtacttcactctcaacctatacacgctacgcccgtcggaacccgtggaacggtacttttcgaccttactttaactactgtcagacaggtcgtggaccgaccgagccgctctacgtttccgggacgggtacgggaaccaaagggttgggaacgtaacgtacgaaaacgtacgtaggtacgggtctacggtacaaccgtacgtacgttcgtcttaccactttcccgttcccgacctacg

SEQ ID NO: 237394 - DNA, 609 bp, Homo sapiens
  misc_feature: GYAE6OF02FZZ4I.45.42.D09.1.454.CMB.1.raw
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
tcagacgcgatcgacacgaccggtgctcgatttagacacatacgcagggaaagggggaggaactgctcagttaggacccagacggaaccatggaagccccagcgcagcttctcttcctcctgctactctggctcccagagacctccggagaaattgtcttgacacagtctccagccattctgtctctctctccgagggganacagccaccctctcatgcagggccagtcagagtattagaacatacttggcctggtatcaatacaancctggccaggtccccgntccncntctatgatgcttcagcacggccacgtggacactcccagccaggttcaggtggcggtgggtttgctagagtacttcactntcacatcancacgcctaccaactgaaacgttatttcgactagttacttaattacttacgtactaacaggtacgttaacgaagtacgtttacgggccgtcttaccgttacgtttaccgggaccgggaacgggtaaccgtaggggttagaacggtaacggtaaaccgtaaaaccggtaaccgttacgggttacggaccgttacggaacccgtaaccgtacggttaccctttacggttaaccg

SEQ ID NO: 237395 - DNA, 201 bp, Homo sapiens
  misc_feature: GYAE6OF01C1OFE.48.15.B04.1.454.CMB.1.raw
  modified_base (193)..(201): a, c, t, g, unknown or other
  misc_feature (193)..(201): n is a, c, g, or t
tcagagtatacatacacgaccggtgctcgatttagacagtatatatccgcgggcacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagnnnnnnnnn

SEQ ID NO: 237396 - DNA, 202 bp, Homo sapiens
  misc_feature: GYAE6OF01BAUXY.48.15.B04.1.454.CMB.1.raw
  modified_base (190)..(202): a, c, t, g, unknown or other
  misc_feature (190)..(202): n is a, c, g, or t
tcagagtatacatacacgaccggtgctcgatttagacagtatatatccgcgggcacgaccggtgctcgatttagcactcgcacgttggttggaccaaggtggaagtcaaacgaactgtggctgcaccatctgtcttcatcttcccgccatctgatatgtatactctgagcgggctggcaaggcgcatagnnnnnnnnnnnnn

SEQ ID NO: 237397 - DNA, 211 bp, Homo sapiens
  misc_feature: GYAE6OF01CZ66V.48.15.B04.1.454.CMB.1.raw
  modified_base (191)..(211): a, c, t, g, unknown or other
  misc_feature (191)..(211): n is a, c, g, or t
tcagagtatacatacacgaccggtgctcgatttagacagtatatatccggcgggcacgaccggtgctcgatttagcactcgcacgttggttggaccaaggtggaagtcaaacgaactgtggctgcaccatctgtcttcatcttcccgccatctgatatgtatactctgagcgggctggcaaggcgcatagnnnnnnnnnnnnnnnnnnnnn

SEQ ID NO: 237398 - DNA, 510 bp, Homo sapiens
  misc_feature: GYAE6OF01BGP4T.48.15.B04.1.454.CMB.1.raw
  modified_base (335)..(335): a, c, t, g, unknown or other
  misc_feature (335)..(335): n is a, c, g, or t
  modified_base (372)..(372): a, c, t, g, unknown or other
  misc_feature (372)..(372): n is a, c, g, or t
  modified_base (505)..(505): a, c, t, g, unknown or other
  misc_feature (505)..(505): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcgggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaaactactcatttactcgcatccaccggaagtccgaggttccngaccgattccgtggcagcggtctgggacagatttacnctcaccatcactaccctgcagctgaagatgtggctagtttatactgtacaactaatattattctactccgcgtacgtcgccggggacaacgtgaaatcgaaacgaactggtggctgaccaccatctcgtcttntaccg

SEQ ID NO: 237399 - DNA, 328 bp, Homo sapiens
  misc_feature: GYAE6OF01DE0NS.48.15.B04.1.454.CMB.1.raw
  modified_base (324)..(328): a, c, t, g, unknown or other
  misc_feature (324)..(328): n is a, c, g, or t
tcagagtatacatacacgaccggtgctcgatttagacagtatatatccgcgggcacgaccggtgctcgatttagacagtatatatccgcgggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctcgttcccgccctcctctatgtatactctgagcgggctggcaaggcgcatagnnnnn

SEQ ID NO: 237400 - DNA, 193 bp, Homo sapiens
  misc_feature: GYAE6OF01AIFP7.48.15.B04.1.454.CMB.1.raw
  modified_base (193)..(193): a, c, t, g, unknown or other
  misc_feature (193)..(193): n is a, c, g, or t
tcagagtatacatacacgaccggtgctcgatttagacagtatatatccgcgggcacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagn

SEQ ID NO: 237401 - DNA, 674 bp, Homo sapiens
  misc_feature: GYAE6OF01EHTPF.48.15.B04.1.454.CMB.1.raw
  modified_base (342)..(342): a, c, t, g, unknown or other
  misc_feature (342)..(342): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagaccggccaccatcaactgacaagtccagccagtagttgttttcacacctccatgaacaaggagtacttggcttggttccagcagaaaccagggcagcctacctaaactactctatttactcgcactccaccggaagtccgagttccngaccgtattccgtgcaggcggtctgggactagtacttttacgctcaacctataccaccttacccgtgacgacggcttaggaagcgttggtggacctttaaggtttttacttaacgttacggtaacctaaaacgtaatttaacgtttaacttccgttaacccgttcccggtacccggtaacccggttttacccgggggaccccggggggtaaaccctaaaccggggttaaggtaaaaaccgttacccgaaaaacggtaaccgttcggggttaccggacgttaccgggaacctaacccgtaacttcgtttccggtttaccttccgttaaccccg

SEQ ID NO: 237402 - DNA, 160 bp, Homo sapiens
  misc_feature: GYAE6OF01DX8R4.48.15.B04.1.454.CMB.1.raw
  modified_base (157)..(160): a, c, t, g, unknown or other
  misc_feature (157)..(160): n is a, c, g, or t
tcagagtatacatacacgaccggtgctcgatttagacagtatatatccgcgggatttagacagtatatatccgcgggcacgaccggtgctcgatttagagagagtgtgttgggtttggggtttttaggtatctgagcgggctggcaaggcgcatagnnnn

SEQ ID NO: 237403 - DNA, 858 bp, Homo sapiens
  misc_feature: GYAE6OF01B8ALA.48.15.B04.1.454.CMB.1.raw
tcagagtatacatacacgaccggtgctcgatttagacagtatatagtccgcgggggagctacaacaggcaggcaggggcagcaagatggtgttgcacgacccaggtcttccatttctctgttgctctggatctctggtgcctgcgggacatcgtgatgacccagtctccagactccctggcctgtgtctcgtgggcgagtaccggccaccatcaactgacaagtccagccagacgtagttttcacctacctcctatacgaaaccaaggacgtaacgttggctttggttccaggccaagaaaccgtaggggctaacggtacccttaaccgttaaaacgttactaccgtaattttacccgtccgggacctaaccgttaccccgaacccgggtaacgttcccggtaacggtttcccctacggaacccgtacgttcccggtagggacccgtaacgggtaccggggttaccgtacgggggtaacctaaacggttaacttttttaacccgtaccgttaccgaaacccgtacgttacccgtaaccccgttaaccccgtgggaacccgaacggggtaccttaagggaaacggtaactttacgggttacggtaccgttaacggtttttaactttaacccgtacggttaaccaaaccgttaaagttacttttaacgtttccgttaaacccgttcccggttacccgggttaacgggttttacccggggaaccccggggggttaacctaaaccggggttacgggaaaaaccgttaccggaaaaccggtaaccgttacgggttacgggtaccttaccggacccgtaaacccgtaacgttcccggttaccggttccgtttacccgtaacccg

SEQ ID NO: 237404 - DNA, 571 bp, Homo sapiens
  misc_feature: GYAE6OF01CK8ZQ.48.15.B04.1.454.CMB.1.raw
  modified_base (309)..(309): a, c, t, g, unknown or other
  misc_feature (309)..(309): n is a, c, g, or t
  modified_base (372)..(372): a, c, t, g, unknown or other
  misc_feature (372)..(372): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggtccagcagaaaccagggcagcctactaaactactcatttacncgcatccaccggaagtcgagttcctgaccgattccgtggcagcggtctgggacagtatttacnctcaccatcactaccctgcaggctagaagatgtggactagtttattactgtaccaaactaattaatttacttacttaacctccggtacccgaaccggtttcgggacccgggggaaccgtaaaccggtagggtaaaactaccgtaaaaccggaaactacggtgggccttgaccgtaacccattaccttcgtcttctaccg

SEQ ID NO: 237405 - DNA, 656 bp, Homo sapiens
  misc_feature: GYAE6OF01DDVLQ.48.15.B04.1.454.CMB.1.raw
  modified_base (359)..(359): a, c, t, g, unknown or other
  misc_feature (359)..(359): n is a, c, g, or t
  modified_base (641)..(641): a, c, t, g, unknown or other
  misc_feature (641)..(641): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatgacccagtctccagacctccctggctgtgtctcgtgggcgagacggccaccatcaactgcaagtccagccagagttcgtttttcaacaccaaccaatagaagaagaactaacttagcttggtaccagcagacgaccagaccaacctcctaagtgcttctttacgtggtcgtccgttcccgggagtcccgggtcctcgaccgtntcagtcgccgacggcggtcgtagggacacggtacttccgactcctaccgaccctagtccgacggtccggcccttggaccgaagggtccttaggaacgtagtggtacgggcttaaggtttttactacgtcgtacacggtctacgtttggtttccgggtaccggtttccttacccgggttaccgttttccggggacggtaacggggaccctaaaagggggtcggtaaacgggtaacccgaaaacggtacgttcgggacggttccgtacggtacctaaacccgtnttccgttgttacccg

SEQ ID NO: 237406 - DNA, 261 bp, Homo sapiens
  misc_feature: GYAE6OF01D9WAK.48.15.B04.1.454.CMB.1.raw
  modified_base (259)..(261): a, c, t, g, unknown or other
  misc_feature (259)..(261): n is a, c, g, or t
tcagagtatacatacacgaccggtgctcgatttagacagtatatatccgcgggcacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnn

SEQ ID NO: 237407 - DNA, 599 bp, Homo sapiens
  misc_feature: GYAE6OF01C2JEC.48.15.B04.1.454.CMB.1.raw
  modified_base (312)..(312): a, c, t, g, unknown or other
  misc_feature (312)..(312): n is a, c, g, or t
  modified_base (381)..(381): a, c, t, g, unknown or other
  misc_feature (381)..(381): n is a, c, g, or t
  modified_base (390)..(390): a, c, t, g, unknown or other
  misc_feature (390)..(390): n is a, c, g, or t
  modified_base (413)..(413): a, c, t, g, unknown or other
  misc_feature (413)..(413): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcacacctccatgaacaaggagtacttggcttggttccagcagaaaccagggcagcctacctaaactactctatttacncgcactcccaccggagtccgagttcctgaccgtattccgtggcaggcggtctgggacagtacttttacnctcacttanccactaccctgcaggctagaagntgtgctagtttattactgtacaactaattattacttcctaccgtcccgtaccgtaccggttccgggacccgggggtaaccctaacgggtacggaaaacttaccggaaaaaccggtaacgttacgggtcgggtaccgtacggtaccctaaccctaagtttcccttacggtttcctttcccgtacccg

SEQ ID NO: 237408 - DNA, 523 bp, Homo sapiens
  misc_feature: GYAE6OF01AMNA4.48.15.B04.1.454.CMB.1.raw
  modified_base (146)..(146): a, c, t, g, unknown or other
  misc_feature (146)..(146): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
  modified_base (457)..(458): a, c, t, g, unknown or other
  misc_feature (457)..(458): n is a, c, g, or t
  modified_base (460)..(461): a, c, t, g, unknown or other
  misc_feature (460)..(461): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (517)..(518): a, c, t, g, unknown or other
  misc_feature (517)..(518): n is a, c, g, or t
  modified_base (521)..(522): a, c, t, g, unknown or other
  misc_feature (521)..(522): n is a, c, g, or t
tcagagtatacatacacgaccggtgctcgatttagacagtatatatccggcgggcacgaccggtgcttcggactttagacacgtatagtaatcccgcggggcacgaccggtgctcgactttacgatcgtctgtgtggtttcggggntgtcggctcactaccgcctttgacgaggactcgacttactacctcgtcacgtcttttgataaccaacgaaatcacgtcggtcctttcggccggtagggaccaggcctgaccgtccgtagtcagcccaaaggctagtcccctcggtcgacctactgttacccaccctccgtcctaagttcgtagtactctcgtagcgggtactcggtcgaaacggccggctactaagggcacngcgccagcngtcancgcgtgcgngcncncncncncncncncncncncncgcncncncncanacnctcnctntatctncnncnncncncncncncncgtcgcgcgcgacgacgagcgcacacgcgngncncncncncncnnctnnc

SEQ ID NO: 237409 - DNA, 730 bp, Homo sapiens
  misc_feature: GYAE6OF01EMH9G.48.15.B04.1.454.CMB.1.raw
  modified_base (308)..(308): a, c, t, g, unknown or other
  misc_feature (308)..(308): n is a, c, g, or t
  modified_base (443)..(443): a, c, t, g, unknown or other
  misc_feature (443)..(443): n is a, c, g, or t
tcagagtatacatacacgaccggtgctcgatttagacagtatatatccgcgggggagctacaacaggcaggcaggggcagcaagatgggtcgttgcagacccaggtcgttcatttctctgttgctctggatctctggtgcctgcgggacatcgtgatcgacccagtctccagacctccctggctgtcgtcgtcgtgggcgagaccgccaccatcaactgcaagtccaagccagagtgttttacactacctccatacgaaacaaggacgtacgttcggcctttaggttcccagtactaacgaaaaccgnggggccacgccctacctaaactacgtcactttacgcggcagtcccgaaccgggtaagtcccggaggttcccaggtacccgtattcccggtagggacctaggtccgggttctacggggactacggtacttttaccnctaccaacctattccaaccttaccccgttgaccgtaaggtctaaggaaacgtagttcggtacggtaccttaagttttaacttaacgttacggtaacctaaacgttaaacttagtttaacgttaccgtaaccgttacccggtaccgtaaccgggtttaccggggaccgggggttaaccctaaacgggttagggtaaaaacttacccgaaaaaccggtaacgttcgggttacggtacccttacggacccctaacccgtaacgttccttacggtttaccttacgtaaccc

SEQ ID NO: 237410 - DNA, 194 bp, Homo sapiens
  misc_feature: GYAE6OF01DM4UZ.48.15.B04.1.454.CMB.1.raw
  modified_base (193)..(194): a, c, t, g, unknown or other
  misc_feature (193)..(194): n is a, c, g, or t
tcagagtatacatacacgaccggtgctcgatttagacagtatatatccgcgggcacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagnn

SEQ ID NO: 237411 - DNA, 553 bp, Homo sapiens
  misc_feature: GYAE6OF01DQKM0.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagccctacctaaactactctatttactcggcatcccacccggaagtccgaggttcctgaccgattccgtggcaggcgggtctgggacagtattttactctcacctatccactaccctgcaggctagaagatgtggctagttttatactgtacaactaattattattcctactccgccgtacggtttccgggaccggggtaacctaacggtaggaaataccgaaaacggaacttggtcggcctgaccaccctattctgtcttctaccg

SEQ ID NO: 237412 - DNA, 590 bp, Homo sapiens
  misc_feature: GYAE6OF01APOEI.48.15.B04.1.454.CMB.1.raw
  modified_base (437)..(437): a, c, t, g, unknown or other
  misc_feature (437)..(437): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccaggcagcctacctaaactactctatttactcggcactcccgaccggaacgtccgacggttcctagaccgtattccggtggccaggcgggtcgtgggactaggtacttttactctaccacctatccaccttaccccgtgaccaggtcctaggaaagtnttcggtggctaggtttattacgtagtacaaactaattatttacttctaacctccgaccgtaccggttccgggacccggggaacctaacggtacggaaactccgaaaacggtacttggtcggacctgacctacctattccgtgttccttctacg

SEQ ID NO: 237413 - DNA, 567 bp, Homo sapiens
  misc_feature: GYAE6OF01B0EAH.48.15.B04.1.454.CMB.1.raw
  modified_base (316)..(316): a, c, t, g, unknown or other
  misc_feature (316)..(316): n is a, c, g, or t
  modified_base (422)..(422): a, c, t, g, unknown or other
  misc_feature (422)..(422): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagacctccctggctgtgtctctgggcgagaccggccaccatcaactgcaagtccagccagagttgttttcacacctccatgaacaaggagtacttggcttggttccagcaagaaaccagggcagccctacctaaactactacatttacncgcactcccaccggaagtccgagttcctagaccgtattccgtgcaggtcggtctgggactagtactttactctcacctatccactaccctgacaggtctaggaatntgtggctagtttattactgtacaactaattacttattcctactcccggaccgtacggttccgggaccggggacctaacggtaggaaactccgaaaacggtagtcggtcggacttacggacctaccgtattcctcgttcttctacc

SEQ ID NO: 237414 - DNA, 370 bp, Homo sapiens
  misc_feature: GYAE6OF01AZBW4.48.15.B04.1.454.CMB.1.raw
  modified_base (101)..(101): a, c, t, g, unknown or other
  misc_feature (101)..(101): n is a, c, g, or t
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (292)..(296): a, c, t, g, unknown or other
  misc_feature (292)..(296): n is a, c, g, or t
  modified_base (298)..(298): a, c, t, g, unknown or other
  misc_feature (298)..(298): n is a, c, g, or t
  modified_base (300)..(307): a, c, t, g, unknown or other
  misc_feature (300)..(307): n is a, c, g, or t
  modified_base (309)..(310): a, c, t, g, unknown or other
  misc_feature (309)..(310): n is a, c, g, or t
  modified_base (312)..(370): a, c, t, g, unknown or other
  misc_feature (312)..(370): n is a, c, g, or t
tcagagtatacatacacgaccggtgctcgattttagacagtatataagtaccggcgggcacgaccggtgctcgatttagatcgttgtgttggttgggggtntggtggtctcccactcccgccttgaccgaggctgatttacgactgtcagtcttttgataacacaatcacgtgtcttcggcgagggaccagcctgaccgtctaggtccagcccaaggctgccccctggtcactctgttcccacctctctatgtaataactctgagtcgggntggcaaggcgacatagncncnnnnngnannnnnnnncnncnnnnnnnnnnnnnnnnnnnnnnnnnnnnnnnnnnnnnnnnnnnnnnnnnnnnnnnnnnn

SEQ ID NO: 237415 - DNA, 607 bp, Homo sapiens
  misc_feature: GYAE6OF01CNVMM.48.15.B04.1.454.CMB.1.raw
  modified_base (296)..(296): a, c, t, g, unknown or other
  misc_feature (296)..(296): n is a, c, g, or t
  modified_base (326)..(326): a, c, t, g, unknown or other
  misc_feature (326)..(326): n is a, c, g, or t
  modified_base (356)..(356): a, c, t, g, unknown or other
  misc_feature (356)..(356): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
  modified_base (428)..(428): a, c, t, g, unknown or other
  misc_feature (428)..(428): n is a, c, g, or t
tcagagtatacatacacgaccggtgctcgatttagacagtatatagtccgcgggggagctacaacaggcaggcaggggcagcaagatggtgttgcagacccaggtcttcatttctctgttgctctggatctcgtggtgcctgcggggtacatcgtgattgacccagtctccagactccctggctgtgtctcgtgggcgaggacggccaccgatcaactggccaagtccagccagtagttgttttcacacctccagtgaacaaggtagtacttggcttggttccagcacgaaaccgngggcagccgtactaaactctctagtttacncggacatccgaccggaagtccgaggttccngaccgtattccgtgcaggcggtctgggactaggtattttacnctcactntccactaccngacagctagaatntggtgctagttttactacgtgtaactaactaattacttaactttccgaccgttccggacccgtaggttccggggaacccgggggtaacctaaacgggttacggaaactaccggtaaaacggaacgttaggtacggtccgtagaccgtaaacccgagttacttacgtcctttcgtaaccg

SEQ ID NO: 237416 - DNA, 517 bp, Homo sapiens
  misc_feature: GYAE6OF01CX1ZK.48.15.B04.1.454.CMB.1.raw
  modified_base (310)..(310): a, c, t, g, unknown or other
  misc_feature (310)..(310): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (388)..(388): a, c, t, g, unknown or other
  misc_feature (388)..(388): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggtccagcagaaaccagggcagcctacctaaactactctatttacncgcatccaccggagtccgagttcctgaccgattccgtgcagcggtcngggacagtatttacnctcaccatcactaccngcaggctagagtatgtgctagtttactactgtacaactaattatttattctactccgccgtacgttcggaccggggaccaacggtgaaactacgaaacgtatgtcggctgcacctatctcgtcttctac

SEQ ID NO: 237417 - DNA, 215 bp, Homo sapiens
  misc_feature: GYAE6OF01DE3SL.48.15.B04.1.454.CMB.1.raw
  modified_base (201)..(215): a, c, t, g, unknown or other
  misc_feature (201)..(215): n is a, c, g, or t
tcagagtatacatacacgaccggtgctcgatttagacagtatatatccgcgggcacgaccggtgctcgatttagtcgagctctctcgcggcacgaccggtgctcgatttagtcacgcgagaagggaaggggctggccctgacgtgtttctgttcccgccctcctctatgtatactctgagcgggctggcaaggcgcatagnnnnnnnnnnnnnnn

SEQ ID NO: 237418 - DNA, 590 bp, Homo sapiens
  misc_feature: GYAE6OF01B85B0.48.15.B04.1.454.CMB.1.raw
  modified_base (312)..(312): a, c, t, g, unknown or other
  misc_feature (312)..(312): n is a, c, g, or t
  modified_base (397)..(397): a, c, t, g, unknown or other
  misc_feature (397)..(397): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctcgtgggcgagacggccaccatcaactgcaagtccagccagagttgttttcacacctccatgaacaaggagtacttggcttggtccagcagaaccagggcagcctacctaaactactactatttacncggcactccaacccggaagtccgtacggttcctagacccgtattcccgtggcgaacggtcgggtctcgggactagtattttaccnctacaccatacacctaccctgccgaggtctaggaacgatcggtggtctagtttatactgtacaacaattattacttactacgtcccgaccggtaccggttccggtacccgggggaacctaaccggtagaaaaccgttaccgaaacgtaacgtggtcggacgtcgacctacacttactcgttccttctaacccg

SEQ ID NO: 237419 - DNA, 701 bp, Homo sapiens
  misc_feature: GYAE6OF01CFA91.48.15.B04.1.454.CMB.1.raw
  modified_base (326)..(326): a, c, t, g, unknown or other
  misc_feature (326)..(326): n is a, c, g, or t
  modified_base (360)..(360): a, c, t, g, unknown or other
  misc_feature (360)..(360): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagacctccctggctgtgtctcgtgggcgagaccggccaccatcaactgacaagtccacgccagtagttgttttcactacctccatagaacgaaggtagtacttggtctttggtccagacagaaaccagggcacgcctacctaaactctactactttacncgctactcccgaccggtaagtccgtacggttccngaccgtacttccggtggcaggtccgggtcgtacgggactaggttactttactctacacctatcctaacctacccgtgactacgggtactaggaagtacgttggtacggtacttaagttttacttacgttacgtaacctaaaacgttaatttaacttttacttacccgttaaccgtccccggtacccgggttaaccgggtttacccggggggaccccgggggtaaacccttaaccgggttaacgggtaaaaaccttaacccgaaaaaccggtaacgttacgggttacgggtaccttacgacccgtaaccctagttaccctttacggttccttcctaacccgg

SEQ ID NO: 237420 - DNA, 558 bp, Homo sapiens
  misc_feature: GYAE6OF01EEU8J.48.15.B04.1.454.CMB.1.raw
  modified_base (387)..(387): a, c, t, g, unknown or other
  misc_feature (387)..(387): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcacacctcatgaacaaggagtacttggcttggttccagcagaaaccagggcacgcctacctaaactactacatttactcgcactcccgaaccggagtccgaggttcctgaccgtattccgtggcgaggtcggtctgggactagtacttttacnctcacctatccactacctgcaggctgaatgtgtggcttagtttactactgtacaactaattattactcttactcccgacgtacggttccgggaccggggtaaccaacgggtacgaaaatacgaaaacggttactggtcggacctggaccctacagttctcgttctcgtacc

SEQ ID NO: 237421 - DNA, 533 bp, Homo sapiens
  misc_feature: GYAE6OF01BMCHB.48.15.B04.1.454.CMB.1.raw
  modified_base (310)..(310): a, c, t, g, unknown or other
  misc_feature (310)..(310): n is a, c, g, or t
  modified_base (350)..(350): a, c, t, g, unknown or other
  misc_feature (350)..(350): n is a, c, g, or t
  modified_base (412)..(412): a, c, t, g, unknown or other
  misc_feature (412)..(412): n is a, c, g, or t
  modified_base (434)..(434): a, c, t, g, unknown or other
  misc_feature (434)..(434): n is a, c, g, or t
  modified_base (451)..(451): a, c, t, g, unknown or other
  misc_feature (451)..(451): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcacgcctcctaaactactcatttacncggcatccaccggaagtcctaggttcctgaccgattccgnggcagcgggtctgggactagtacttttacgtctacaccataccactaccctgcagctagaantgtgctagttatactgtacaanaagttattatcttaccnccgtccgtacgttcggaccggggactaacggtgaaaactcgaaacgtactacggtggcctgactaccatctctcttctaccg

SEQ ID NO: 237422 - DNA, 565 bp, Homo sapiens
  misc_feature: GYAE6OF01B5BJA.48.15.B04.1.454.CMB.1.raw
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
  modified_base (387)..(387): a, c, t, g, unknown or other
  misc_feature (387)..(387): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagtagttgttttcacacctccatgaacaaggagtacttggcttggttccagcagaaccgaggcagcctacctaaactactctatttacncgcactcccacccggaagtccgaggttcctgaccgnttccgtggcaggcggtctgggacagtatttactctcacntaccactaccctgcaggtctagaagtgtgtggacttagttttatactgtaccaataattattattcctacctcccgtaccgtacggttccgggacccggggtaacctaacggtaggaaactaccgaaaacgtacgtggtcgcttagcctaaccctataccttcggttccttcctaccg

SEQ ID NO: 237423 - DNA, 661 bp, Homo sapiens
  misc_feature: GYAE6OF01EJKNT.48.15.B04.1.454.CMB.1.raw
  modified_base (459)..(459): a, c, t, g, unknown or other
  misc_feature (459)..(459): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatcgacccagtctccagacctccctggctgtgtctcgtgggcgagacggccaccatcaactgacaagtccagccagagttgtttcacacctaccatagaacaaggattacgttggtacttcggtaccagacaacggaaaccgaggcacgtcctacctaactactactattactcgctacgtcccaaccggacgtccgaggttccacgaccgtacgttccgtggaccgaggccggttacgtcgggtactagtactttacctcgtacacctatacctaccttaccgtgactaggaccgttagaagtntaggtacggtacttaacgttttacttaacgtacgtaaccaaacgttaattaactttaccttcctaccttacccgggtaccgtaaccgggttccggggaacccggggtaaccgaacggtaacggtaaaacctaccgaaaccgtagtcggttcgggaccttcggacctaccgttacttaccgttacggttccctttagtacccg

SEQ ID NO: 237424 - DNA, 803 bp, Homo sapiens
  misc_feature: GYAE6OF01DSGSH.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacagtcgtgatcgacccagttctccagacctccctggctgtgtctcgtgggcgaggaccggccaccatcaactgacacgtccacgccagtagtttcgttttcacctacctccatagaacaaggtacgtacgttgcgtttcggttaccagaccaagaaaccgagggaccacggtccctaaccgtaaacttctacttacgtttaccgtacggtcctaacgtacccgacccgggtaacgttcccggtaacggtttacccgtacggtaacccgttacgttcccggtcgggacctacggggtccgggttacgtacgggtaacctaaggtttacttttacccgaccttaaccgtaaccctacttacctaacccccgtttaccgtacggaccgtaacgtaccgttaaggtaaacggttacgtaggttacggtaactttaagtttttaaccgtaaccgtttagtaaacctaaaattaacgtttaactttaccgttaacgttaccccgtaccggacccgggtttaccgggtaccgggggacccgggttaaacccgtaaggttaaccgtaaaacgttaaccgtaaaaccggttacggtagggttcccgacggttaaccgtaacccgtaacgtacgtttcccgtaacgtttcccgttaaccgtacccg

SEQ ID NO: 237425 - DNA, 540 bp, Homo sapiens
  misc_feature: GYAE6OF01DRFD3.48.15.B04.1.454.CMB.1.raw
  modified_base (310)..(310): a, c, t, g, unknown or other
  misc_feature (310)..(310): n is a, c, g, or t
  modified_base (413)..(413): a, c, t, g, unknown or other
  misc_feature (413)..(413): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctacctaaactactcatttacncggcatccaccggaagtccgaggttcctgaccgattccgtggcaggcgggtctgggacagtacttttactctcacctatccacctaccctgcaggctagaagngtgtggctagtttattactgtacaataattattacttctactccgccgtacgttcgggaccgggacctaacgtgaaactacgaaacggtaactggtcgctgacctaccattccttgtccttctaccg

SEQ ID NO: 237426 - DNA, 556 bp, Homo sapiens
  misc_feature: GYAE6OF01EWB9X.48.15.B04.1.454.CMB.1.raw
  modified_base (309)..(309): a, c, t, g, unknown or other
  misc_feature (309)..(309): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcacacctcatgaacaaggagtacttggcttggttccagcagaaccagggcagcctacctaaactactcatttacncgcactccacccggagtcccgagtccctgaccgattccgtggcaggcgggtctgggacagtattttacnctcaccatcactcctncaggctgaantgtgactagtttactactgtacaacaattattactccgttacctcccgtaccggtaccgtttccggggacccggggtaccaaccggttggaaaacctacgaaacggtaactggtcggctcggccaacctattccttcggttccttcgtaacc

SEQ ID NO: 237427 - DNA, 554 bp, Homo sapiens
  misc_feature: GYAE6OF01AUFTZ.48.15.B04.1.454.CMB.1.raw
  modified_base (337)..(337): a, c, t, g, unknown or other
  misc_feature (337)..(337): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctacctaaactactcattactcggcatccaccggaagtccgagttccngaccgattccgtggcagcggtctgggacagtatttactctcaccatcacctaccctgcagctgaagntgtcggntagtttatactgtacaactaattattattcctaactcccgtaccgtaccggttccgggaccggggtacccaacggtacggaaactaccgaaaccgaacgttcgtcgggacctggaccaccgtatccgttgttccttcgtaccg

SEQ ID NO: 237428 - DNA, 532 bp, Homo sapiens
  misc_feature: GYAE6OF01ENRF2.48.15.B04.1.454.CMB.1.raw
  modified_base (310)..(310): a, c, t, g, unknown or other
  misc_feature (310)..(310): n is a, c, g, or t
  modified_base (335)..(335): a, c, t, g, unknown or other
  misc_feature (335)..(335): n is a, c, g, or t
  modified_base (374)..(374): a, c, t, g, unknown or other
  misc_feature (374)..(374): n is a, c, g, or t
  modified_base (404)..(404): a, c, t, g, unknown or other
  misc_feature (404)..(404): n is a, c, g, or t
  modified_base (523)..(523): a, c, t, g, unknown or other
  misc_feature (523)..(523): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagcggccaccatcaactgcaagtccagccagagttgttttcacacctccatgaacaaggagtacttggcttggttccagcagaaaccagggcagcctacctaaactactcatttacncgcatccaccggagtccgagttccngacgtattccgtgcaggcggtctgggactagtatttacnctccacatccactacctgcagctagaagtntgtcgctagtttattacgtgtacaactaattattacttactacgtcccgacgtacgttccgggaccgggtaaccacggtagtaaactcgtaaacgtactggtcgactgacctacatctntctctaccg

SEQ ID NO: 237429 - DNA, 565 bp, Homo sapiens
  misc_feature: GYAE6OF01BGQLC.48.15.B04.1.454.CMB.1.raw
  modified_base (316)..(316): a, c, t, g, unknown or other
  misc_feature (316)..(316): n is a, c, g, or t
  modified_base (396)..(396): a, c, t, g, unknown or other
  misc_feature (396)..(396): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgtttttcacacctccatgaacaaggagtacttggcttggttccagcaagaaaccagggccagccctacctaaactactctatttacncgcactcccgaacccggaagtcccgtacggttcctgaccgtacttccgtggcaggtccgggtctgggactagtatttacnctcaccatccactacccngcaggctagaantgtgctagtttatactntacaactattattacttcctacctccgtccggtaccggttccggggacccggggaacctaacggtacggaaactacgaaacgtacgtggtcgactcgaccactactctcgttccttcgtacc

SEQ ID NO: 237430 - DNA, 601 bp, Homo sapiens
  misc_feature: GYAE6OF01EXJR1.48.15.B04.1.454.CMB.1.raw
  modified_base (389)..(389): a, c, t, g, unknown or other
  misc_feature (389)..(389): n is a, c, g, or t
  modified_base (421)..(421): a, c, t, g, unknown or other
  misc_feature (421)..(421): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctcgtgggcgagacggccaccatcaactgcaagtccagccagtagttgttttcacacctccatacgaacaaggagtacgttggcttggttccagcaagaaccgaggcagcctacctaaactactctatttactcgcactccgaccggagtccgtaggtcctcgaccgtattccgtggcacggcggtctgggactagtactttacnctacaccatccactaccctgcagctagaagtntgtcgtctagtttactcgtagtactaaactagtttaacttacgttaccttaaccgtcccgccggttaacggttcccggggaacccggggtaactaacgggttacgaaaacttaccgaaaaccggtaagttcggtcggacctacgaccctaaccgtcttaccgttcgttcttccgtacccg

SEQ ID NO: 237431 - DNA, 532 bp, Homo sapiens
  misc_feature: GYAE6OF01CGKTJ.48.15.B04.1.454.CMB.1.raw
  modified_base (311)..(311): a, c, t, g, unknown or other
  misc_feature (311)..(311): n is a, c, g, or t
  modified_base (409)..(409): a, c, t, g, unknown or other
  misc_feature (409)..(409): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggtccagcagaaaccagggcacgcctacctaaactactctatttacncgcactccaccggaagtccgacggttcctgaccgtatccgtggcaggcggtctgggacagtatttactctcaccatccacctacctgcagctagaagntgtgtctagtttatacgtgtacaactaattattacttcctacgtccgaccgtacggttccgggaccgggtacaacgtgaaactcgaaacgtagtggtcgctgacctacacttctctctctacc

SEQ ID NO: 237432 - DNA, 852 bp, Homo sapiens
  misc_feature: GYAE6OF01CN6YX.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatcgacccagtcctccagactccctggctgtgtctcgtgggcgagaccggccaccatccaactgacaagtccagccagtagttgttttacacacctccatagaacgtaaggtacgttaacgttcggtacctttcggttaccaggtaccaacggaaacccgaggggacctacggtacccttaaccttaaaacctaaccgtccttaactttttaccgtaccgggtaccctaaaccgtaccccgaaccccgggtaaacgttcccggtaaccggtttcccgtacgaaccccggttacgttcccgggtagggccgtaacgggtccggggttaccgtcggggtaacctacggtttactttttaacccgcctaccaacccgtactacccgtaacccgttaaccccgtacggtaacccggtcgggtaaccgtaaggtaaacgtagtacggggtttacggtaccgtttaagtttttaacttaccgtacggttaaacctaaaacgttaacgtttaacttttaaccgtttacccggttaacccgttaccccgggtacccgttaacccggggtttacccggggaacccgggggtaaaccctaaacgggttaaaccgggtaaacttaaacccgtaaaacgggtacgttacgggttccggccgttaccggtaaccctaaccgtacttcccgttacgttccttacccgtaaccg

SEQ ID NO: 237433 - DNA, 561 bp, Homo sapiens
  misc_feature: GYAE6OF01AB9LT.48.15.B04.1.454.CMB.1.raw
  modified_base (381)..(381): a, c, t, g, unknown or other
  misc_feature (381)..(381): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaccagggcagcctcctaaactactctatttactcgcatccaccggaatccgaggttcctgaccgtattccggtggcacggcgggtctcgggacagtattttacncgtcaccatcacctacctgcaggctgaagntgngctagtttattactgtacaactattacttacgttctaacctccggtacctacggttccgggacccggggtaacaacggtacggaaataccgaaaaccggtattggtcggtctacgacctacctattaccgttcgttcctttctaccg

SEQ ID NO: 237434 - DNA, 819 bp, Homo sapiens
  misc_feature: GYAE6OF01EMXAC.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcattttctctgttgctctggatctctggtgcctgcggggacatcgtgatgacccagtctccagactccctggctgtgtctcgtgggcgagaccggccaccatcaactgcaacgtccagccagtagttgtttttaccactacctccatacgaaacgaaggtagttacgttacggtcgtttcggttacccagaccaaacggaaaacccgagggaccacggtacccttaaccctaaaaccttaccgttactacgttttaccgtccggtacctaaccgttaccccgaaaccccgggtaacgttaccccgttaacggtttacccgtacggtaacccgtacgtttcccggtggaccgtacgggtccggggtacgtacgggaacctaggttacttttaccgtccttaccgaccctacttacccaccgttaccctgacccgtaggtactaaggtaacgtgttcggttacggacgtttaacgttttacgttaacgttacggtaacctaaacgttaaattttaacctttaactttacccgttaacccggttccccgggtaaccccggtttaacccgggggtttacccgggggaaccccgggggttaaaccctaaaccgggttaaacgggtaaaacccgttaccgaaaaaccgggttacgttacggttaccggaccttacggaccctaaccgttattaccgtttcttaccgttaccctacccg

SEQ ID NO: 237435 - DNA, 822 bp, Homo sapiens
  misc_feature: GYAE6OF01DYXBL.48.15.B04.1.454.CMB.1.raw
tcagagtatacatacacgaccggtgctcgatttagacagtatatatccggcgggggagctacaacaggcaggcaggggcagcaagatggtgttgcagacccaggtcttcgatttcctctgttgctctggatctctggtgcctgcggggacatcgtgatgacccagtcctccagactccctggctgtgtctcgtgggcgaggacggccaccatcaactgcaacgtccagccagtagttgttttaccactaccttacctatacgaaacgaaggagttaaccgttgggactttagggttaccacgaccgaacgtaaaacccgaggggaccacggtacccttaccgtaaaaccttacctacctaacttttaccgtccgggactaacgtaccccgtaaaccccgggtaacgttcccggtaggtttacccgtacggaacccgtaagtttccccgggtagggtaccgtaacgggtccggggtacgtacggggaaccctaaggttaacttttttacctccgttaccaaacccctacttaccccgttaaccttaacccccgttggacccgtaacgggaccctttaagggaaacggttagttacgggttacggtaacctttaaggtttttaactttaccgttaaggttaaccctaaaacttaaatttaacgttttactttaccgtacccgttaccccggacccggttaacgggtttcccgggggaacccgggggaaacccttaaacgggtacggaaaacttaccgaaaaccgtaaggttccggtaggaccgttacgaccgtaccaactttcctacggttcttcttaaccccg

SEQ ID NO: 237436 - DNA, 554 bp, Homo sapiens
  misc_feature: GYAE6OF01DQNQS.48.15.B04.1.454.CMB.1.raw
  modified_base (309)..(309): a, c, t, g, unknown or other
  misc_feature (309)..(309): n is a, c, g, or t
  modified_base (337)..(337): a, c, t, g, unknown or other
  misc_feature (337)..(337): n is a, c, g, or t
  modified_base (374)..(374): a, c, t, g, unknown or other
  misc_feature (374)..(374): n is a, c, g, or t
  modified_base (403)..(403): a, c, t, g, unknown or other
  misc_feature (403)..(403): n is a, c, g, or t
  modified_base (448)..(448): a, c, t, g, unknown or other
  misc_feature (448)..(448): n is a, c, g, or t
  modified_base (548)..(548): a, c, t, g, unknown or other
  misc_feature (548)..(548): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctactaaactactcatttacncgcatccacccggaagtccgaggttccngaccgattccgtgcagcggtctgggacagtatttacnctcaccatcactacctgcaggctagaagntgtggctagttttactactgtactaataattattaattcttaccncccgtaccgtacgttcgggacccgggggtaaccaagggtacgtaaactacgaaaaccggtacttggtcggacctgaccctaaccgacttcttcgtccttntaaccg

SEQ ID NO: 237437 - DNA, 814 bp, Homo sapiens
  misc_feature: GYAE6OF01DTU0V.48.15.B04.1.454.CMB.1.raw
tcagagtatacatacacgaccggtgctcgatttagacagtatatatccggtcggggggagcctacaaccagggcacggcaggggctagcaagtatggtgttgcaggacccaggtcttcatttctctgttgctctgggattcgtctggtgccttggtcggggtactatcgtagtaatgacccagtctcagactccctggctgtgtcgtcggtgggcgtagacgcaccgagtccaactgacaagttccagccagagttcgttttcactaccttccaattgaacaaggacgttaacgttggactttcggttaccacggtcgaacgaaaccgaggggcctacggacccgttaccgtaaacttacgtcgtacgttttacgtcggtactacgttaccgaaccgggtaagtaccggtaacggtttacctacgaaccgtaacgtttaccggtacggtaccgaacgggtaccgggttacgttacggggaaccgtaaggttaactttttaccgtaccttacctaacccgtaacgtacctaacccgttaaccccgtacggaacccgtaacggaccttaggaaacggttagttacgggtacggtacgtttaacggtttttaaattaccggtacggttaacctaaagtaaagtttaacttacgtttaccgtaacccgttaccggtccggttaaccggtttccggggaacccgggggtaaaccttaacgggttacggtaaaacgtaaccgtaaaacggtacgtacgggttacgggcttaacccggactaaccgttacttaccggttaccgtttccgtacgttacccgg

SEQ ID NO: 237438 - DNA, 582 bp, Homo sapiens
  misc_feature: GYAE6OF01BT6U3.48.15.B04.1.454.CMB.1.raw
  modified_base (425)..(425): a, c, t, g, unknown or other
  misc_feature (425)..(425): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaacgtccagccagagttgttttcacacctccatgaacaaggagtacttggcttggttccagacaagaaaccagggcacgcctacctaaactactctatttactcgcactccaacccggaacgtccgacgttcctagaccgtacttccgtgcaggtcggtcgtgggactagtatttactctcacctatccacctaccctgcaggctagaagtntggtcgcttaagtttacttacgtagtactaactaattaatttacgttactacctccggtaccgtacggttccgggacccgggtaaccaacggtacggaaacttaaccgaaacgttactggtcgactacgacctaacctatcgtcttccttctacccg

SEQ ID NO: 237439 - DNA, 745 bp, Homo sapiens
  misc_feature: GYAE6OF01EA9TO.48.15.B04.1.454.CMB.1.raw
  modified_base (499)..(499): a, c, t, g, unknown or other
  misc_feature (499)..(499): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatcgacccagtctccagacctccctggctgtgtctcgtgggcgagaccggccaccataccaactgacaacgtccacgccagtagtttcgtttttaccaacctacctcctaatacgaaaaccgaagggtacgttacgtttgggtctttcgggttcccaaggaccaacggaaaacccgagggaccacggtacccttaacccttaaacctacctactaacttttaccgtcggacctaactaccccgaacccgggtaacgtcccggtacggtttccctacggtaacccgtacgttcccggtaggcgacgggtccggggttcgtacggggactaagttacgtttttaccnccgttacccacctacttacccaacccgttaccccgtggaccgtacggactaaggaacgtacgttggtacggtacttaagttttactacgtcgtaacaaattaagtttattactttacctaccgttcccggacccgttaccgggtccggggaacccggggtaacctaacggtaacggtaaactaccgtaaaacgtagttacggtcggactacgaccctacgtacttccgttcttccttcgttacccg

SEQ ID NO: 237440 - DNA, 731 bp, Homo sapiens
  misc_feature: GYAE6OF01DEKQA.48.15.B04.1.454.CMB.1.raw
  modified_base (470)..(470): a, c, t, g, unknown or other
  misc_feature (470)..(470): n is a, c, g, or t
tcagagtatacatacacgaccggtgctcgatttagacagtatatatccgcggggggagctacaacaggcaggcaggggcagcaagatggtgttgcagacccaggtcttcatttctctgttgctctggatctctggtcgccgtggcggggacagtcgtgactcgacccagtcctccacgacctccgtggctgtcgtctcggtgggcgacgaccgaccacactacaactgacaacgtccacgaccgtaggttacgtttcgttttaccacctacctcaagtacgaacgaaggtacgttacgttcggtacgttcggtaccagacgaacggaaaccgcgggacaccgtacctaacctaaactactactacttacgtcgactaccgtacccggaaccggtacggtccgtacggttccgtacgtacgtccgtccggtcggcgtacggtcgggtcgtacgggtactagttactttacnccgtacctacctactacctacctaccgtcgacgtacgtacgtacgtaagtagtacggtacgtacttacgggggggggggtttacttacgtacgtaactaactaacttaacttacttaccgttaccgtacccggtaccggttaccggggtacccggggtaacccggggtaccggtaaccggtaaccggtaacgtaacggtaaacgtaacggtacggtcggtaccgtacgaccgtacctacttacgttcgttcgtcgtacccg

SEQ ID NO: 237441 - DNA, 723 bp, Homo sapiens
  misc_feature: GYAE6OF01B6YFE.48.15.B04.1.454.CMB.1.raw
  modified_base (307)..(307): a, c, t, g, unknown or other
  misc_feature (307)..(307): n is a, c, g, or t
  modified_base (429)..(429): a, c, t, g, unknown or other
  misc_feature (429)..(429): n is a, c, g, or t
  modified_base (465)..(465): a, c, t, g, unknown or other
  misc_feature (465)..(465): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctgctgtgtctctgggcgagacggccaccatcaactgacaagtccagccagtagtgtttttcactacctccatgaacaaggagtacttggcttggtccagcaaggaaaccagggcacgcctacctaaactacnctaattactcgacacttacccgaaccggtaacgtccggtaacggtttcctacggaaccgtacgtttcccggtcggaccgtaggtccggggtacgtagggtaactagttaacgtttttaaccnccgtacctaccaacttaccaacccgttaaccccgtnaccggtaaggtcccgtagtaaaaggcgttagggttacggaccttaaggtttttatacccgttagtaacctaaacttactttaatttacttaccgtaccgtccggtacccggttacggttacccggggaccggggtaaacctaccgggttaaaggtaaaaccttaacccgaaaacgggttaacccgtagggttacgggaccccttaaggtacccaaaacccgttcttaacccggttcgttaccctttacgttaaccccg

SEQ ID NO: 237442 - DNA, 635 bp, Homo sapiens
  misc_feature: GYAE6OF01DJ8BC.48.15.B04.1.454.CMB.1.raw
  modified_base (426)..(426): a, c, t, g, unknown or other
  misc_feature (426)..(426): n is a, c, g, or t
  modified_base (611)..(611): a, c, t, g, unknown or other
  misc_feature (611)..(611): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctcgtggtgcctggcggggacatcgtgatgacccagtctccagacctccctggctgtcgtctcgtgggcgagaccgccacatcaactgacaagtccagccagtagttcgttttcacctacctccatacgaaacaaggacttacgttggtctttggtccagtcaacggaaaccgagggccacgtccctaacctaactactactacttaccgcgacactcccgaaccggagtccgtagttccctaggaccgtattccgtggccaggtccggtacgtacgggaccttaggttactttaccncgtaccaccgtactacccaaccgtcccgtgacccgtaggaccttaaggaacgtatcgggtcggtaacttagttttaactaccgtgtaactaactaagtttacttacttccctacgtccccggtcgttacccggtcggggaccgggtaaccctaaggtacgaaactaccgaaacgcgttggacgtncgacactataccttgtctcgtacg

SEQ ID NO: 237443 - DNA, 731 bp, Homo sapiens
  misc_feature: GYAE6OF01DGHQN.48.15.B04.1.454.CMB.1.raw
  modified_base (424)..(424): a, c, t, g, unknown or other
  misc_feature (424)..(424): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatcgacccagtcctccacgacctcccgtggctgtcgtctcgtgggcgacgaccgccaaccactacaactgacaacgtccacgccagtagttcgttttaccaccacctaccatacgaaacgtaaggtacgttacgttggtccgtttcggttacccaagaccgaacgaaaccggagggccaacgtaccctaacctaaactacctactactttacgaccgacaccgtcccgaacccggtacgtccgtacgttcctacgaccgtacgttccggnggacgacggtcggtacgtacgggtactagttacttttaccgtcctacctaccgtactacccgtaaccttaccgtacgacgtacggactaacggtaagtacgtggtacgtacgtttaagtttacttaacgtacgtaactaacttaaactttacgtttaacctcccgttaccgtcccggtacccgggttaccgggttacccggggaacccggggtaaacctaaacggtaacggtaaacgaaacccgtaaaacggtagttcgggtaccgcgtaccgaccgtacctattcccttacgttcttaccgtaccc

SEQ ID NO: 237444 - DNA, 859 bp, Homo sapiens
  misc_feature: GYAE6OF01BI7WB.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctcgtgggcgaggaccggccaccatcaacgtcggacaacggtccagccagtagttgttttcactacctccatagaaaccaaggacgttacgtttggctttcggttaccaagaccgaacggaaaacccgaggggcctacgtacccttaccgttaaaaccttaccgttacctaactttttaacccgtcgggctaaccttccccgaaccccgggtaagttcccggtaacggtttccctacggtaacccgtacgtttcccggtggacccgacggtccgggtcgtacggggacctaggttacctttttacgccgttaccaacccgtacttaccctaaccgttaaccccgtgacccgtagggtaccttaggaaacgttgtcgggttacggtaccgtttaaggttttacctttacgtacggttaacctaaactaaagtttactttaacttaccgttaaccgttacccggtaccccgggttaccgggttttacccgggggaccccgggggtaaaccctaaacgggttaaccgggtaaaaacgttaaacccggtaaaaaccggtttaaccgggttacgggtttcccgggttaaacccgtttaccggaacccccgttaaacccggtttaacgtttaccccgtttaacggggttttccccccttttaacggtttaaacccccccgg

SEQ ID NO: 237445 - DNA, 682 bp, Homo sapiens
  misc_feature: GYAE6OF01EOU5B.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatgacccagtctccagacctccctggctgtgtctcgtgggcgagaccggccaccatacaactgacaagtccagccagtagttcgttttccacctacctccatacgaaacgaaggtacgttacgttggtcttggttaccagacaacgaaccgagggacacgtccctaacctaactactactacttaccgcgactactacccgaaccggtacgtccgtacggttccacgtaccgtacgttccggcggacgacggtccgggtcgtacgggactaggttaccttttacgccttaccacctacgtaccctaccgttaccccgtggaccgtaaggtcctaaggtaacgtcgttggtacggtactttaaggttttacttacgtacgtaacctaaagttaactttaatttccttaccgtacccgtcccggtaccggtaccgggttacccgggaccggggtaacctaacgggtacgaaactaccggaaacgtacggtgtcgacgtacgacctacgtacttactcgttctcgtacccg

SEQ ID NO: 237446 - DNA, 566 bp, Homo sapiens
  misc_feature: GYAE6OF01DDBDI.48.15.B04.1.454.CMB.1.raw
  modified_base (315)..(315): a, c, t, g, unknown or other
  misc_feature (315)..(315): n is a, c, g, or t
  modified_base (342)..(342): a, c, t, g, unknown or other
  misc_feature (342)..(342): n is a, c, g, or t
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
tcagagtatacatacacgaccggtgctcgatttagacagtatatatccgcggggggagctacaacaggcaggcaggggcagcaagatggtgttgcagacccaggtcttcatttctctgttgctctggatctctggtgccctgcggggacatcgtgatgacccagtctccagactccctggctgtgtctctgggcgagacggccaccatcaactgcaagtccagccagagtgttttcactacctccatgaacaaggagtacttggcttggttccagacagaaaccagggtcagcctcctaaactactcatttaccncggtcatccaccggaagtccgagttcngaccgattccgtgcagcggtctgggacagtatttacnctcaccatccaactacctgctagctagatntgtgactagtttatactagtacaactaattacttattcctacgtcccgaccgtaccggttcgggacccggggtaaccaaacggtcggtaaataccgaaaacgtaactggtacggccttacggacctaccgtaattccgtacgttcccttcgtaaccg

SEQ ID NO: 237447 - DNA, 554 bp, Homo sapiens
  misc_feature: GYAE6OF01A8QS3.48.15.B04.1.454.CMB.1.raw
  modified_base (366)..(366): a, c, t, g, unknown or other
  misc_feature (366)..(366): n is a, c, g, or t
  modified_base (426)..(426): a, c, t, g, unknown or other
  misc_feature (426)..(426): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagtagttgttttcacacctccatgaacgaggagtacttggcttggttccagcaagaaaccgagggcagccctacctaaactactcctatttacgcgcactccgaaccccggaagtcccgtaggttcctgacccgtattcccgnggcgagcgggtctagggacagtactttctctcacctatcacctacctgcaggctagaagngtgtggctagtttactctgtacaactattattactctacctccgcgtacgtcgggcccgggactaacggacgtaaatcgtaaaacggtactggtcgtctacggctacctattacgtgttcctccgtac

SEQ ID NO: 237448 - DNA, 649 bp, Homo sapiens
  misc_feature: GYAE6OF01AM9O4.48.15.B04.1.454.CMB.1.raw
  modified_base (438)..(438): a, c, t, g, unknown or other
  misc_feature (438)..(438): n is a, c, g, or t
tcagagtatacatacacgaccggtgctcgatttagacagtatatatccgcgggggagctacaacaggcaggcaggggcagcaagatggtgttgcagacccaggtacttcatttctctgttgctctggatctctggtgcctgcgggacatcgtgatgacccagtctccagactccctgctgtgtctcgtgggcgaggacggccaccatcaactgcaagtccagccagagttcgtttttcacctacctccatcgaacaggacgtacttggcttcggttccagcagaaacccagggcacgtccctaccgtaaactcgtactattttaccacggctactcccacccggtaagtccggaggttccctcgaccgtacgttccggtaggcacggcggtacgtacgggactaggtacttttactctactaccagtacaccttaccngacaggtctaggaaatgtggtgactagtttacttacgttgtactaaacgtaattaatttattaccgttaacccgtacccgtcccggtaaccgggttacggggacccggggggtaaccctaaacgggttacggaaaacttaccggaaaaccgtaacgttgggtacggacgttcgaccctaccctattaccgtttcgtaccgtttctaacccg

SEQ ID NO: 237449 - DNA, 555 bp, Homo sapiens
  misc_feature: GYAE6OF01EUOVX.48.15.B04.1.454.CMB.1.raw
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
  modified_base (337)..(337): a, c, t, g, unknown or other
  misc_feature (337)..(337): n is a, c, g, or t
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcacacctccatgaacaaggagtacttggcttggttccagcagaaaccngggcagcctcctaaactactcatttacncgcatcccaccggaagtccgagttccngaccgattccgngcaggcggtctgggacagtatttacnctcacctntaccactaccctgcgagctagaagtgtgtgctagtttatacgtgtacaaacattattactctaccgtcccgacgtaccggttcgggacccggggtaccaacggtacggaaaactaccgaaaacggtaacgttggtggacctagacctaccattccgttgtaccttcgtaccg

SEQ ID NO: 237450 - DNA, 772 bp, Homo sapiens
  misc_feature: GYAE6OF01AZ7H8.48.15.B04.1.454.CMB.1.raw
  modified_base (187)..(187): a, c, t, g, unknown or other
  misc_feature (187)..(187): n is a, c, g, or t
  modified_base (249)..(249): a, c, t, g, unknown or other
  misc_feature (249)..(249): n is a, c, g, or t
  modified_base (325)..(325): a, c, t, g, unknown or other
  misc_feature (325)..(325): n is a, c, g, or t
  modified_base (725)..(725): a, c, t, g, unknown or other
  misc_feature (725)..(725): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatcgacccagtcctccaagcctccctggctgtntctcgtgggcgaggaccggccaccatacaacgtcgaccaacgtccacgccgtagtaggtttnttttaccacctacctccagtaggaaacgtaaggtacttacgttggtccttagggttaccagtacgaacgaaaccgngggaccacgtaccctacctaaacttactacttaacttacgcggactactacccgaaccggagtccgtacgttactcgaaccgtacgttccgtaggcgtacggtccgggtagtaccgggaattacggttagttttaccctcccttaaccgacccttaaccgttccctaacccgttaaccccgtcgtaaccggtacggtaaccgtaagtaacggtacgttcgggttacgtaacgtttaacgttttaccgtttaacgtacggtaacctaatttagtttaactttaccgtacgttaccgtacccgtcggggttaacccggtaccggggtacccgggaacccgttaaggtaaccggtaaaacgtacccggtaaaacgtaaccggttcgggtaccgaccggtaacncccggttaaactaaccgggtttccgtttaacttccgttcgttacccc

SEQ ID NO: 237451 - DNA, 194 bp, Homo sapiens; identical to SEQ ID NO: 237410
  misc_feature: GYAE6OF01EKO9E.48.15.B04.1.454.CMB.1.raw
  modified_base (193)..(194): a, c, t, g, unknown or other
  misc_feature (193)..(194): n is a, c, g, or t

SEQ ID NO: 237452 - DNA, 546 bp, Homo sapiens
  misc_feature: GYAE6OF01BE0HU.48.15.B04.1.454.CMB.1.raw
  modified_base (286)..(286): a, c, t, g, unknown or other
  misc_feature (286)..(286): n is a, c, g, or t
  modified_base (317)..(317): a, c, t, g, unknown or other
  misc_feature (317)..(317): n is a, c, g, or t
  modified_base (345)..(345): a, c, t, g, unknown or other
  misc_feature (345)..(345): n is a, c, g, or t
  modified_base (357)..(357): a, c, t, g, unknown or other
  misc_feature (357)..(357): n is a, c, g, or t
  modified_base (390)..(390): a, c, t, g, unknown or other
  misc_feature (390)..(390): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactcctggctgtgtctcgtgggcgagacggccaccatcaactgcaagtccagccagtagttgtttttcactacctcatagaacaaggatacgttggcttggtccagcaacgaaccgngggccagccctacctaaactctctatttacncgcactccaacccggagtcccgagtccngaccgtattcgngcagcggtctagggatagtatttacgctcaccntccacctacctcgcaggctagagatggtgtacttaggtttactacgtagtacaagtaattattacttctaccgtccgtaccgtacggtccgggaccgggtaacacggtacgaataccgaaacgtgtgtcgcgtcgaccgacattctctcttcgtac

SEQ ID NO: 237453 - DNA, 570 bp, Homo sapiens
  misc_feature: GYAE6OF01C0HT1.48.15.B04.1.454.CMB.1.raw
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagaccggccaccatcaactgcaagtccagccagtagttgttttcacacctccatgaaacaaggagtacttggcttggttccagcaagaaaccagggcagcctacctaaactactcatttactcgcactcccaaccggtaagtccgacgttcctcgaccgtattccgtgcaggcggtctgggacagtattttacnctcacatcactccngcagctagagntgtgctagtttattactgtacaataattattacttcctaactccggaccgtaccgggttccgggacccggggtaacctaacggtaaggtaaactacgaaaaccggtacgtggttcggaccttgacctaaccgtacttccgtacgttcctttctacccg

SEQ ID NO: 237454 - DNA, 614 bp, Homo sapiens
  misc_feature: GYAE6OF01BOBPB.48.15.B04.1.454.CMB.1.raw
  modified_base (325)..(325): a, c, t, g, unknown or other
  misc_feature (325)..(325): n is a, c, g, or t
  modified_base (366)..(366): a, c, t, g, unknown or other
  misc_feature (366)..(366): n is a, c, g, or t
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgacaagtccagccagtagttgtttttcaccacctaccatgaaacaaggagtacttggtcttggttccagccaagaaacccgagggcagccctacctaaactactacactttacncggcactacccacccggtaagtccgaggttcctggaccgtnttaccggtgcgacggcggtcgtgggactagtacttttacnctacacctatccactacccngaccaggctagaacgtatcggtgtctagtttatactgtacaactaattacttacttacctacgtacccgtacgtaccgggtttaccgggaccggggtaaccaacggtacggaaacgtacccgtaaaacgtaacgttcggcggtaccttcgaccgtaaccctactaccgtttcgttccttccgtaaccg

SEQ ID NO: 237455 - DNA, 212 bp, Homo sapiens
  misc_feature: GYAE6OF01A00IM.48.15.B04.1.454.CMB.1.raw
  modified_base (152)..(152): a, c, t, g, unknown or other
  misc_feature (152)..(152): n is a, c, g, or t
  modified_base (202)..(212): a, c, t, g, unknown or other
  misc_feature (202)..(212): n is a, c, g, or t
tcagagtatacatacacgaccggtgctcgatttagacagtatatagtccgcgggcacgaccggtgctcgatttagacagtatataagtccggcgggctacggaccggttgcctccgatttagtcacgcgagaaagggaaagggcgtgtttcngttcccgaccctctctatgtatactctgagcgggctggcaaggcgcatgnnnnnnnnnnn

SEQ ID NO: 237456 - DNA, 705 bp, Homo sapiens
  misc_feature: GYAE6OF01BIW6M.48.15.B04.1.454.CMB.1.raw
  modified_base (318)..(318): a, c, t, g, unknown or other
  misc_feature (318)..(318): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcgggacatcgtgatcgacccagtctccacgactcccgtggctgtgtctcgtgggcgagaccgccaccatacaactgacaacgtccacgccagtacgttcgttttccacctacctctagtacgaaacgtaaggtacgttacgttcggtcgtttcggtaccacgtacaacggaaaccgnggacacgtcctaacctaactactctacttacgcggtactacgtacccgaccggtaacgtccggtacgttcccgtacgaccgtacgttccggcggaccgacggtccgggtacgtacgggacttaggttactttaccacctacaccctactacccgtaccttacccgtacgtccgaacggtctaaggtaacgtgttacggtacggtaactttacgtttactttacgtacgttaactaaacgttaattaagttacttcccgttaaccgtccggtaccggtaccgggttccggggaaccgggtaccggtaaacggtacgtaaacgtaacgtaaacggtacgtacggtcgtacgtactaccgtactcgttacgttacttccgtcgttacccg

SEQ ID NO: 237457 - DNA, 573 bp, Homo sapiens
  misc_feature: GYAE6OF01EWX7J.48.15.B04.1.454.CMB.1.raw
  modified_base (287)..(287): a, c, t, g, unknown or other
  misc_feature (287)..(287): n is a, c, g, or t
  modified_base (349)..(349): a, c, t, g, unknown or other
  misc_feature (349)..(349): n is a, c, g, or t
  modified_base (394)..(394): a, c, t, g, unknown or other
  misc_feature (394)..(394): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctcgtgggcgagacggccacatcaactgcaagtccatccagagttgttttcacacctccatagaaacaaggagtacttggtcttggttccagcaagaaaccgngggcacgtacctacctaaactactctatttactcgcactaccgaccggaagtccgagttccngaccgattccgtgcgacggcgggtctcgggactagtacttttacnctacacactcacctacctgacacggtctagaagtgtggtcgcttagtttatactagtactaactaattattacttcctacctccgtacggtacggttccgggacccggggtaactaacggtaggaaactacgaaacgacgtggtacgcgtacgcctacgtactacgtcgttctctaccg

SEQ ID NO: 237458 - DNA, 669 bp, Homo sapiens
  misc_feature: GYAE6OF01E4FTD.48.15.B04.1.454.CMB.1.raw
  modified_base (480)..(480): a, c, t, g, unknown or other
  misc_feature (480)..(480): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatgacccagtctccagactccctggctgtgtctctgggcgagacggccaccatcaactgacaacgtccagccagtagttcgtttttccacctaccctccatacgaacgaaggtagtacttggtctttcggttcccagacaaggaaaccgaggggcacgccctacctaaactactactatttactcggcactacccgacccggaacgtccgtacggttcctcgacccgtagttccggtggccgaggccggggttctcggggactacggttacttttacctctaccacctactaccaccttacccgtgaccgacggtctaggtaacgngttggtgggtacctaaggttttacttactagtacaacttaacttaattactttcctaccttccggtaccggtaccggttacccggggacccgggggtaacctacggtaacggaaaccgttaaccgaaaccgtaaccgtgggtccggcgtaccgacctaaccgtacttacgttcgttccttacttacccg

SEQ ID NO: 237459 - DNA, 765 bp, Homo sapiens
  misc_feature: GYAE6OF01BEVCK.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcgggacagtcgtgatcgaccagtctccagtacctcccgtggctgtcgtctcgtcgggcgacggaccgccaccactacaactgacgtaacgtccacgaccgtagtacgtttacgttttaccacctacctactataacgaaacgtaaggtacgttaacgttcggtctttcgggtaccacggacgtaaacggaaaccggacggacctaaccgtcccttaacctaaaccgttacctacgttactttaccgcggactaacctacccggaaccggtacgtacccggtacggttaccgacgtaccgtcgttccggtggcgtacgggtcggtcgtacgggtactaggttaccttttacgtacctacctaaccgtacttcccgaaccgtttaccgagtacgtaacggtacgtaacgaagttacgtcggtaacggtacttttacgtttacgtacgttataaccgtaaattatttaacttacgttacccgttccggaacccgttcggtaacccgggttccgggaacccgggtaaacttaaccggtaacggaaaaccttaacgaaaccggttaggttaccggtcgaccgtacctaaccgtaacctcgtttacccttacgttccctaccgttacccg

SEQ ID NO: 237460 - DNA, 648 bp, Homo sapiens
  misc_feature: GYAE6OF01BG1IR.48.15.B04.1.454.CMB.1.raw
  modified_base (304)..(304): a, c, t, g, unknown or other
  misc_feature (304)..(304): n is a, c, g, or t
  modified_base (482)..(482): a, c, t, g, unknown or other
  misc_feature (482)..(482): n is a, c, g, or t
  modified_base (605)..(605): a, c, t, g, unknown or other
  misc_feature (605)..(605): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatgacccagtctccagacctcccgtggctgtgtctcgtgggcgaggaccggccaccatcaactgacaacgtccacgccagtaggttcgtttttacacctacctccaatagaacgaaggagttacttggcttggtccagcgaagaaaccgnggacacgtcctaccaaactacctactaatttaccacggtactacgtacccaaccgggtaacgttcccggtaacggttcccgacggtaccgtacgttccggtcggcgtacgggcggtacgtagggaccgtaagttactttactctaccgacctactacctacctacccgtgtcacggtntaacggaatacgtggtacgtacttacggtttatacgtagtactaatacttaattactccgttaaccgtccgacggtaccggttcgggaaccgggtacaacgggtagaacgtaccgtaaaggtntacggtcggctggtacccacgttactagttcgtattcggtacc

SEQ ID NO: 237461 - DNA, 959 bp, Homo sapiens
  misc_feature: GYAE6OF01BBYKK.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcgggacagtcgtgacgtcgacctacgtcctaccgacgtccttccgtcggtcgttcggtcgtcgtcggtcgggacgacggaccggacccaacctactaccgaacgtcgaccgtaaccgtaccgacgtaccgtaaggttacgttttacgttttaccaacctacctactaagtacgaaacgtaaggtacgttaacgttcggtacgtttacggttaccgagtaccgaaacggtaaccgacgggacctaaccgttaccctaaccgttaaacctaccttacttaacgttttaccgacggtacctaccggtacccggtaaccgggtacgtaccggtacggttaccctacggtacccgttacgttccggtacgtcggtacgggtcggtacgggtacggtaaccgtacggttttacctttaccgtacctaacccgtaccgttaacgtacccgtaacccgttcggtaccggtcgtaacggtacggtaacgaacgttacggtcggtacggttacctttaacgggtttttaactacggtttacgtaaaccgtaaaactttacggtttaacctttttacccgtaaccgtttacccccgggttaccgggttaccccgggtttaaccgggggttaccccgggggtaaccccgggtaaaaccgggtttaaaccgggttaaaccgggttaaaaaacccgttaacccggggtaaaaacccggggttaaggtttacccgggggtaaccgttacccgtaaaccggggtttaccctaaacccgtttaccggttttacccggtttcccgttaaacccggttttcccgtttaaacccccgg

SEQ ID NO: 237462 - DNA, 845 bp, Homo sapiens
  misc_feature: GYAE6OF01B1H14.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatgacccagtcctccagacctcccgtggctgtgtctcgtgggcgaggaccggccaccatacaactgacaacgtccagccagtagttcgttttcacctacctccaagttacgaaacgaagggtagttaccgttggtccgtttacgggttacccagaccgaaggaaaacccgagggacaccgtacccttaacctaaacctacttactaacgttttaccgccgtactactaccccggaacccggtaacgtccggtacggttccgtacgaacccgtcgttaccgtaggccgtagggtccgggttacgtacgggaacttaacgttacgttttacctccgtaccacccttacgtacccgtaacccttaccccgtaggaccgtacggtaacgtacggtaaagtcgttacgggtacggtaccttttaacgttttacgtttaacccgttaggtaaacccttaaaaacgttaacgtttttaaacctttaccgtttaaccccgttaaccccggttacccccgggttaacccgggttaacccggggttacccccgggggtaaccccgggggaaaccgttaaaacccgggtacggggtaaaaacccttaaccggtaaaaccggtacgggttacggtaccgggtacccgtacgtaaccccttaacccgtactttacccggttacttacccgtttccgttaacccg

SEQ ID NO: 237463 - DNA, 684 bp, Homo sapiens
  misc_feature: GYAE6OF01CD1XB.48.15.B04.1.454.CMB.1.raw
  modified_base (304)..(304): a, c, t, g, unknown or other
  misc_feature (304)..(304): n is a, c, g, or t
  modified_base (460)..(460): a, c, t, g, unknown or other
  misc_feature (460)..(460): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcgggacatcgtgatcgacccagtctccagactccctggctgtgtctcgtgggcgagaccggccaccatcaactgacaacgtccagccagtagttgttttaccacctacctccaatacggaaacgtaaggagttacttggctttcggtccagtcaagaaaccgngggacacgccctaacctaaactctacgtaacttaccgccggactaccgtacccgaaacccgggtaacgtacccggttacggttaccccgacggtaacccgttacgttccggacggacgacggtcgggtacgttacgggactaacggttactttacnccgttaccacctatccaccctccagtcgacggtctaagaagtgtggtacgtacttagttttactacgtgtaaccaaacttattaacctttcttaacccttaccgcccggtaccggttaccggttaccggggaacccggggtaactaacggtacggtaaaatacccggaaacgtacgtggtcgaactcgaaccgtactacgttaccgtcgttctacgttaccccg

SEQ ID NO: 237464 - DNA, 670 bp, Homo sapiens
  misc_feature: GYAE6OF01EZYVZ.48.15.B04.1.454.CMB.1.raw
  modified_base (333)..(333): a, c, t, g, unknown or other
  misc_feature (333)..(333): n is a, c, g, or t
  modified_base (430)..(430): a, c, t, g, unknown or other
  misc_feature (430)..(430): n is a, c, g, or t
  modified_base (475)..(475): a, c, t, g, unknown or other
  misc_feature (475)..(475): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagacctccctggctgtgtctcgtgggcgagaccggccacatcaactgacaacgtccagccagtagtttgtttttccaccaccctccatagaacaaggagttacttggcttcggttccagacaagaaaccgagggcacgtacctacctaaactactactactttacncgacactaccgacccggaaggtcccgtaggttccctagaccgtacttccggtggcgacggtcggggtacgtacggggaactaagttactttttaccncctaccaccattaccacctacccgtcgacgtacggactagaagtntacggtcgtacgttagttttacttacgtacgtactaaataattaactttacttaccttaccgtccccggtaccgttaccgggttacccggggacccggggtaacccaacggttaaaccggaaacttaaccgaaaccggtagttacgggtacgccgtccgtaccctaactacgttcttcgttaccctcgttacccg

SEQ ID NO: 237465 - DNA, 772 bp, Homo sapiens
  misc_feature: GYAE6OF01DFYFX.48.15.B04.1.454.CMB.1.raw
  modified_base (337)..(337): a, c, t, g, unknown or other
  misc_feature (337)..(337): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatcgacccagtcctccagactccctggctgtgtctcgtgggcgagccggccacatcaactgctaacgtccagccagtagttcgttttcaccacctccatagaaacgaaggtacgttacgttggtctttcggtaccagcaacgaaccgagggccacgtccctaacctaactactctactttacncgcaactcccgaaccggaacgtccgtagttccgtacgtaccgtacgttccggcggacacgggtccgggtacgtacggggaacctaggttaactttttaccgccctaccgtaaccctacttacccgtaacccgttaccccgtacggtcgtacgggtacctagggaacgttacggtaggttacgggtacttaggtttttaacttacgttacggttaacctaaacttaagttaactttttacttcccgttaaaccggttccccgggaccccggtttacggggttacccgggggtaacccgggggtaaaccccttaaacgggaaacggtaaaaccgtacccgtaaaaaaccgggttacgttcgggttaacgggtacccgttacgaaaccccgttaccctaaacgtttccccgtttaaggttccctttcccgttaacccg

SEQ ID NO: 237466 - DNA, 663 bp, Homo sapiens
  misc_feature: GYAE6OF01DX68X.48.15.B04.1.454.CMB.1.raw
  modified_base (345)..(345): a, c, t, g, unknown or other
  misc_feature (345)..(345): n is a, c, g, or t
  modified_base (374)..(374): a, c, t, g, unknown or other
  misc_feature (374)..(374): n is a, c, g, or t
  modified_base (501)..(501): a, c, t, g, unknown or other
  misc_feature (501)..(501): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatgacccagtctccagactccctggctgtgtctcgtgggcgagaccggccaccatacaactgacaacgtccagcctaggtagttcgtttttccacctacctaccatacgaaacgaaggtacgtacgttggtcttcggtaccagacaacggaaaccgagggacacgacctacctaaactactactatttacncgcactccgaaccggagtccgaggttccncgaccgtacgttccggtggacgtacggtcgggtacgcgggtactagttactttacgtctcaaccgtactaccctaacctccgtagcgagtctaggaagtagtggtcgtacttaggtttacttacgtntaactaataacttatttaccttacgtaccgttcccggtacccggtaccggttccgggggaaccccgggaaccgtaacggttaaccggtaaataaccgtaaaacggtagttcggtacggcctaccggcctaccttaacgttcgttcgttacttccgtaacccg

SEQ ID NO: 237467 - DNA, 684 bp, Homo sapiens
  misc_feature: GYAE6OF01E26NF.48.15.B04.1.454.CMB.1.raw
  modified_base (325)..(325): a, c, t, g, unknown or other
  misc_feature (325)..(325): n is a, c, g, or t
  modified_base (437)..(437): a, c, t, g, unknown or other
  misc_feature (437)..(437): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtcgcctggcgggacatcgtgatcgacccagtcctccagacctcccgtggctgtcgtctcgtgggcgacgaccggccacctatccaactgacaacgtccgagcctagtagtttcgttttaccacctaccctaccagtacgaaacgtaaggtacgttacgttggtcttcggttaccacgacgaaacgaaccgnggggacctacgtaccccttaacctaaaacttacctaccttaacttttaccgcggtacacgttacccacgtaccggtaacgtccggtaacggttccacgaccttcgttccggngccggtagtcgggtacgtaggactacgtttacttttaccactacaacctactcctacctccgagcacggtcgtaagaacgtgtacggttcgtacgttaacttttactacgttactaactaacttaattacgtttacttaccgtccgtaccgtaccggtacgggttcccgggacgggtacccgtaagtaacgtaaacgtaaccgaagtacggtgtccgtgtaccctacacctagtcttgtccttaccg

SEQ ID NO: 237468 - DNA, 805 bp, Homo sapiens
  misc_feature: GYAE6OF01ASSSJ.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctcgtggtcgcctggcggggacatcgtgatgacccagtctccagactccctggctgtcgtctcgtgggcgacggaccggcccaccactacaactcgaccgtaaaggtccacgacctaaggtacggttttcggtttttccaactacccgtacctaagtacggaaaccgtaagggacgtttaccggtttcgggtcctttcgggttaccaggaccgaaacggaaaacccggaggggccgacgtacccttaacccttaaaaccgttcctacttacgttttaccgtaccgggacctaaccgtaccccggaacccgggttaacgtcccggttacggtttccctacgggtaaccgtacgttcccgggtaggccgtacgggccgggtttcgaacggggtaactacggttaacttttaccgacctacgtacctactacctacctaccgtcgcacggtctaaggaacgtgtcggtagtacgttatttaacgtacgtacgtaacgtaacgtaatttacgtttacttaccgttacccgttaccggtacccggttaccggggttaccggggacccgggtaaccggtaaccgggtaagtaaaccgtaaccgtaaacccggtaccgttacggtcccggactaccggtaccctaaccgttacgttccttaccgtttccctacccgtttacccg

SEQ ID NO: 237469 - DNA, 718 bp, Homo sapiens
  misc_feature: GYAE6OF01BE9TK.48.15.B04.1.454.CMB.1.raw
  modified_base (291)..(291): a, c, t, g, unknown or other
  misc_feature (291)..(291): n is a, c, g, or t
  modified_base (318)..(318): a, c, t, g, unknown or other
  misc_feature (318)..(318): n is a, c, g, or t
  modified_base (349)..(349): a, c, t, g, unknown or other
  misc_feature (349)..(349): n is a, c, g, or t
tcagagtatacatacacgaccggtgctcgatttagacagtatatatccgcgggggagctacaacaggcaggcaggggcagcaagatggtgttgcagacccaggtcttcattttctctgttgctctggatctctggtgcctgcggggacatcgtgatgacccagtctccagactccctggctgtgtctcgtgggcgagacggccacatccaactgcaagtccacgccagtagttgttttccaccacctccatgaacaaggactacgttggcttggttccagcaagaaaccgnggcagcctacctaaactctcatttacncggcacgtccgaccggagtccgacggttccngaccgtattccggtagcgaggtcgggtcgtagggactagtacttttccgtctaccgacctacttaccctaccttaccccgtcgccgtaacgggtccgtttaagaaacggtacgttcgggtacgggtacctttaaggtttttacctttaacgttaccgtaactaaacgtaacgtttaactttaactttaccgtttaccctacccgggtaccgttacccggggttccggggtaccccggggggtaacccgtaaaacgggttcgaaaaacgttaacccggaaaaccggttaaccttaggggttaccggaccgttaccggtaaccctaacccggttactaccccggttttacgttcctttacccgttaccccg

SEQ ID NO: 237470 - DNA, 737 bp, Homo sapiens
  misc_feature: GYAE6OF01C4Q1L.48.15.B04.1.454.CMB.1.raw
  modified_base (364)..(364): a, c, t, g, unknown or other
  misc_feature (364)..(364): n is a, c, g, or t
  modified_base (715)..(715): a, c, t, g, unknown or other
  misc_feature (715)..(715): n is a, c, g, or t
  modified_base (723)..(723): a, c, t, g, unknown or other
  misc_feature (723)..(723): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctcgtggtcgccgtgggaccggggactagtccggtagacgtccgaaccctgtcctacctaacggcctcccgtggtccttgtcgtctcggtcgggacgacggccgtaccacactacaactcgacaacgtccagccgtaaggttcgtttcttttaccacctaccttaccgaagtaacgaaacgacggttacgttacggttcggttaccgtttggaccacgacgaaaccggaaaccggngggaccacgtaccctaacctaacgtaccttcgttaacttacgcgaacctacgtacccgaacggtacgtcgtacgttaccgaccgtacgttcgtcggtcgcgaacggggtgtacggtacggacttacgttacctttacaccgtaccacctacctactaacccgtccgtacgacgaacgttacgtaaggtagtacgtacggttcggtaacgtttacgtttaactttacgactaataacgtttaattaacgttacctaccgtaaccttcccggacggtaacccgggttccggaacggaaccgtaagtaccgaaagttaaccggacgtaggtcgtaggtcctacgacctaacgtnaccggttntaccgtcttacccg

SEQ ID NO: 237471 - DNA, 749 bp, Homo sapiens
  misc_feature: GYAE6OF01DN3DR.48.15.B04.1.454.CMB.1.raw
  modified_base (190)..(190): a, c, t, g, unknown or other
  misc_feature (190)..(190): n is a, c, g, or t
  modified_base (502)..(502): a, c, t, g, unknown or other
  misc_feature (502)..(502): n is a, c, g, or t
  modified_base (582)..(582): a, c, t, g, unknown or other
  misc_feature (582)..(582): n is a, c, g, or t
tcagagtatacatacacgaccggtgctcgatttagacagtatatatccgcgggggagttacaacaggcaggcaggggcagcaagatggtgttgcagacccaggtcttcatttctctgttgctctggatctctggtgcctggcggggacagttcgtgatcgacccagtcctccagacctcccgtggctgtntctcgtgggcgacgaccggccaccataccaactgacaacgtccacgccgagtacgttcgttttacacctacctccatacgaaacgaaggtagttacgttcggtacgtttcggtaccagaccaacggaaacccgagggccacgtacccttaacctaaactacctactaacgttttacgcgactaccctacccgtaacccggtaacgtcccgttacgtccgtacgtaaccgtcgttccggaggcgtacggtcgggtcggtagggactaacgttacttttacctcctaccaaccgtacttaccacccgttacccngaaccgcggtacgtaagtaagtacggtgggtacttacgttaacgtttttacttacgtacgttaactaaacgtttaacttntttaacctttcccgtaacccgttcccgggtacccgttacgggttaccccggggggtacccgggtaaaccgtaaacggtacggtaaaaccctaacggtaaaaccgtcggttggttaccggctaccggaccacttacgttccgtactcccttttcgaccgtttcccccg

SEQ ID NO: 237472 - DNA, 978 bp, Homo sapiens
  misc_feature: GYAE6OF01AMRWT.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctcgtggatctcgtggtcgccgtgggccgggacagttcgtgatcgacctagtcctaccgacgtacctcccgtggtcttggtcgtccgttcggtcgggacgaacggaccggacccaaccactacctaacgtcgaaccgtaaccgtccacgaccgtagttcgtttcgttttaccaccctaccgtacagtaacggaaacgtaacggtacgtttaacggttcggtacgtttcggttaccccgaggtaccgaaaacggaaccggagggaccgtaccgttaacccctaaccgttaaacctacctacgtttaccgttacccggtaccgtaccctaaccggtacccccggaaccggtaaccggttcccggtaccggtttaccccgtacggtaacccggtttacccgttcccgggtacggtaccgggaccgggttccggttacggtaacgggtacgtttaaaccgtttccgttttaacccgttcccgttaaccctacccgttaacccgtttaccccggttaacccccgtaccccggttaggccccggttaaacggggtaccgttaaagggttaaccgtaacgggttttccggtaccgggtttaacgtttttaccccgtttaagttttaacccgtaacttaaaccggttaaaccttttaaaccgttttaacgtttaaccgtttacccccggtttaccccggttaaccgggttacccccgggttaacccggggttacccccgggggtaaaccggggtaacccgggtaaaccggtttaacggaaacgttaacccggtaaaccggttcgtaacgggtcgtaaccgtcgtaacccgtcgttacgtactttacccgttgttacccgttacccg

SEQ ID NO: 237473 - DNA, 803 bp, Homo sapiens
  misc_feature: GYAE6OF01EPXNN.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctcgtggcgagcgccacatcaactgcaagtccagccagagttgtttttcacacctccatgaaacaaggacgtacttggcttggttccaagcaacgaaccgaggcacgcctacctaaactactcacttttacgacgtccactcccgaccggtaagtcccgtacggttcctggacccgtagttcccggtggaccgtacggccgggttacgtacggggtactaaggttaactttttaccgtaccgtttaccgaaccctacttacccgtaaccgttaccccgtacggtcccgaagggtcccttaagggaaacgttacgtttacgggttacgggtacctttaacgggtttttaactttaacgttacggttaaacctaaaacccggttaatttttaacgtttaaccgttttacccgttaaccccggtttacccgggtaacccggttaacccgggggttttcccgggggacccggggggttaaaacccgtaaaccgggtttaacggggtaaaaacccttaacccggaaaaaccggttaaccggtcgggttacccgggtaccgtaacccgggtaaccctacccgtttaaccgttccctttacgggtttaccccttcgtttaaccccg

SEQ ID NO: 237474 - DNA, 763 bp, Homo sapiens
  misc_feature: GYAE6OF01D4ATV.48.15.B04.1.454.CMB.1.raw
  modified_base (615)..(615): a, c, t, g, unknown or other
  misc_feature (615)..(615): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcgggacatcgtgatcgacccagtctccagactccctggctgtgtctcgtgggcgacggacgccacatacactgacaacgtcagccagtcgttgtttaccactacctacatacgaaacgtaaggtagttacgttacggtcttacggtaccaagtaccgaaacggaaaccggtacggggtactaccggtacccttaaacctaaaaccttaccgtaacgttaacgttttaccgaccgggtaactaacccgttaaccccggtaacccgggtaacggttacccgggttaacggtttacccgacggtaaacccgttcggtttacccggacggtaccggtaacggggtccgggttacggtacggtacgtaacggttaatttaccgtaccgtacctaaccctatacccgtaacctacccgtgacgtacgtacgtaagaagtcgtagtacggtacttaagttaacttcgaagtacctaaacgtnttaaccttagtactcccgtacggtacccgttacgggtaccgggttaaccggggaaccgtagtaaaccgtaaaacgtacgtaaaacccgtagggttccggtacgacgtacgtccgtaaacctgttaacccgttcgacgttcgtaacccg

SEQ ID NO: 237475 - DNA, 744 bp, Homo sapiens
  misc_feature: GYAE6OF01CQHJD.48.15.B04.1.454.CMB.1.raw
  modified_base (626)..(626): a, c, t, g, unknown or other
  misc_feature (626)..(626): n is a, c, g, or t
  modified_base (712)..(712): a, c, t, g, unknown or other
  misc_feature (712)..(712): n is a, c, g, or t
  modified_base (716)..(716): a, c, t, g, unknown or other
  misc_feature (716)..(716): n is a, c, g, or t
  modified_base (727)..(727): a, c, t, g, unknown or other
  misc_feature (727)..(727): n is a, c, g, or t
tcagagtatacatacacgaccggtgctcgatttagacagtatatatccgcgggggagctacaacaggcaggcaggggcagcaagatggtgttgcagacccaggtcttcatttctctgtgctctggatctctggtcgcctggcggggacatcgtgatcgacccagtcctccaggtacctcccgtggtcttggtcgttccgtcggtcggggaccgaacggacccggacccaccctaacgtacctaacgtcggacctaacggtacccacggtacctaaggttacggtttacgtttttaccaaccctaaccgttacccgtaagtaacggaaaaccgtaaacggttagttaaccggtttgggtccgtttacggttaccaaacggccgaaaacggaaaccggtacggggaccaccgtaccttaaaccgtaaacctaaccgtcttaactttaccgcggtacctaaccgtccccggtaaaccgggaacttccggtaacggttcccgtacggtaacccgttcgttaccggcggacgcgggtaccggtcgtaagggaccttagtttactttacctcgtcctactctaccctacctacgcgctacgcgtaaggatcggtgtcgtacgttattacttnacactaattatacttacttaccgtaccgtcggtacgtccgggaccgggaccggaccgtagtacggaactacgacgtagtcgtacgntacncctacacgttntacgttccgtctacccg

SEQ ID NO: 237476 - DNA, 836 bp, Homo sapiens
  misc_feature: GYAE6OF01D94ON.48.15.B04.1.454.CMB.1.raw
tcagagtatacatacacgaccggtgctcgatttagacagtatatatccggcgggggagctacaacaggcaggcaggggcagcaagatggtgttgcagacccaggtcttcatttctctgttgctctggatctctggtgcctgcggggacagtcgtgatcgacccagtctccgagtacctcccgtggctgtcgtccgtcgtcgggcgacgaccggcccaaccataccaactgaccaacgtcccgacgacctaggtacgttttcgttttaccaccgtacccttaccaagtacgaaaacgtaaggtacgttaacgtttggtcctttacgggtaccaggaccgaaacggaaaccgacgggacctaccgtacccttaacccgttaaacctacttacctaaccttttaccgaccggtacctaaccgtaccccgtaaccccgggtaacgttcccggtaacggtttccctacggtaacccgttacgttcccggtagggacgtacgggtccgggttactacgggtaacttaggtttaaccttttaccaccgttaccaacccgtaccttacccgaaccccgttacccgtacggtacccgtaacgggtaccttaaggtaacggttacgttcggttacggtactttaacgttttacttaacgttacgtaaccgtaaattaactttaactttaccgttaccgttacccggtccccggttaaccgggttacccgggttaccggggaacccgggtaaaccgtaacggttaaacgtaaaaccgtacggtaaaaccgtacgtcggtacggtaccgtacgacctactacgttaccttcgttacttccgttacccg

SEQ ID NO: 237477 - DNA, 970 bp, Homo sapiens
  misc_feature: GYAE6OF01CSBWV.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctcgtggtcgtcccgtgggacggggacctagtcggtagactacgaaccctgtcctccaacgcctcccgtggcgttgtcgtctcggtcgggacgaacggaccgacccacactaccaacgtcgacgaccgtaccacgccgaagttacgtttcgtttaccaaccctacctacctaataaggtaaaccggtaaaggtacggttacgttcggtaccgtttggtaccaacgaccgaacggaaaccggtacgggacctaccgtaccctaaccttaaaccgttaccttaccgttaacgtttaccgacccggtactaacccgttaccccggaacccggtaccggtacccggttaccggtttacccggaccggttaacccgttcccgggtttacccgggacggaccggtaccgggtaccgggttacggggtaccggtaacgttaaccggttttaacttttacccgtacccgttaacctacccggttaaccttaaccccgtaaccccgtttacccgggtcggtaaacccggtaacggggttactaaaacggggttacgttacgggtaacggtttaccggtttaacgtttaaccgtttttaaccggtaccgttaaccgtaaaaccttaaacgttaactttttaccttaaccgggtttacccttacccggtaccccgggttaccgggtacccggggggttaccccggggaaacccgggtaaaccgggtaaccgtaaaaccggggttaactaaaaccccgggtaaaggtcccggttaagggtcccggttaacccgtacccgaaaccgttccgttaacggttcctttaaacccggtccttttcccgtaaacccccgg

SEQ ID NO: 237478 - DNA, 825 bp, Homo sapiens
  misc_feature: GYAE6OF01CG8EM.48.15.B04.1.454.CMB.1.raw
  modified_base (192)..(192): a, c, t, g, unknown or other
  misc_feature (192)..(192): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatcgaccagtctccagacctccgtggctgtgtctacgnggcgacgaccggccaacatacaactgacacgtccagacctagtacgtttcgttttaccacacctaccaagtaggaaaaccgaaggtacgttaacgttggacgtttacggtacccaaggaccgaaacggaaaaccggtgggacaacggtacccttaaccgtaaaactacttactaactttaccgtacggactacgtacccgaaacccgtaacggtcccgtaacggtttacccgacggaaccggttacgttaccggtggtacgtacggggtccgggtacgtacgggactaacggtttacttttaccaccgtacgaacctaaccgttcctaaacccgtacccgttacgggacgtaacggtacgtaacggtaaaccggttaggttacgggtacggtaactttaacggttttaaccttaaacgtacggttaaaaccaaactttaaactttacttttaaccgttaacccgttaacccggcccggttaacccgggttacccggggttaccggggtaacccgggggtaaaaccctaacgggtaaaacgggtaaaacgttaacccggaaaacggttaaactcggggttcggacctaacggtaaccaccttaaacgtccgtttaacgttcgtaccgttaaccc

SEQ ID NO: 237479 - DNA, 741 bp, Homo sapiens
  misc_feature: GYAE6OF01CAJFB.48.15.B04.1.454.CMB.1.raw
  modified_base (217)..(217): a, c, t, g, unknown or other
  misc_feature (217)..(217): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctcgtggtgcctggcgggacagtcgtgatcgaccctagtcctccagacctcccgtggctgtgtctcgtgggcgagaccggccaaaaccntacaactcgacaacgtccacgaccgtaaggtacgtttgttttccaacctacccttaccagtaaggaaacgaagggtacgttacgtttcggtcgttacggtaccgacggaacaaacggaaacccggagggaccaccgtacccttaaccttaaaacctacctacttaacgtttaccgaccggactaccgtaccccgaaccccgggtaacgtacccggtacgtttcccgtagtacccgtacgttccgtacggccgaagggtccggtacgtacgggaccgtaagtttaacgtttcctccgtacctacctactacctacctacccgtacgcgagtcgtaacgagtgtaggtgaccgttagtttactttcgacgtaactaacttataactttcctaccgtacccgtaccggtacccggtaccggttaccggggaacccgggtacccgtaagtaaaccggtaaactaaccgaaacgtacgtacggtcggtccgacgtccgtaactacgttactccgttctaccgttacccg

SEQ ID NO: 237480 - DNA, 422 bp, Homo sapiens
  misc_feature: GYAE6OF01B1R3E.48.15.B04.1.454.CMB.1.raw
  modified_base (213)..(213): a, c, t, g, unknown or other
  misc_feature (213)..(213): n is a, c, g, or t
  modified_base (302)..(302): a, c, t, g, unknown or other
  misc_feature (302)..(302): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (352)..(355): a, c, t, g, unknown or other
  misc_feature (352)..(355): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (361)..(363): a, c, t, g, unknown or other
  misc_feature (361)..(363): n is a, c, g, or t
  modified_base (365)..(368): a, c, t, g, unknown or other
  misc_feature (365)..(368): n is a, c, g, or t
  modified_base (370)..(422): a, c, t, g, unknown or other
  misc_feature (370)..(422): n is a, c, g, or t
tcagagtatacatacacgaccggtgctcgatttagacagtatatatccgcggggggatttagacagtatatatccgcggggcacgacccggtagctcggattttagagagacgtgtgttgggtttgggggtgtggtggtctccactcccgccttgacgaggctgattacgtactgtcagtcttttgataacaacatcacgtcggtcgttcggnggaggtccagccgtgaccgtccgtacggtccacgacccaacggctcgccccctcggtaccaccttcttcgttcccctaccctcctactntacgtactactcgtagacggcggacgtgacagcangagntcncntacntnnnncncngnnnannnnannnnnnnnnnnnnnnnnnnnnnnnnnnnnnnnnnnnnnnnnnnnnnnnnnnnn

SEQ ID NO: 237481 - DNA, 780 bp, Homo sapiens
  misc_feature: GYAE6OF01D02P7.48.15.B04.1.454.CMB.1.raw
  modified_base (149)..(149): a, c, t, g, unknown or other
  misc_feature (149)..(149): n is a, c, g, or t
  modified_base (479)..(479): a, c, t, g, unknown or other
  misc_feature (479)..(479): n is a, c, g, or t
tcagagtatacatacacgaccggtgctcgatttagacagtatatatccgcggggggagctacaacaggcaggcaggggcagcaagatggtgttgcagacccaggtcttcatttctctgttgctctggatctctggtcgcgtggcggganatcggtgatcgaccctacgtcctaccacgtacctcccgtggcttggtcgtcctcggtcgggacgacggaccggaccacctaataccaacgtgaccaacgtccacgacctaggtacgtttcgttttaccacctaccactaagtacgaaacgtaaggtacgtacgttggtcgttacgtacagaacgaacggaaccgacggacacgtacctaacctaacgtactactacgttacgtcggacctaccgtaccgaaccggtacgtccggtaacggtccacgtaccggtcgtaccggtggacgacggtcggtacgtaggactacgttactttaccncgactacctctacctaccgtaacgcgaacgacgtacgtagtaacgtggtacggttacgtaccgtttaacgttttaaccgttagttaacgtaaactaaaccggtttaatttaacgtttctaacccgttaaccgggttacccggttaccggggttaaccgggtacccggggaaacccggggtaaacgtaaaccgggttaacggtaaaacccgtaaacgttaaccgggaaaggttcgggttaacggaccgtaaccgtaacccgtaaccttaggttaccgttacgtttaccgtaccgttaccccg

SEQ ID NO: 237482 - DNA, 717 bp, Homo sapiens
  misc_feature: GYAE6OF01BGC1K.48.15.B04.1.454.CMB.1.raw
tcagagtatacatacacgaccggtgctcgatttagacagtatatatccgcggggggagctacaacaggcaggcaggggcagcaagatggtgttgcagacccaggtcttcatttctctgttgctctggatctcgtggtgccgtggcggggacatcgtgatcggacccagtctccagtacctcccgtggctgtcgtctcgtcgggcgacggaccgaccaccatacaacgtcgacaacgtccacgccagtacgttgttttacactacctactatacgaaacgtaagggtacgttacgttggtcgttacggtaccgaacggtacgaaacggaaaccgagggtaccaacgtacccgttaaaccttaaactacgtacttaacttaccgtccggactaaccgtaccccggaaccggtacgtacccggtacgttcctacggtaccgtacgttccgacgggtacgacggtcgggtaccgtaggtaactacgttactttaccgctacgtacctacttaccaccgtaccgtgacacggtacaaggtaagcgttaggttacgtaccgtttagtttacacgtactactaacttaagttacgttactccgtacgtacccggtcgtaccgggtaccgggaccgggtaaccacggttacgaaaacgtacgtaaacggtaaggtcggtactaccggtctaccgacgttacctatccggttaactcctaacccgg

SEQ ID NO: 237483 - DNA, 870 bp, Homo sapiens
  misc_feature: GYAE6OF01A12GV.48.15.B04.1.454.CMB.1.raw
  modified_base (558)..(558): a, c, t, g, unknown or other
  misc_feature (558)..(558): n is a, c, g, or t
  modified_base (700)..(700): a, c, t, g, unknown or other
  misc_feature (700)..(700): n is a, c, g, or t
tcagagtatacatacacgaccggtgctcgatttagacagtatatatccgcgggggagctacaacaggcaggcaggggcagcaagatggtgttgcagacccaggtcttcatttctctgttgctcgtggatctctggtgccgtggcgggacagtcgtgacgtcgacccgtagttcctaccagtccctcccgtgtcgttgtcgttcgttccggtacgggcgacggcccggtacccaacctaactaccgtaacgtcgaccgtaaaccgtccgacggccgtaaggttaccgttttcgttttacccaccttaccgtacctaaggtaacgaaaccggaaggtcgtttacggtccggttaccgttttcggtacccgaacgtaccgaaaacggaacccggacgggtacccgtaacgttacccccttaaaccgttaaacccgtacctttaccgtttaaccgtttacccggtacccggtaacgtaccccggtaaccccggtaaccccggggttaaacgttccccgggttaaccggttccctaacgggtaccccgttaacgggttcccgngggacccggtacgggtcggtacggtacgggtacttacgtttccgtttaccactaacccgtacctaaccgttcccaaacccgttccgacgtaccggtacgtacgtagtaacggtcggttacggtcgttacgtttagttaaccncgttaacgtaacctaattaacttaacgttcgtacccgttaccgggtcccgttaccggtacccgggtaccggggaccgtaaccgacggttaacggaactaacggtacgtaggttaccggcgtaccgttaccacgttaacctcggttacccttgttacccctcgttaccccg

SEQ ID NO: 237484 - DNA, 916 bp, Homo sapiens
  misc_feature: GYAE6OF01EUB8V.48.15.B04.1.454.CMB.1.raw
  modified_base (149)..(149): a, c, t, g, unknown or other
  misc_feature (149)..(149): n is a, c, g, or t
tcagagtatacatacacgaccggtgctcgatttagacagtatatatccgcggggagctacaacaggcaggcagggcagcaagatggtgttgcagacccaggtcttcatttctcgtgttcgctctggatctcgtggtcgctggcgggacngttcggtatactacgacctacgttactaccgacgtacctcccgtgtcgttgtcgtccgtacggtcgggcgacggaccgaccactactacgaaacgtcgactaacgccgaacgtccgtaaggttcgttttacgttttaccaacctacccgttacaacgtacgaaaacgtacggtaacgtttcggtttacgtcgtttcgggtaccaaggtacgaaacgtaacggagaccgtactacccttaaactaaccttacgttacttaaccgttttacggaccgtacctaacgtaccccggtaaaccggtaggttacccgttacgggttacccgtacggtaacccggtttcggttacccggggcggaccggttaaccggggtcggggttaaccgttaacggggtaaccttacggtttactttacccgttaaccgtcctaaccgttacccgttacctaacccgtttcccgacgggtaaccccgttacggtaagtacggttaacgaagtttcgggttacgttaaacgttttacgttttacccggttaacttacccggttaaaactaacctttaaagttaaccggttttcccttaaccgttaaccccgggtacccgggtttacccgggtaccgggtttaccgggggaaccccggttaaaacgttacggttaaaacgaaacccggttaaaccggtaaggttaccgggttacggtaccggttcgaaacccgtacccgttacggttacttaccggttcttaacccggttccttaaccccggg

SEQ ID NO: 237485 - DNA, 800 bp, Homo sapiens
  misc_feature: GYAE6OF01BGA9N.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatcgacccagtctccagacctccgtggctgtgtctgtgggcgagacggccaccataccaacgtgacaacgtccagccaagtacgttcgttttaccacctacctaccatacggaaacgtaaggtacgttaccgtttggtcctttcgggttaccacgtaccgaacggaaaccgacgggtaccacgtacccttaaccgtaaacttaccttactactttaccgtccggtacctaccgtaccccgaaccgggtacggttacccgtaccggttaccgtacggtaaccgttacggtttcccggtacgggtccggtacgggtccggttaggtacggggtaaaccttaggtttaccttttaccgtcctacctacctaacgttccctacccgtacccgtggacggttaacgggtcttaagggaacgtgggttccggttacgggtaacttttaagtttaacgttacgtaccgtaaacgtaaactttaagttttaccttaacgttcccgttaacccggttcccggtaccgggtaccggggttccgggaacccgggtaaactaacggggttaacgaaaacttcccgggaaacgttacggtcggtccgggtactaccggaacctcggttaactttccggttacttccgtaacccttcccg

SEQ ID NO: 237486 - DNA, 772 bp, Homo sapiens
  misc_feature: GYAE6OF01E18TI.48.15.B04.1.454.CMB.1.raw
  modified_base (120)..(120): a, c, t, g, unknown or other
  misc_feature (120)..(120): n is a, c, g, or t
  modified_base (233)..(233): a, c, t, g, unknown or other
  misc_feature (233)..(233): n is a, c, g, or t
tcagagtatacatacacgaccggtgctcgatttagacagtatatatccgcgggggagctacaacaggcaggcaggggcagcaagatggtgttgcagacccaggtcttcatttctctgttnctctggatctctggtgcctggcggggacatcgtgagtcgacccgagtctccaagacctcccgtggtctgtcgtcctcgtgggcgacgccgccaccatcactgccaagtccacnccgagtacgtttcgttttaccacctaccctccgaatacgaaacgaaacggtaacgttaccgttggtcctttacggttaccgacggtaccgaaacgaaacccgtaggggacctaccgtacccgttaaccctaaaaccgttaccgttaccgttaacgtttttaacccgtccggtaccctaaccgtaacccccgaaccccggggtaacgtaccccggtacgggtttacccgtaccggaacccggttacggttcccggtaggcccgtacgggtccgggtccgtacgggaactacgttaccgtttttacctaccgtaccaccacgtaccctaccgtaccgtcgacgtcggactacggtacgtagttaggtcgtaccttaggtttaactacggttactaacctaattaacgtttacttaacgtttcccgtaaccgttccccgtaaccgggtcccggttaccgggaacccgggtaccaacggttagaaacctaacgaacggtactacggtacgcctacgacctactcgtacgtcttccacttcccg

SEQ ID NO: 237487 - DNA, 804 bp, Homo sapiens
  misc_feature: GYAE6OF01ELDR7.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatcgaccagtctccagcctcctggctgtcgtctcgtgggcgacggaccggccacctactacaacgtcgacaacgtccgacgccaggtacgtttcgtttttaccaacctaccctacctaactaacgaaaacgtaaagggtaacgttaccgtttcgggttccgtttcggttacccgacggtaccgaaaccggaaaaccggacggggaccgaaccggtaccccttaacccgttaaaaccttaccttacttaacttttaccgtaccggacctaaccgttaccccggaacccgggtaacggttcccggtacggttaccctacggtaccgtacgttccggtaggcgacgggtcgggtacgtagggtacgtaacggttacttttaccgtcctacctaacccgtacttacccgtaaccttcccggtacggacgacggtcgtaagaacgtgttcggtagttacgtttaatttaccttaacgtacttaaacaattaactttaactttaaccgtttacccgttaaccgtccccgggtacccgggttaccggggtacccggggaacccggggtaacctaaacggtacggaaaacttaccggaaaccggtacgttggccgtacgtaccaccgttacctacgttccgttattccgtacttcccg

SEQ ID NO: 237488 - DNA, 1011 bp, Homo sapiens
  misc_feature: GYAE6OF01EWYTS.48.15.B04.1.454.CMB.1.raw
tcagagtatacatacacgaccggtgctcgatttagacagtatatatccgcgggggagctacaacaggcaggcaggggcagcaagactggtgttgcagacccaggtcttcatttctctgttgctctggatcctctggtgacctggcgggacatcgtgactcgacctagtctcagacctcctggtctgtcgtctcgtggcgacggaccgccacagtacaacgtgacacgtccagaccagtagtttcgttttccacgtacctacattacgaaaccgaggtaacgttagttacgtccgtttacgttaccgaacgtacgtaaacgtaaccgaggggtctaccggtaccctaaccttaaacctaaccgttacttaaccttttacgaccggtaacctaccgttacccgtaaccccgggtaagttacccgggtacggtttccccgtaacggtacccggttaggtttacccccgggtacgggtacgtaccggggtaccgggtttaccgggtaccgggtaaacgttaacggttttaaaccttttacgttaccccggttaacctaacccgtaaccgttaacccgttaacccgtaaccccggtttttccgaaccgggttaaccgttaacggttaacgggtaaacgttaacggtttaccgggttaaccgggttaaccgttttaaccggtttttaaaccggtttaacccggttttaaacccggttaacccgtttaaaaacgttaacccgtttttaaaccgtttttaaaccctttaaccccggtttaaacccgtttaccccggggttaaccccgggttaaccccggggttttacccgggggaaccccgggggtaaacccgtttaaacgggttaaacccggtaaaacgttaaccccggtaaaaaacccgggtttaaccggtttacgggtaaacccggttaccggttaaacccggttaaccccgtaaaccggttttacccgtttaacccggtttcccgtttaacccgtttaaacccgggttaaccccc

SEQ ID NO: 237489 - DNA, 717 bp, Homo sapiens
  misc_feature: GYAE6OF01DSXU3.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtcgccgtggcggggactagtcgtgactacgacccagtcctccagtcctcccgtggctgtcgtcgtcgtgggcgacggccggacccaactactaccaacgtcgactaacgtccacgccgaggttacgtttacgttttaccaccgtacctacctagtaacgaaacgaacggtacgttacgttcggtactttcggtaccagaccgaacgaaccgagggaccacgacccgtaactaaacgtctactacttaccgacgactaccgacccgaccggtaacgtccgtacggttcccgacgtaccgtacgttcggtcggaacgtcggtccgggttcgtacggaacttaacgttacttttaccgacctaccaaccgtactaccctaacctccgagaccgtagtacgtacgtaatggtagtacggtactttaaggtttactaacgtactaactaagttaacttacgttaaccttccgtacctccggtaccggtaccggttcccggggaccggtaaccgtaacgtacggtaaactaccggaaacgtcgtcggacgtacgacgtactaccggttactacttcgtcgtctaacccg

SEQ ID NO: 237490 - DNA, 766 bp, Homo sapiens
  misc_feature: GYAE6OF01AVHKP.48.15.B04.1.454.CMB.1.raw
  modified_base (520)..(520): a, c, t, g, unknown or other
  misc_feature (520)..(520): n is a, c, g, or t
  modified_base (551)..(551): a, c, t, g, unknown or other
  misc_feature (551)..(551): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctcgtggtgcctggcggggacagtcgtgatcgacctacgtctaccacggactcccgtggcttgtgtctacgtggggacgacggaccggaccaacctagtacctaaacgtcgtaccgaacggtccaacgccgtaaggtacggtttacgtttttaccgaccttaccctctaatacgaaacgaaggtacgttaacgttggtaccttcggttaccacgtacgaaacgtaaacccggagggtccaccgtccctaaccgtaactctacttacgtttaccgtcgactaacgtaccccgaaccgggtacgtacccggtaacgtaccccgtagaacccggttcgttaccggacgtccggacgggtcgggtacggtaccgggtaagttacgttacgtttacnccctactaacctactccctaaccgttacccncggtacgaggtccgaaaggtagtacgtggttacgaacttttacgtttacttagtccgtaacgaattttaacgtactttaaccgttacctcccgtaccgggtaccgttaccggggttacccgggacgggtaacccgtaagtaccggaaactacggaaaccggtcttaggtcggtcctaacgacccgtaactgttccgtgttaccctggttaccccc

SEQ ID NO: 237491 - DNA, 886 bp, Homo sapiens
  misc_feature: GYAE6OF01CRFL1.48.15.B04.1.454.CMB.1.raw
  modified_base (679)..(679): a, c, t, g, unknown or other
  misc_feature (679)..(679): n is a, c, g, or t
tcagagtatacatacacgaccggtgctcgatttagacagtatatatccgcgggggagctacaacaggcaggcaggggcagcaagatggtgttgcagaccctaggtcttcatttctcgtgttgacctcgtggtactcttcgtggtcgcccgtagggaccggggaccagttcgagtataccgaacctacgtcctaccgacgtacctcccgtcggtcttacggtcgttccgtcggttacgggacggaccgtaccggacctaaccaacgtactaacgcgtacgaacgtacccgaacggaccgtaaagggtttctttacggttttaaccaaccccgtaaccgttacccgaaagttaacgaaaacccgggttaaggttaaccggttaaccggtttacgggtaaccgtttacggtaaccgtaacgaccgaaacggtaaacccggtacgggacctaacccgtaccctaaaccgttaaaaccttaacgttaccttaacttaaccgcgtaaccctaccgaacccggttaaccggtacgtaccggttaccgggtacctaaccggtaccgtaccgttccgggtacgacgttacgggcggttacgacgggtaacttacggttacttttaccgaaccgtactaaccgtaactaaccctaccgtacgttacgacgttacgacgtaagtaacgtntaccgggtacgtacgtttaacgttacttaacgtacgtaacaacgtttaataacttacgttacccgtacgtacccggtaccgggtaccggtacggggtacccgtaaagaacggttaacgaaagttaaccccgtaaaggtcgttaacggtcgtacgtaaccgtaccgtacgttaaacgtttccgtaacgttccttacccggtttaaacg

SEQ ID NO: 237492 - DNA, 132 bp, Homo sapiens
  misc_feature: GYAE6OF02G6F09.48.15.B04.1.454.CMB.1.raw
  modified_base (132)..(132): a, c, t, g, unknown or other
  misc_feature (132)..(132): n is a, c, g, or t
tcagagtatacatacacgaccggtgctcgatttagacagtatatatccgcgggcacgaccggtgctcgatttagagctcacgtattgggtttggggttttaggtatctgagcgggctggcaaggcgcatagn

SEQ ID NO: 237493 - DNA, 193 bp, Homo sapiens; identical to SEQ ID NO: 237400
  misc_feature: GYAE6OF02HIKC8.48.15.B04.1.454.CMB.1.raw
  modified_base (193)..(193): a, c, t, g, unknown or other
  misc_feature (193)..(193): n is a, c, g, or t

SEQ ID NO: 237494 - DNA, 194 bp, Homo sapiens; identical to SEQ ID NO: 237410
  misc_feature: GYAE6OF02GBRPJ.48.15.B04.1.454.CMB.1.raw
  modified_base (193)..(194): a, c, t, g, unknown or other
  misc_feature (193)..(194): n is a, c, g, or t

SEQ ID NO: 237495 - DNA, 183 bp, Homo sapiens
  misc_feature: GYAE6OF02IPMT6.48.15.B04.1.454.CMB.1.raw
  modified_base (157)..(157): a, c, t, g, unknown or other
  misc_feature (157)..(157): n is a, c, g, or t
  modified_base (159)..(183): a, c, t, g, unknown or other
  misc_feature (159)..(183): n is a, c, g, or t
tcagagtatacatacacgaccggtgctcgatttagacagtatatatccgcgggcacgaccggtgctccgatttagtcacgcgagaaagggaaagggacgtgtttctgttcccgccctcctctatgtatactctgagcgggctggcaaggcgcatagntnnnnnnnnnnnnnnnnnnnnnnnnn

SEQ ID NO: 237496 - DNA, 501 bp, Homo sapiens
  misc_feature: GYAE6OF02HA8PR.48.15.B04.1.454.CMB.1.raw
  modified_base (376)..(376): a, c, t, g, unknown or other
  misc_feature (376)..(376): n is a, c, g, or t
  modified_base (404)..(404): a, c, t, g, unknown or other
  misc_feature (404)..(404): n is a, c, g, or t
  modified_base (498)..(498): a, c, t, g, unknown or other
  misc_feature (498)..(498): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaaactactcatttactcggcatccacccggaagtccgaggttcctgaccgattccgtggcagcggtctgggacagattttacnctcacatcactaccctgcaggctgaagntgtgcagtttatactgtcaacatattatctactccgccgtacgttcgccggggaccaacgtgaatcgaaacgactgtgctgcaccatctgtctntac

SEQ ID NO: 237497 - DNA, 203 bp, Homo sapiens
  misc_feature: GYAE6OF02GBP3H.48.15.B04.1.454.CMB.1.raw
  modified_base (193)..(203): a, c, t, g, unknown or other
  misc_feature (193)..(203): n is a, c, g, or t
tcagagtatacatacacgaccggtgctcgatttagacagtatatatccgcgggcacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagnnnnnnnnnnn

SEQ ID NO: 237498 - DNA, 173 bp, Homo sapiens
  misc_feature: GYAE6OF02IXXF7.48.15.B04.1.454.CMB.1.raw
  modified_base (173)..(173): a, c, t, g, unknown or other
  misc_feature (173)..(173): n is a, c, g, or t
tcagagtatacatacacgaccggtgctcgatttagacagtatatatccgcgggcacgaccggtgctcgatttaagagagtgtgttgggtttgggcgtactcttccccatagtaggtcttcatcttcccgccatctgatatgtatactctgagcgggctggcaaggcgcatagn

SEQ ID NO: 237499 - DNA, 132 bp, Homo sapiens
  misc_feature: GYAE6OF02GYGNT.48.15.B04.1.454.CMB.1.raw
tcagagtatacatacacgaccggtgctcgatttagacagtatatatccgcgggcacgaccggtgctcgatttagagctcacgtattgggtttggggtttttaggtatctgagcgggctggcaaggcgcatag

SEQ ID NO: 237500 - DNA, 515 bp, Homo sapiens
  misc_feature: GYAE6OF02G55UT.48.15.B04.1.454.CMB.1.raw
  modified_base (408)..(408): a, c, t, g, unknown or other
  misc_feature (408)..(408): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaaactactcatttactcggcatccacccggaagtccgaggttcctgaccgattccgtggcagcgggtctggggacagattttactctcaccatcactaccctgcaggctagaagntgtgctagtttatactgtcaacaatattatctactccgccgtacgttcggaccggggaccacgtagaactacgaaacgaactgtgctgacacatctacgtctactac

SEQ ID NO: 237501 - DNA, 506 bp, Homo sapiens
  misc_feature: GYAE6OF02FX6FS.48.15.B04.1.454.CMB.1.raw
  modified_base (376)..(376): a, c, t, g, unknown or other
  misc_feature (376)..(376): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaaactactcatttactcggcatccacccggaagtccgaggttcctgaccgattccgtggcagcggtctgggacagattttacnctcaccatcactaccctgcaggctgaagatgtggctagtttatactgtcaactaatattatctactccgccgacgttcggccgggaccaacgtgaatcgaaacgactgtgctgcaccatctgtcttctac

SEQ ID NO: 237502 - DNA, 509 bp, Homo sapiens
  misc_feature: GYAE6OF02G0YBW.48.15.B04.1.454.CMB.1.raw
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (394)..(394): a, c, t, g, unknown or other
  misc_feature (394)..(394): n is a, c, g, or t
  modified_base (417)..(417): a, c, t, g, unknown or other
  misc_feature (417)..(417): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaccagggcagcctctaaactactcatttactcgcatccaccggaagtccgagttcctgaccgattccgtggcagcggtctggacagntttacnctcacatcactacctgcagctgaantgtgctagtttatactgtacaanaatattactctactccgcgtaccgttcggaccggggtaccaacggtgaactcgaaacgactgtacgctagaccaccatccgtcgtctactac

SEQ ID NO: 237503 - DNA, 193 bp, Homo sapiens; identical to SEQ ID NO: 237400
  misc_feature: GYAE6OF02IJXUF.48.15.B04.1.454.CMB.1.raw
  modified_base (193)..(193): a, c, t, g, unknown or other
  misc_feature (193)..(193): n is a, c, g, or t

SEQ ID NO: 237504 - DNA, 504 bp, Homo sapiens
  misc_feature: GYAE6OF02G5M2D.48.15.B04.1.454.CMB.1.raw
  modified_base (377)..(377): a, c, t, g, unknown or other
  misc_feature (377)..(377): n is a, c, g, or t
  modified_base (493)..(493): a, c, t, g, unknown or other
  misc_feature (493)..(493): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaaactactcatttactcggcatccacccggaagtccgaggttcctgaccgattccgtggcagcgggtctgggacagattttacnctcacatcactaccctgcagctagaagatgtgctagttattactgtacaacatattatctactccgccgtacgttcggccggggtacacgtgaatcgaaacgtactgtgctgcacntctgtcttcac

SEQ ID NO: 237505 - DNA, 196 bp, Homo sapiens
  misc_feature: GYAE6OF02FWZ42.48.15.B04.1.454.CMB.1.raw
  modified_base (193)..(196): a, c, t, g, unknown or other
  misc_feature (193)..(196): n is a, c, g, or t
tcagagtatacatacacgaccggtgctcgatttagacagtatatatccgcgggcacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagnnnn

SEQ ID NO: 237506 - DNA, 521 bp, Homo sapiens
  misc_feature: GYAE6OF02F1YLB.48.15.B04.1.454.CMB.1.raw
  modified_base (311)..(311): a, c, t, g, unknown or other
  misc_feature (311)..(311): n is a, c, g, or t
  modified_base (380)..(380): a, c, t, g, unknown or other
  misc_feature (380)..(380): n is a, c, g, or t
tcagagtatacatacacgaccggtgctcgatttagacagtatatatccgcgggggagctacaacaggcaggcaggggcagcaagatggtgttgcagacccaggtcttcatttctctattgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccaggggcagcctcctaaactactcatttacncggcatccacccggaagtccgaggttcctgaccgattccgtggcagcgggtctgggacagtattttacnctcaccatcactaccctgcaggctagaagatgtggctagtttattactgtacaactaatattattctactccgccgtacgttcggccggggaccaacgtgaaactcgaaacgaactgtggctgacaccatctgtcttctac

SEQ ID NO: 237507 - DNA, 542 bp, Homo sapiens
  misc_feature: GYAE6OF02HAQOE.48.15.B04.1.454.CMB.1.raw
  modified_base (410)..(410): a, c, t, g, unknown or other
  misc_feature (410)..(410): n is a, c, g, or t
  modified_base (538)..(538): a, c, t, g, unknown or other
  misc_feature (538)..(538): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggtccagcagaaaccagggcagcctacctaaactactcatttactcggcactccacccggaagtccgaggttcctgaccgtattccgtggcaggcgggtctgggacagtatttactctcaccatccactaccctgcaggctagaantgtgctagtttatctgtacaacaattattattctaccttccgaccgtacggttccgggcccggggtaaccaacggtagaaactacgaaaacgtactggtcggtctgacctaccattcctcgttccttntacc

SEQ ID NO: 237508 - DNA, 525 bp, Homo sapiens
  misc_feature: GYAE6OF02HFRA6.48.15.B04.1.454.CMB.1.raw
  modified_base (347)..(347): a, c, t, g, unknown or other
  misc_feature (347)..(347): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (409)..(409): a, c, t, g, unknown or other
  misc_feature (409)..(409): n is a, c, g, or t
  modified_base (433)..(433): a, c, t, g, unknown or other
  misc_feature (433)..(433): n is a, c, g, or t
  modified_base (508)..(508): a, c, t, g, unknown or other
  misc_feature (508)..(508): n is a, c, g, or t
  modified_base (521)..(521): a, c, t, g, unknown or other
  misc_feature (521)..(521): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcacacctccatgaacaaggagtacttggcttggttccagcagaaaccagggcaggcctacctaaactactctatttactcggcatccaccggaagtccgagttcctgaccgtnttccgtggcaggcggtctgggacagtacttttacnctcacntcactacctgcaggctagaanatgtgctagtttatactgtacaanattattattctactccgccgtacggttccggccgggacaagtacgaataccgaaacgactggtggactgcctacnttcgtcgttcttntacc

SEQ ID NO: 237509 - DNA, 529 bp, Homo sapiens
  misc_feature: GYAE6OF02IIDXJ.48.15.B04.1.454.CMB.1.raw
  modified_base (352)..(352): a, c, t, g, unknown or other
  misc_feature (352)..(352): n is a, c, g, or t
  modified_base (380)..(380): a, c, t, g, unknown or other
  misc_feature (380)..(380): n is a, c, g, or t
  modified_base (407)..(407): a, c, t, g, unknown or other
  misc_feature (407)..(407): n is a, c, g, or t
  modified_base (513)..(513): a, c, t, g, unknown or other
  misc_feature (513)..(513): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcacacctccatgaacaaggagtacttggcttggttccagcagaaaccagggcagcctacctaaactactcatttactcgcatccacccggaagtccgaggttcctgaccgtattccgngcaggcggtctgggacagtacttttacnctcacatcactacctgcagctagaagntgtgactagtttattactgtacaactaatattatctactccgaccgtacggtcggaccggggtacaacggtagaacgtacaaacgtactggtcgctacgcaaccgnttctgttccttctacc

SEQ ID NO: 237510 - DNA, 509 bp, Homo sapiens
  misc_feature: GYAE6OF02IEEFG.48.15.B04.1.454.CMB.1.raw
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (506)..(506): a, c, t, g, unknown or other
  misc_feature (506)..(506): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcacacctccatgaaacaaggagtacttggcttggttccagcagaaaccngggcagcctacaactctcatttacncgcatccgaccggatccgagttcctgaccgattccgngcagcgggtcngggacagtntttactctcacntcactacctgcagctgaagntgngtctagtttatatgtacaataattattactactactccgccgtacggttcggccgggacaagtggaaactcgaaacgtactgcgactcgcacctattctagttctntac

SEQ ID NO: 237511 - DNA, 195 bp, Homo sapiens
  misc_feature: GYAE6OF02HJWVR.48.15.B04.1.454.CMB.1.raw
  modified_base (193)..(195): a, c, t, g, unknown or other
  misc_feature (193)..(195): n is a, c, g, or t
tcagagtatacatacacgaccggtgctcgatttagacagtatatatccgcgggcacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagnnn

SEQ ID NO: 237512 - DNA, 509 bp, Homo sapiens
  misc_feature: GYAE6OF02FZIVB.48.15.B04.1.454.CMB.1.raw
  modified_base (380)..(380): a, c, t, g, unknown or other
  misc_feature (380)..(380): n is a, c, g, or t
  modified_base (412)..(412): a, c, t, g, unknown or other
  misc_feature (412)..(412): n is a, c, g, or t
  modified_base (487)..(487): a, c, t, g, unknown or other
  misc_feature (487)..(487): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactctcatttactcggcatccacccggaagtccgaggttcctgacccgattccggtggcaggcgggtctgggacagattttacnctcaccatcactaccctgcaggctgaagatgngctagtttatactgtacaactaatattatctactccgaccacgttcggccgggacacgtgaaatcaaacgactgngctgcaccatctntcttntacg

SEQ ID NO: 237513 - DNA, 311 bp, Homo sapiens
  misc_feature: GYAE6OF02JCNIK.48.15.B04.1.454.CMB.1.raw
  modified_base (309)..(311): a, c, t, g, unknown or other
  misc_feature (309)..(311): n is a, c, g, or t
tcagagtatacatacacgaccggtgctcgatttagacagtatatatccgcggggatttagacagtatatatccgcgggcacgaccggtgctcgatttagagagagtgtgttgggtttgggggtgtggtggtctccactcccgccttgacgaggctgattactactgtcagtcttttgataacaacaatcacgtggtcttcggcggaggaccagcctgaccgtcctaggtcagcccaaggctgccccctcggtcactctgttcccgccctcctctatgtatactctgagcgggctggcaaggcgcatagnnn

SEQ ID NO: 237514 - DNA, 507 bp, Homo sapiens
  misc_feature: GYAE6OF02FF9AV.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaaagttgctcttttactgggcgtcttcccgggagtccggggtccctgaccgattcagtgccagcgggtctgggacagacttcactctcaccatcagcgcctgcaggctgaagatgtggcagtttattactgtcagcactgttttgcggtttctccgactttcggcgagggaccaggtggaggtcaacgactggtgctgcaccatctgtcttcg

SEQ ID NO: 237515 - DNA, 522 bp, Homo sapiens
  misc_feature: GYAE6OF02GUWYJ.48.15.B04.1.454.CMB.1.raw
  modified_base (376)..(376): a, c, t, g, unknown or other
  misc_feature (376)..(376): n is a, c, g, or t
  modified_base (426)..(426): a, c, t, g, unknown or other
  misc_feature (426)..(426): n is a, c, g, or t
  modified_base (512)..(512): a, c, t, g, unknown or other
  misc_feature (512)..(512): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaaactactcatttactcggcatccaccccggaagtccgaggttcctgaccgattccgtgcagcggtctgggacagattttacnctcaccatccactaccctgcacggctgaagatgtggctagtttattactntctaaacaattattattctacctccgtccgtacgttcggaccggggaccaacgtagaatcgaaacgactgtgctcgacacatcgtntacttctacg

SEQ ID NO: 237516 - DNA, 539 bp, Homo sapiens
  misc_feature: GYAE6OF02GPS1R.48.15.B04.1.454.CMB.1.raw
  modified_base (390)..(390): a, c, t, g, unknown or other
  misc_feature (390)..(390): n is a, c, g, or t
  modified_base (514)..(514): a, c, t, g, unknown or other
  misc_feature (514)..(514): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctacctaaactactctatttactcggcactcccaacccggaagtccgtacggttcctagaccgtattccgtggcacggcgggtctgggacagtacttttacnctcaccatccacctaccctgccgaggctagaagtagtggtgactagtttatacgtgtacaaactattattactctacctccgcgtacgttcggaccgggacaacggtgaaatcgaaacgatcgngctgactccatcgtagttctactac

SEQ ID NO: 237517 - DNA, 547 bp, Homo sapiens
  misc_feature: GYAE6OF02GSSAK.48.15.B04.1.454.CMB.1.raw
  modified_base (305)..(305): a, c, t, g, unknown or other
  misc_feature (305)..(305): n is a, c, g, or t
  modified_base (399)..(399): a, c, t, g, unknown or other
  misc_feature (399)..(399): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaactctaagtgctctttacnggtctcgttcccgggagtccgggtcctgaccgatcacgtcgcagcggtctgggacagactcactctcacctatcagccgctgcaggctagaagngtgtggctagtttactacgtgtcagtcacgtttggtttcggcgtttccgtcgtaccgtttcgggaggtacgggacctagggtggtaacgggtacaaaacggtacgtcggttcggcgttacggcctaaccacgttcgtcgtaccttacg

SEQ ID NO: 237518 - DNA, 535 bp, Homo sapiens
  misc_feature: GYAE6OF02FU2NZ.48.15.B04.1.454.CMB.1.raw
  modified_base (307)..(307): a, c, t, g, unknown or other
  misc_feature (307)..(307): n is a, c, g, or t
  modified_base (411)..(411): a, c, t, g, unknown or other
  misc_feature (411)..(411): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaccagggcagcctcctaaacactcatttacncgcatccacccggaagtccgaggttcctaccgattccgtggcagcgggtctgggacagtatttactctcactatacactaccctgcaggctagaagatgtcggntaagttttattactgtacaactaattattattctacgtccgaccgtacgttcggccggggtaaccaacggtggaactcaaacgtacgtgtcggctacgacaccattccgtgtacttcattcccg

SEQ ID NO: 237519 - DNA, 507 bp, Homo sapiens
  misc_feature: GYAE6OF02I2ZRI.48.15.B04.1.454.CMB.1.raw
  modified_base (377)..(377): a, c, t, g, unknown or other
  misc_feature (377)..(377): n is a, c, g, or t
  modified_base (405)..(405): a, c, t, g, unknown or other
  misc_feature (405)..(405): n is a, c, g, or t
  modified_base (504)..(504): a, c, t, g, unknown or other
  misc_feature (504)..(504): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaaactactcatttactcggcatccacccggaagtccgaggttcctgaccgattccgtggcagcgggtctgggacagattttacnctcaccatcactaccctgcaggctgaantgtgctagtttattactgtacaactaatattattctactccgccgtacgttcggccggggacacgtgaactcgaaacgactgtgctgcacatctgtctntac

SEQ ID NO: 237520 - DNA, 541 bp, Homo sapiens
  misc_feature: GYAE6OF02HYQI4.48.15.B04.1.454.CMB.1.raw
  modified_base (313)..(313): a, c, t, g, unknown or other
  misc_feature (313)..(313): n is a, c, g, or t
  modified_base (531)..(531): a, c, t, g, unknown or other
  misc_feature (531)..(531): n is a, c, g, or t
  modified_base (537)..(537): a, c, t, g, unknown or other
  misc_feature (537)..(537): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcacacctccatgaacaaggagtacttggcttggttccagcaagaaaccagggcagcctacctaaactactcatttaccncggcactccacccggaagtccgaggttcctgaccgtacttccgtggcaggcgggtctgggacagtattttactctcaccatcacctaccctgacaggctagaagattgtcggtctagtttattactgtaccaataattattattctactccgacgtaccggtcggaccggggtacaacggtagaactacgaaacgtaactggtgtctgaccacatctntccttntacc

SEQ ID NO: 237521 - DNA, 521 bp, Homo sapiens
  misc_feature: GYAE6OF02F8NME.48.15.B04.1.454.CMB.1.raw
  modified_base (374)..(374): a, c, t, g, unknown or other
  misc_feature (374)..(374): n is a, c, g, or t
  modified_base (518)..(518): a, c, t, g, unknown or other
  misc_feature (518)..(518): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaaactactcatttactcgcatccacccggaagtccgagttcctgaccgattccgtggcagcggtctggacagtattttacnctcacatcactaccctgcaggctagaagatgtgctagtttatactgtacaacaatattatctactccgaccgtacgttcggaccggggaaccacggtagaaatccgaaaacgaacttggtacggctagccacagtctggtcttntac

SEQ ID NO: 237522 - DNA, 343 bp, Homo sapiens
  misc_feature: GYAE6OF02G6BPA.48.15.B04.1.454.CMB.1.raw
  modified_base (314)..(343): a, c, t, g, unknown or other
  misc_feature (314)..(343): n is a, c, g, or t
tcagagtatacatacacgaccggtgctcgatttagacagtatatatccggtcgggggatttaagacacgtatagtatccgccgggcacgaccggtgctcgattttagagagagtgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccacctctctatgtatactctgagcggctggcaaggcgcatagnnnnnnnnnnnnnnnnnnnnnnnnnnnnnn

SEQ ID NO: 237523 - DNA, 195 bp, Homo sapiens; identical to SEQ ID NO: 237511
  misc_feature: GYAE6OF02HNFGE.48.15.B04.1.454.CMB.1.raw
  modified_base (193)..(195): a, c, t, g, unknown or other
  misc_feature (193)..(195): n is a, c, g, or t

SEQ ID NO: 237524 - DNA, 720 bp, Homo sapiens
  misc_feature: GYAE6OF02I2FKU.48.15.B04.1.454.CMB.1.raw
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
tcagagtatacatacacgaccggtgctcgatttagacagtatatatccgcgggggagctacaacaggcaggcagggcagcaagatggtgttgcagacccaggtcttcatttctctgttgctctggatctctggtgcctggcggggacatcgtgatgacccagtctccagacctccctggctgtgtctcgtgggcgagacggccaccatcaactgacaacgccaagccagagttcgttttaccacacctcatacgaacaggagtacttagcttggttccagcagaaaccgnggcagcctaacctaactactctactttacncggctacgtcccaacccggtaagtccgtaggttccctgaccgtactttccgacggtaccgaggtccggtcgtaggggaaccttaaggttactttttaccgacctaccgtaacctaacgtaccctaacctaaccccgttcgaccgtaggtactaacgtaaaggtcttaggtacgggttacttaacgttttaacttacgtacgttaacctaaacgtaaattttaaccgtttattttaccccgacgttacccgaaccgggtttaccgtttaccgggaccccgggggtaaccttaacggggtaacggtaaacgttaaacccgtaaacggtaaaccttccggggttagacccggttaacgtacccgtaaccttaagttcccgttacggtttaccttaccgtaccg

SEQ ID NO: 237525 - DNA, 621 bp, Homo sapiens
  misc_feature: GYAE6OF02HY3ZR.48.15.B04.1.454.CMB.1.raw
  modified_base (314)..(314): a, c, t, g, unknown or other
  misc_feature (314)..(314): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatgacccagtctccagactccctggctgtgtctcgtgggcgagacggccaccatcaactgcaagtccagccagagttgttttcactacctccatgaacaaggatacgtggtcttggttccagcaagaaccagggcagcctacaaactctctattactcgnactccgaccgaagtccgagtcctgaccgattcgtgcacggcggtctggactagttcttttaactcgtacctactactacctacctaccctgacgtaggtactagaacgtatggtggtactagtttaacgttactgtaactaaacgtaattaactttacgtttaaaaccttccgttacccgtaccgttaccggttaccgggacccggggtaaccgtaacggtacggtaaacgttaaccgaaacgtaacgttacggtcggtaaccgttcggacctaccgtacgttaccgtcttaccgttacttaacccg

SEQ ID NO: 237526 - DNA, 531 bp, Homo sapiens
  misc_feature: GYAE6OF02G8EAP.48.15.B04.1.454.CMB.1.raw
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (405)..(405): a, c, t, g, unknown or other
  misc_feature (405)..(405): n is a, c, g, or t
  modified_base (426)..(426): a, c, t, g, unknown or other
  misc_feature (426)..(426): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcgcatccaccggaagtccgaggttccngaccattccgnggcagcgggtctgggacagtattttactctcaccatcactaccctgcaggctgaagntgtgctagtttatctgtcaanaattattattcctaactccgccgtacggttcggaccggggtaccaaggtgaaactcgaaacgaacttggcggacttgacctaccattcctggttacttactaccg

SEQ ID NO: 237527 - DNA, 134 bp, Homo sapiens
  misc_feature: GYAE6OF02GQ6E7.48.15.B04.1.454.CMB.1.raw
  modified_base (134)..(134): a, c, t, g, unknown or other
  misc_feature (134)..(134): n is a, c, g, or t
tcagagtatacatacacgaccggtgctcgatttagacagtatatatccgcgggcacgaccggtgctcgatttagagctcacgtattgggtttggggttttttaggtatctgagcgggctggcaaggcgcatagn

SEQ ID NO: 237528 - DNA, 554 bp, Homo sapiens
  misc_feature: GYAE6OF02JFV9P.48.15.B04.1.454.CMB.1.raw
  modified_base (377)..(377): a, c, t, g, unknown or other
  misc_feature (377)..(377): n is a, c, g, or t
  modified_base (408)..(408): a, c, t, g, unknown or other
  misc_feature (408)..(408): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctacctaaactactctatttactcggcatccaccggaatccgagttcctgaccgtattccgtgcaggcggtctgggacagtattttacnctcaccatcactacctgacaggtctagaagntggtgctagttttactacgtgtacaaactattattacttctacctccgaccgtacggttccgggaccggggtaccaacggtacgaaactacgaaaccgactggtaggccttaggccctaacgtactcgttcgttcctttacgtacc

SEQ ID NO: 237529 - DNA, 530 bp, Homo sapiens
  misc_feature: GYAE6OF02GKP7N.48.15.B04.1.454.CMB.1.raw
  modified_base (379)..(379): a, c, t, g, unknown or other
  misc_feature (379)..(379): n is a, c, g, or t
tcagagtatacatacacgaccggtgctcgatttagacagtatatatccgcgggggagctacaacaggcaggcaggggcagccaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaaactactcatttactcggcatcccacccggaagtccgaggttcctgaccgattccgtggcagcgggtctgggacagattttacnctcaccatcactaccctgcagctgaagatgtgctagtttattactgtacaactaatattattactactccgccgtacgttcggacccggggtaccacggtaggaaactaccgaaacgtaactggtcgtctcgcaccatctgtccttctacc

SEQ ID NO: 237530 - DNA, 540 bp, Homo sapiens
  misc_feature: GYAE6OF02HQL6B.48.15.B04.1.454.CMB.1.raw
  modified_base (382)..(382): a, c, t, g, unknown or other
  misc_feature (382)..(382): n is a, c, g, or t
  modified_base (411)..(411): a, c, t, g, unknown or other
  misc_feature (411)..(411): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagacagagtgttttcacacctccatgaacaaggagtactggcttggttccagcaagaaaccagggcagcctacctaaaactactcactttactccggcatcccacccggaagtccgaggttcctgaccgattccgtgcagcgggtctgggacagtattttacnctacaccatcacctacctgcagctgaagntgtgtcagtttatactgtacaactaatattattcctactccgccgtacggttcggaccgggggtaccaacgtaggtaaatacgaaacgtactagtcggacgtgaccaccattacgtcttcgtactaacc

SEQ ID NO: 237531 - DNA, 717 bp, Homo sapiens
  misc_feature: GYAE6OF02ICCKT.48.15.B04.1.454.CMB.1.raw
  modified_base (249)..(249): a, c, t, g, unknown or other
  misc_feature (249)..(249): n is a, c, g, or t
  modified_base (299)..(299): a, c, t, g, unknown or other
  misc_feature (299)..(299): n is a, c, g, or t
  modified_base (434)..(434): a, c, t, g, unknown or other
  misc_feature (434)..(434): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgccgtggcggggacatcgtgatgacccagtcctccacgacctcccgtggctgtgtctcgtgggcgagaccggccaccatcaactgacaagtccagccagagttcgttttcaacncctcatagaacaaggagtacgtggtcttcggttaccagacaacgaaaccnggcagtccctacctaaactcactattactcggactactccccgaaccggtacgtaccgtaagttccctcgtaaccacgtttccggacggcgaacgggccggttcgtacggggaactaacggttacgttttaaccncccgttacaccctacttacccgtaacctaccccgtcggactacgggtcctaggaaacgtgtggtacggtaccttaaggttttacttaacgttacgtaacaaacgttaaacttactttaacttaccttaaccgtaccccggtaccgtaccggtttaccggggaccccggggtaacggtaaacccgtaggtaaaaccgtaacccgttaaaacgggaaaccttcgggttaacgggaccttacggaacccggtacccttaatacccttcggttacctttactacccg

SEQ ID NO: 237532 - DNA, 568 bp, Homo sapiens
  misc_feature: GYAE6OF02GQJDF.48.15.B04.1.454.CMB.1.raw
  modified_base (426)..(426): a, c, t, g, unknown or other
  misc_feature (426)..(426): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagacctccctggctgtgtctctgggcgagacggccaccatcaactgcaagtccagccagagttgttttcacacctccatgaacaaggagtacttggcttggttccagcagaaaccagggcacgccctacctaaaactactctatttactcggcactcccaacccggaagtccgaggttcctgacccgtattccgtggcaggccgggtcgtgggacagtacttttactctcaccatccacctaccctgcaggctagaagntggtggcttagtttatacgtgtaccaataattatttacttactaccttccgccgtaccggttccgggaccggggtaccaacggtagaaactccgaaaacgtacttggacggactcgacaccgtatcgtcgttacctcgtacc

SEQ ID NO: 237533 - DNA, 813 bp, Homo sapiens
  misc_feature: GYAE6OF02JF7LK.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtcctcagactccctggctgtgtctctgggcgagacggccaccagtaccaactgcaacgtccacgccagacgttgttttccactacctccatagaaacaaggagttaacgttcggtcttcggtaccacgtcaacggaaaccacgggtcacgtacctacctaaactactactactttacgcggtactactaccccgtaaccggtaagtccggtaacgttccgtaggtacccgtaacgttccgttacgggcctacgggtccggggttcgtacgggggtaacctaacggtttaacgtttttaccctaccgttaccgaacccttaacttacccgaaccgttttaccccccgaggaccgttacgggacttacggaaaacgtcgttacggtggtaacctttaacggttttaaccgttacgttaacggtaaacccttaaaacgttaaacgtttaccgttttaacgttaccgtttacccctaaccccgggttaccgggtttacccgggtttaccccgggggaacccggggtaaacccgtaaacccggggtaggtaaaaacccgttaaccggaaaaccggttaaccgttaggggttaccgaccgtttaaggccccttaaccgttaaggttccccgtttagttaccccttagttaacccccg

SEQ ID NO: 237534 - DNA, 696 bp, Homo sapiens
  misc_feature: GYAE6OF02H4P9B.48.15.B04.1.454.CMB.1.raw
  modified_base (688)..(688): a, c, t, g, unknown or other
  misc_feature (688)..(688): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatgacccagtctccagacctccctggctgtgtctcgtgggcgagaccggccaccatcaactgcagtccagcagagtgttttacactacctccatagaacaaggagttacttggcgtttcggtccagcaagaaaccgagggacacgcctacctaaactacctactatttactcgcactacccgaaccgaagtccgtacgttcctacgtaccgtattccgtcggacacggtccgggtcgtagggacacgtacttttactcctactaacctataccaccgttaccctggacctaggcctaaggaacgtagttcgggtacggtaccgttaaggttttacttaacgtagtaaaccctaaacgttaaattaacttttacttaccctacccggttacccgacccggttaaccgggttccgggggaaccccgggggttaaccctaacgggttaacggaaaccgttaaaccggtaaaacggaaccgtttagggaccggttaccacggtacccaaccgttacgttaccgtttcgtttacccttntaaccccg

SEQ ID NO: 237535 - DNA, 550 bp, Homo sapiens
  misc_feature: GYAE6OF02GH5D8.48.15.B04.1.454.CMB.1.raw
  modified_base (416)..(416): a, c, t, g, unknown or other
  misc_feature (416)..(416): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctacctaaactactctatttactcggcactccaacccggaagtccgacggttcctgaccgattccgtgcaggcgggtctgggactaggtacttttactctcacatccactaccctgcaggctagaagntgtgactagtttatactgtacaaataattattacttctaacctccgccgtaacgttccgggaccggggaaccacggtagtaaactaccaaaacggacttggtcggctacgctaccattctcgttcttactaccg

SEQ ID NO: 237536 - DNA, 593 bp, Homo sapiens
  misc_feature: GYAE6OF02GML8H.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagtcagaaaccaggggcagcctcctaaacgtacctactatttactcggacatcccgacccggtaagtcccggaggttcctgaccggtattccgtggcaggcgggtcgtgggacaggtacttttacgtctcgtacctatcctacctacccctgacgtaggctaggaacgatggttcggctaagttttacttactcgttacaaactaattacgttacttcctaccgttccgaccgttacggttccgggccggggtaacctacggtaggtaaactcgaaaacggtacctggtagccttgacctaccgattcctagttctctaaccg

SEQ ID NO: 237537 - DNA, 609 bp, Homo sapiens
  misc_feature: GYAE6OF02JHKR8.48.15.B04.1.454.CMB.1.raw
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (410)..(410): a, c, t, g, unknown or other
  misc_feature (410)..(410): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcaccacctccatacgaacaaggtacgtacttggtcttggttccagacaagaaccgaggacacgtcctacctaactactntattacncgacactacccgaccggtaacgtccgacggttcctacgaccgtacgttccggtggacgaggccggtacgtaggaacctagtacttttacnctcgacctatacccgtaactacccgtgaccgagggtactagaaagtacgttggtacgtactagttttactactagtacaaagtaattattacttcctacgtccgtaccgttacgggttcccggaccgggaaccgtaacgtaggtaactacgtaaacgagtgtacggctacggactacctagtccttcggtacttctacc

SEQ ID NO: 237538 - DNA, 581 bp, Homo sapiens
  misc_feature: GYAE6OF02I1UN1.48.15.B04.1.454.CMB.1.raw
  modified_base (338)..(338): a, c, t, g, unknown or other
  misc_feature (338)..(338): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcacacctccatgaacaaggatacttggcttggttcagcagaaaccagggcagcctactaaactactctactttactcgcactaccaccggaagtccgagttccngaccgtatccgtgcaggtcgggtcgtgggactagtacttttacgtctacactactcctaacctaccctggactagcgtaggaaagtcgttggtcgtacttagttttactacgtagtaacaactaattatttactacctaccgtccgtaccgtacgggttccgggaccggggtaacctaggtagaaacgtacgaaacgtacgttggacgtcgtacgacctactactcgtcgtcccttatacccg

SEQ ID NO: 237539 - DNA, 853 bp, Homo sapiens
  misc_feature: GYAE6OF02IWI99.48.15.B04.1.454.CMB.1.raw
  modified_base (550)..(550): a, c, t, g, unknown or other
  misc_feature (550)..(550): n is a, c, g, or t
tcagagtatacatacacgaccggtgctcgatttagacagtatatatccgcggggaggcgtacaacaggcaggcagggcagcaagatggtgttgcagacccaggtcttcatttctctgttgctctggatctctggtgcctgcggggacatcgtgatgacccagtctccagacctccctggctggtgtctcgtgggacagaccggccaccatccaactcggactaagtccccagacccgagaggtttcgtttttaccaacctaccctccgtattacgaaaccgtaaagggtacgttaaccgtttggtccgtttacgggttaccccaagggaccaaacggtaaaaccccgaggggcccttaaacggtcccctaacccttaaaacgttacctactaacgttttacccgtccgggacctaacttaccccgaaccccgggtaacgttccggtaaccggtttcccctaggaaaccccgtttagttacccggttgggacccaacgggggtcccgggttacgtaccggggtacctaacggtttaccgttttttaacccnccgttacccgtacccttacctacccgtaacccgttaccccgtacggtaaccggtacggtaccgtaaggtaaacggttacgttacgggttacgggtactttaaggttttaacttacgttacggttaacctaaacgttaatttaactttaacgtttaccgttaaccgttacccggttaccgggttaaccgggttacccgggaacccggggtaacgttaaccggacggttaaaccgtacggtaaacgttaacgtcggtacgaccgtacgtacctacccgtacgttccgttaccgttcttacccgtc

SEQ ID NO: 237540 - DNA, 559 bp, Homo sapiens
  misc_feature: GYAE6OF02FQAFE.48.15.B04.1.454.CMB.1.raw
  modified_base (279)..(279): a, c, t, g, unknown or other
  misc_feature (279)..(279): n is a, c, g, or t
  modified_base (410)..(410): a, c, t, g, unknown or other
  misc_feature (410)..(410): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggtccagcagaaccngggcagcctcctaaactctcatttactcgcactccacccggaagtcccgtaggttcctgaccgattccgtggcagcgggtctgggacagtattttactctcacctatcctaactccctgccagctagaagntggtgctagtttatactgtacaataattattattctacctccgtaccgacgttcccgggaccggggtacctaacggtagtaaactacgtaaaaccggaccttagggtcggacgtacgaccaccgtacttccgtacgttccttactaccg

SEQ ID NO: 237541 - DNA, 628 bp, Homo sapiens
  misc_feature: GYAE6OF02HTIMF.48.15.B04.1.454.CMB.1.raw
  modified_base (321)..(321): a, c, t, g, unknown or other
  misc_feature (321)..(321): n is a, c, g, or t
tcagagtatacatacacgaccggtgctcgatttagacagtatatatccgcgggggagctacaacaggcaggcagggggcagcaagatggtgttgcagacccaggtcttcatttctctgttgctctggatctctggtgcctggcggggacatcgtgatgacccagtctccagacctccctggctgtgtctcgtgggcgagaccggccaccatacaactgacaagtccagccagtagttcttttcacacctccatcgaacaaggagtacgtggtcttggtccagcagaaaccgagggcagcctacctaaactactcatttacncgcatccaaccggagtccgtagttcctacgaccgtacttccgtggcaggcgggtcgtgggactagtacttttactctaccacctactccaaccttaccctgactagggtactacgaaagtagttggtaggaccttaagttttacttaacgtcgtaacaaacgtaaatttactttaacttccttaaccgtcccggaccgttacgggttccgggacccggggaaccgtaacggtacggtaaactaccgaaaacggtaccgttggtacggtacctagacctaccgattccggttagttaccttactaccg

SEQ ID NO: 237542 - DNA, 196 bp, Homo sapiens; identical to SEQ ID NO: 237505
  misc_feature: GYAE6OF02GDAQN.48.15.B04.1.454.CMB.1.raw
  modified_base (193)..(196): a, c, t, g, unknown or other
  misc_feature (193)..(196): n is a, c, g, or t

SEQ ID NO: 237543 - DNA, 617 bp, Homo sapiens
  misc_feature: GYAE6OF02IPS82.48.15.B04.1.454.CMB.1.raw
  modified_base (400)..(400): a, c, t, g, unknown or other
  misc_feature (400)..(400): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactcccgtggctgtgtctcgtgggcgaggacggccaccatcaactgcaacgtccagccagtagttgttttcacacctccatgaacaaggagtacttggcttggttccagcagaaaccagggcagcctacctaaactacactatttactcggcatcccgaccggaagtcccgaggttccctagaccgtacttccgtggcaaggtccgggtcacggggacagtactttttacncctactacccattccaacttaccctgcgaggtctagaacgatcggtggactagtttacttacgtcgtactaaacacgtttaatttagtccttaacctcccgtacccgtacgggttaccggccgggggaaccctaacgggtacggtaaaactacggaaactaacgtggtaccggacgttcgaccaccgtacgttaccttcggttccgttacttacccg

SEQ ID NO: 237544 - DNA, 725 bp, Homo sapiens
  misc_feature: GYAE6OF02FFJFH.48.15.B04.1.454.CMB.1.raw
  modified_base (328)..(328): a, c, t, g, unknown or other
  misc_feature (328)..(328): n is a, c, g, or t
  modified_base (450)..(450): a, c, t, g, unknown or other
  misc_feature (450)..(450): n is a, c, g, or t
tcagagtatacatacacgaccggtgctcgatttagacagtatatatccggcgggggagctacaacaggcaggcaggggcagcaagatggtgttgcagacccaggtcttcatttctctgttgctctggatctctggtgcctgcggggacatcgtgatgacccagtctccagactccctggctgtgtctcgtgggcgagacggccaccatcaactgcaacgtccagcagagttgttttcacacctccatacgaacaagggtatactttggctttggttccagtcagaaaccaggggcacgccgttacctaaactacctctaattttaccncggtacactcccgaaccccggtaagtcccggtaacggtttcctacggtacccgtagtttcccggtagggacctaacggggtccgggtccgtacggggtaacctaggttaaccttttttaacnccttaccgaaccctactacctaaccgtaaccctaggtcgaacgggtcgtaagaaacgtacgttcggtacggactttaacgttttaacgttacttacgttaacctaaagttaatattttaactttccttaaccgtcccgttaccggtaccggttacccgggaccggggtaaccctaacggttacggaaagtacccgtaaaaaccggtaacgtacggttaccggtacgtacgacctaacccgttaatcccggtttaccgttacctttactaaccccg

SEQ ID NO: 237545 - DNA, 587 bp, Homo sapiens
  misc_feature: GYAE6OF02G59P2.48.15.B04.1.454.CMB.1.raw
  modified_base (302)..(302): a, c, t, g, unknown or other
  misc_feature (302)..(302): n is a, c, g, or t
  modified_base (397)..(397): a, c, t, g, unknown or other
  misc_feature (397)..(397): n is a, c, g, or t
  modified_base (571)..(571): a, c, t, g, unknown or other
  misc_feature (571)..(571): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagacctccctggctgtgtctcgtgggcgaggacggccaccatacaactgacaagtccagccagtagttcgttttcactacctcctaatcgaaacaaggtagttaacttggtcttggttccagtcaacgaaaccgngggacacgcctacctaaactctctactttacgcggcactacccgaccggtaagtccgacggttccacgaccgtattccggagcgacggcgggtcncggggaactaggtacttttaccgctccacctatccaaccttaccctgcgtagctaggaactgtcggtgcttaagtttactacgtagtacaaatattattacttcctaacgccgtacgtcgtccggaccgggtacaaggtacgaactacgaacgacttggacgcgtacgctaacnctctacttctctaccg

SEQ ID NO: 237546 - DNA, 609 bp, Homo sapiens
  misc_feature: GYAE6OF02FLRG3.48.15.B04.1.454.CMB.1.raw
  modified_base (313)..(313): a, c, t, g, unknown or other
  misc_feature (313)..(313): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagacctccctggctgtgtctctgggcgagacggccaccatcaactgcaagtccagccagagttgttttcacacctccatgaacaaggagtacttggcttggttccagcagaaccagggcacgcctacctaaactactctatttacncggcactcccgacccggaacgtccgtacggttcctgaccgtattccgtggcacggcgggtcgtgggactagtacttttactctcaccctatcctacctacccctgaccaggtcctaggaacgtatggtggaccttagttttacttactgttaacctaaagttattactttacttaccttaccgtcccggtaccggtacgttcccggggacccggggtaaccaacggttacggaaactaccgaaaacggtactacgggtcgccgtgacctaccgtacttcgtcgttccttcctaccg

SEQ ID NO: 237547 - DNA, 523 bp, Homo sapiens
  misc_feature: GYAE6OF02H56PA.48.15.B04.1.454.CMB.1.raw
  modified_base (310)..(310): a, c, t, g, unknown or other
  misc_feature (310)..(310): n is a, c, g, or t
  modified_base (335)..(335): a, c, t, g, unknown or other
  misc_feature (335)..(335): n is a, c, g, or t
  modified_base (362)..(362): a, c, t, g, unknown or other
  misc_feature (362)..(362): n is a, c, g, or t
  modified_base (403)..(403): a, c, t, g, unknown or other
  misc_feature (403)..(403): n is a, c, g, or t
  modified_base (499)..(499): a, c, t, g, unknown or other
  misc_feature (499)..(499): n is a, c, g, or t
  modified_base (519)..(519): a, c, t, g, unknown or other
  misc_feature (519)..(519): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcacacctccatgaacaaggagtacttggcttggttccagcagaaaccagggcagcctacctaaactctcatttacncgcatccaccggagtccaggttccngaccattccgtggcagcggtctggacngtatttctctcaccatccaacctccctgcagctagagatgngtctagtttattactgtacaactaattattactctacctcgccgtacggttcggaccggggtacaagtaggaaatcgaaacgtacgtggtacgtcngacaccgattctgtaccttntacc

SEQ ID NO: 237548 - DNA, 330 bp, Homo sapiens
  misc_feature: GYAE6OF02HRB63.48.15.B04.1.454.CMB.1.raw
  modified_base (326)..(330): a, c, t, g, unknown or other
  misc_feature (326)..(330): n is a, c, g, or t
tcagagtatacatacacgaccggtgctcgatttagacagtatatatccgcgggcacgaccggtgctcgatttagacagtatatatccgcggggcacgaccggtgctcgatttagatcgtctgtgttgggtttgggggtgtggtggtctccactcccgccttgacgaggctgattactactgtcagtcttttgataacaacaatcacgtggtcttcggcggaggaccagcctgacccgtcctaggtcagcccaaggctcgccccctggtcactctcgttccccgccctcctctatgtatactctgagcggctggcaaggcgcatagnnnnn

SEQ ID NO: 237549 - DNA, 607 bp, Homo sapiens
  misc_feature: GYAE6OF02HGF5F.48.15.B04.1.454.CMB.1.raw
  modified_base (377)..(377): a, c, t, g, unknown or other
  misc_feature (377)..(377): n is a, c, g, or t
  modified_base (451)..(451): a, c, t, g, unknown or other
  misc_feature (451)..(451): n is a, c, g, or t
  modified_base (572)..(572): a, c, t, g, unknown or other
  misc_feature (572)..(572): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgacaacgtccagccagagttcgtttttcactacctcatgaaacaaggacgtacttggcttggttccagcaagaaaccagggtcagtcctaccgtaaaactcgtactaattttactcggacactcccaacccggtaagtccgtaggttcctcgaccgtattcccggnggcacggtcgggtcgtaggaactaggtacttttacgtctaccgacataccactacccgtgacagctaggaacgntaggtcgactagttttaataccgtgtacaataattactttactccttaccgccgtacccgtacggtccggaccggggtaacaacggttacgaaagtaccgtaaacggacttacggcgtacncgtaccaaccgtatccgtttacgtcttactacccg

SEQ ID NO: 237550 - DNA, 817 bp, Homo sapiens
  misc_feature: GYAE6OF02HN4NO.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgccgtgcggggacatcgtgatcgacccagtctccagacctcccgtggctgtgtctcgtgggcgagaccgccacatacacgtgacgtaacgtccacgaccaggtacgtttcgttttaccaacctacctccgaatagaaaccgaaggtacgttacgttcggtcgtttcggttccgacgtaccgtaacggaaaccggtcggaccgacgtacccttaacctaaacttaccgttaccttaacgttccgtacgacctaaccgtacccggtaaccggtaccgtaccggttaacggttaccgtaccggtaaccgtcgttaccggcggtaaccgtacgggtccggttcgtaacggggtactaacggtttacttttaccgtacgtaccctaacgtacgtacctaaccccgttaccgtaccgtacggtacggtaccttaagggaacgtaggtttcgggcgttaacgttttaacgtttacgtttaccgtagtaaccctaaagtttaacttttaacttaccgtttaccgaccccggttacccggtaccgggtttacccgggggtaccggggtaacccgggtaacttaaaccgggtaccggttaaaacgtacccggtaaacggtaccggttaggtacgtaacccgtacggtaaccgaccgttaacggttctaccgttttacccggtctttaacccg

SEQ ID NO: 237551 - DNA, 831 bp, Homo sapiens
  misc_feature: GYAE6OF02HCCMH.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatgacccagtctccagacctccctggctgtgtctcgtgggcgaggaccggccaccatacaactcgacaacgtccagccaggtagttgttttacactacctccatagaaacaaggactacttggctttcggttaccaggtacaacggaaaaccgaggggccacggcccttacctaaaccttactactaactttacgtacggcaactcccgaacccgggaacggttcccggtacggttcccgtacgacccgtacgttcccggtgggtcgtacggtcggggttcgtacggggaactacgttactttttacctccgttacccgaacctactaccctaaccttaaccccgtggacccgtagggtacccgttaggaaacggtcgttcggggttacggtaccgttaaggtttttacttaaccgttacggttaacctaaaacgttaaacttttaaacttttaaccgttttacccgttaacccgtttaccccgggacccggggtttaacccggggttttaccccggggggaacccggggggtaaaccccgttaaccgggttaacggggtaaaaccgttaacccggtaaaaaccgggtaacccggtttacggggtaccggggtacctttaccggacccgtaaaccgttaccgtttcccggtttacgtttccgtttaccttaaccccg

SEQ ID NO: 237552 - DNA, 757 bp, Homo sapiens
  misc_feature: GYAE6OF02HXERJ.48.15.B04.1.454.CMB.1.raw
  modified_base (365)..(365): a, c, t, g, unknown or other
  misc_feature (365)..(365): n is a, c, g, or t
tcagagtatacatacacgaccggtgctcgatttagacagtatatatccgcgggggagctacaacaggcaggcaggggcagcaagatggtgttgcagacccaggtcttcattttctctgttgctctggatctctggtgcctggcggggacatcgtgatgacccagtctccagactccctggctgtgtctctgggcgagaccggccaccatcaactcgacaacgtccacgccagtagttgttttccacacctccatcgaaacaaggagtacgttggctttcggttccagacaagaaaccgagggacacgcctactaactactctactttacgtcggcactccgaacccggagtccgtaggttacccngtaccgtacgttccggcggacgacggtcgggttacgtggggaactacggttatttttaccgctaccacctactcctaaccttaccctagaccgtacgggaccttaggaacgtagttacgggttacggtacgttaaggtttttaaccgtttacgtacgtaaccttaaaacgttaaatttaacgtttaacgtttacccgttaacccggttaccccggtaccgggttaacccgggttacccgggggaaccccggggggttaacccgtaaacccgggttaacggtaaaccgttaaacccggaaaaccggttaaccggttacgggtaccggttaccgtaccggtaccctaacccgtaccgttttacccggtcgtttacccgtttacgttaaccccgg

SEQ ID NO: 237553 - DNA, 647 bp, Homo sapiens
  misc_feature: GYAE6OF02FUN83.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctcgtgggcgagacggccaccatcaactgcaagtccagccagagttgttttcacacctccatgaacaaggagtacttggcttggttccagcagaaccagggcagcctacctaaactactctatttacgtcggcactcccgacccggtaacgtccgagttcctacgaccgtatccggtggcaggtcgggtctcgggacagtattttacgtctcaacctatccactaccccgtgcctacggctagaacgtagtggtacggcttaagttttacttcgtagtacctaaacgtaattactttacttccgttaccgtccgtacccggttaaccggttccggggaccccggggtaaaccgtacgggttaacgtaaaccgtaaccggtaaaaccggtaaccgttcggttaccgggtaccttccggaacctacccgttaacgttccgttacggtttcccttacgttaccccg

SEQ ID NO: 237554 - DNA, 634 bp, Homo sapiens
  misc_feature: GYAE6OF02IHFBV.48.15.B04.1.454.CMB.1.raw
  modified_base (445)..(445): a, c, t, g, unknown or other
  misc_feature (445)..(445): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
  modified_base (484)..(484): a, c, t, g, unknown or other
  misc_feature (484)..(484): n is a, c, g, or t
tcagagtatacatacacgaccggtgctcgatttagacagtatatatccgcgggggagctacaacaggcaggcagggggcagcaagatggtgttgcagacccaggtcttcatttctctgttgctctggatctctggtgcctggcggggacatcgtgatgacccagtctccagacctccctggctgtgtctcgtggggcgaggaccggccaccacgtaccaactgacaacgtccacggccaggtacgttcgttttacaccacctccatagaaacgaaggtaagttacttggtcgttggttaccagacaacgaaaccgagggccacgtcctacctaaactctactacttacgcgactacgtccaacccggtacgtaccggtcgttccgtacggacgtacgttaccggtggccgacggtcggggtctacgggactagttacttttaccnctacacctactcctaacctaccgtnacgnggctaggagngttgtaggtactagttagttacgtactactaacttattattacttactaccgtaccgtccgttcgggtccgggaaccgggtacgaaggtacgtaataccgaacgtaccgtgggacgtcgtacgccaccgtatcgtcttccgtactacccg

SEQ ID NO: 237555 - DNA, 714 bp, Homo sapiens
  misc_feature: GYAE6OF02FY2VA.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatgacccagtctccagacctcccgtggctgtgtctcgtcgggacgagaccggccaccactacaactgacaacgtccacgccaggtgttcgttttaccacctacctaccatacgaacgaaggtagtacgttgtcttgggttcccagtacgaagaaaccgagggaccacgtccctaacctaaactactacgtactttacgccggcactccgaacccggtacgtaccgtcggttacctcggacctacgttccgtggacgaggccgggtcgacggacgtagttacttttacctcctaccaccacgtacctacccgtaccctgaccgcggtacgtagtaacgtgtcggttagtaccgtttagtttacgttaacgtcgttaactaaactaatttaacgtttactttaacccgttaccgttacccggtaccgtaaccgggttccggggtaacccggggaaccggtaacggttaacggtaaccgtaacggtaaaaccgtagttacgggtacggtccgttacggaccttaaccgttaccttcggttaccgttaccgttaccttacccgg

SEQ ID NO: 237556 - DNA, 687 bp, Homo sapiens
  misc_feature: GYAE6OF02FQ74K.48.15.B04.1.454.CMB.1.raw
  modified_base (187)..(187): a, c, t, g, unknown or other
  misc_feature (187)..(187): n is a, c, g, or t
  modified_base (306)..(306): a, c, t, g, unknown or other
  misc_feature (306)..(306): n is a, c, g, or t
  modified_base (336)..(336): a, c, t, g, unknown or other
  misc_feature (336)..(336): n is a, c, g, or t
  modified_base (374)..(374): a, c, t, g, unknown or other
  misc_feature (374)..(374): n is a, c, g, or t
  modified_base (418)..(418): a, c, t, g, unknown or other
  misc_feature (418)..(418): n is a, c, g, or t
  modified_base (467)..(467): a, c, t, g, unknown or other
  misc_feature (467)..(467): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacagtcgtgatcgacccagtctccagacctccctggctgtntctcgtgggcgagacggccaccatccaaactgaccaacgtccacgccgagtaggttcgtttttcactaccctccatagaaacgaaggtagtacttggcttcggttccagcaagaaccgnggcacgcctacctaactctactactttacncgctactcccgaccggagtccggtagttccagaccgtnttccgtcggcgtacggtcgggtctgggactaggttacttttacnctaccgacctataccctacctacccgtgacgtcggtacgtaggtaacgnttaggtcgtagttaacgttttactacgttcgtaacctaaacttaagttaactttacgttacccgttaaccgttcccggtacccgggttaccggttacccggggaacccggggtacctaacggttagaaacccgttaacggaaaccgtaacggttcggtaaccggttacgtacccgaacgttacccgtaattccggtaccgtttaccgttaacgttccccg

SEQ ID NO: 237557 - DNA, 710 bp, Homo sapiens
  misc_feature: GYAE6OF02G5ZYD.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagacctcccgtggctgtgtctcgtgggacgaggaccggccacatcaactgacaagtccacgccagtagttcgtttttccactacctccagtacgaaacgaaaggtacgttacgttggtccgtttacggttcctacgacgaacggaaacccgacggggcacgtaccctaaccttaaacctactacttactttacgtaccgactacctacccgaaccggtaacgtccggtacggtttcccgtacggtaccgtacgtttcccggtacggacgtacgggtccgggtcgtacgggaacgtaacgttacgttttacctccgttaccgtaacctacgttaccctaacccgttacccgcgtaccgtaggtaccgttaaggaaacgtgttacggttacggtactttaacgttttactacgttacgtaactaaattaattactttacttaccttaccgtccgtaccggtaccggttccgggaccgggtactacggtacgaactacgaaaccgtacgtggtcgtacgtcgtacacgtattcgtcttactactcc

SEQ ID NO: 237558 - DNA, 581 bp, Homo sapiens
  misc_feature: GYAE6OF02F390Z.48.15.B04.1.454.CMB.1.raw
  modified_base (318)..(318): a, c, t, g, unknown or other
  misc_feature (318)..(318): n is a, c, g, or t
  modified_base (422)..(422): a, c, t, g, unknown or other
  misc_feature (422)..(422): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcacacctccatgaacaaggagtacttggcttgggttcccagtcaagaaaaccagggtcagcctcctaaaactactctatttacncggactatccaacccggaagtccgaggttccctgacccgtattccgtggcaggcgggtctgggacagtattttactctcacatcactacctgcagctagaacgntggtgctagtttatacgtntactaanaagttattactcttaccgtccgccgtacgttccgggaccggggtacctaacggtacgaaactacgaaaaccgtaaccgttaggtaccggtctacggtacctaccgtacgttccgtacgttccttcttaacccg

SEQ ID NO: 237559 - DNA, 858 bp, Homo sapiens
  misc_feature: GYAE6OF02H7DK5.48.15.B04.1.454.CMB.1.raw
  modified_base (307)..(307): a, c, t, g, unknown or other
  misc_feature (307)..(307): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgccgtggcggggacagtcgtgatcgacccagtcctcagacctccgtggctgtgtctcgtgggcgagacggccaaccgatacaactcgacgaacgtaccagaccagtagttgttttaccacctaccgtccaatagaaccgaaggtacttaccgttggactttacgggtccaanccgtaacgaaaccgcgggtaccaccgtacccttaacccgaacttacctacgtaacttttaccgaccggaccaaccgtaccccgaaccggtaccgtaccggtaccggttacccacggtaccgttacgttccggtaggtccgacggtcggttaccgtacggtactacggtttactttcctaccgtaccgtaacctaacgttaccccttaccgtaacccgtcggtaacgtacggtaccgttaaacggaaggttacgttcgggttaggttaccgtttagtttaaaccgtttagttaacgaaacctttaaacgttaaacgtttaacttttcccgtaaacctttcccgggtacccggtttaaccccgggttaccccgggggttttaacgggggaaccccggggtttaaaccccgtaaccggggttaaaaccgttaaaccggggtaaaccccgttaaacccggggttaacttagggtaccccgggttaaccgtttacgaacccggttaacccgttccgttttaacccgttacggttttaccccctagtttaccccccg

SEQ ID NO: 237560 - DNA, 752 bp, Homo sapiens
  misc_feature: GYAE6OF02HC1BA.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatcgacccgagtcctccagacctccctggctgtgtctcgtgggcgaggaccggccaccatacaactgacaacgtccacgcctagtagttcgttttccacctacctacctaatacgaaacgaaggtacgttacgttggtcgttcggttccagacaacggaaaccggacgggaccacggtaccctaaccgttaaactaccgttacctacgtttaccgtccggacaccgttaccccgaccggaacggttcccgtacggttaccacggtaccgtacggttccggtcggacgacggtccgggttacgtacggggtaacgtaacggttaccttttaccctacgtaccaccttaactctaacccctcccgagtcgaggtaccttaaggaacgtgttagggtaccgtactttaagttttacgtacgtacttaaccaaattacttaactttacgttaaccttcccggttacccggttacggtacccggggttaccggggaaccgggtaaccgtaacggttacggtaaaccgtaaacccgggtaacgtaacgggttcgtacgtcccgtagtacccctaacttctaccggttccttctacgttaccccg

SEQ ID NO: 237561 - DNA, 638 bp, Homo sapiens
  misc_feature: GYAE6OF02JDLXM.48.15.B04.1.454.CMB.1.raw
  modified_base (296)..(296): a, c, t, g, unknown or other
  misc_feature (296)..(296): n is a, c, g, or t
  modified_base (327)..(327): a, c, t, g, unknown or other
  misc_feature (327)..(327): n is a, c, g, or t
tcagagtatacatacacgaccggtgctcgatttagacagtatatatccgcgggggagctacaacaggcaggcaggggcagcaaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagttgttttcactacctccatacgaacaaggtacgtaacttggtctttcggttcctaggcaacgaaaccngggcacgcctaccgtaaactctcatttaccncgactactccaccggaagtccgacgttccagacccgtattccggtggctaggtccggtgtcgggactaggttaacttttaccgtctcaccgtactcctactacccgtcgacacggactcgaagtattcggtcggtacgttagttacgttacttcggtactaacgtaattaacttattaccttaacctcccggtaccgtaccggttaccgggtaccggggtaccgtaaggtacccccgtaaagtaacccgaaacgtaacgtacggtcggtacgttacgaccgtacctacgtcttcgttaccgttcgttaccg

SEQ ID NO: 237562 - DNA, 557 bp, Homo sapiens
  misc_feature: GYAE6OF02H8WL0.48.15.B04.1.454.CMB.1.raw
  modified_base (312)..(312): a, c, t, g, unknown or other
  misc_feature (312)..(312): n is a, c, g, or t
  modified_base (344)..(344): a, c, t, g, unknown or other
  misc_feature (344)..(344): n is a, c, g, or t
  modified_base (553)..(553): a, c, t, g, unknown or other
  misc_feature (553)..(553): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaaacaaggagtacttggcttggttccagcaagaaaccagggcagcctacctaaactctcattttacncggcacttccgacccggaagtccgaggttccncgacgtactccgtggcacggcgggtctgggacaggtacttttactctcacctatccacctaccctgacaggcctagaagtgttagtgacttagttttacttagtgtaccaaataattatttatctacctccgccgtacggtccgggccgggaacacggtgaaactaccgaaacgtacgtgtcggctgaccacctatccgtgttaccctntacc

SEQ ID NO: 237563 - DNA, 713 bp, Homo sapiens
  misc_feature: GYAE6OF02FK57O.48.15.B04.1.454.CMB.1.raw
  modified_base (318)..(318): a, c, t, g, unknown or other
  misc_feature (318)..(318): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctcgtgggcgagacggccaccatcaacgtgacaagtccagccagtagttgttttcaccacctccatcgaacaaggatacttggcttggtccagcagaacagggcagcctacctaaactctacgtaattttaccncggacacgttcccgaaccccggggtaacgtccggaacggtttccccgtaggaacccgttaacgtttcccgggtaggtacgacgggtccgggggtacctagggggactaacgttacgtttttacctcctaccgacctacttacgaccctacccgtacggacgtaacggtcccgtaggaacgtagttcggtaacggtacgttaagttttacttaacttcgtaaccgttaaacctaaattatttaaccttcgttaacctcccgggtaccggtaaccggtttcccggggacccggggaaccgtaaccggttacggaaaacgtaccggtaaaccgaacgtttcgggtaacggaccgttacggaccaaccgtaagttccgttacttaccttcttaacccgg

SEQ ID NO: 237564 - DNA, 771 bp, Homo sapiens
  misc_feature: GYAE6OF02J1ULA.48.15.B04.1.454.CMB.1.raw
  modified_base (305)..(305): a, c, t, g, unknown or other
  misc_feature (305)..(305): n is a, c, g, or t
  modified_base (525)..(525): a, c, t, g, unknown or other
  misc_feature (525)..(525): n is a, c, g, or t
tcagagtatacatacacgaccggtgctcgatttagacagtatatatccgcggggagctacaacaggcaggcagggcgagcaagatggtgttgcagacccaggtcttcatttctctgttgctctggatctctgtgcctgcggggacatcgtgatgaccagtctcagactcctgctgtgtctgtcggcgaggccgccgacacgtcaaccgtgcaagtccagcctgtaacttgttttaccactacccttacgactagaacgtaagtacgtaagttggtccgtttggttccgagtcgaacgaaaccggngggactaacgcccttaacgtaaaccttcctacgtaacttttaaccgcgtacctaacttcccccggaaccggttaacggtaccccgttaggttacccgtacggaacccgttgtttacccggtgggacctacgggtcggtcgtacggggactaacggtttacgtttaacctcgtacctaactctaccgtaactaccccggtcacgtccgtacgacggttaanacgttcggtagtaacccgtttagttttacctagttaaccgtccttaaaactaaggttttaacctttacgtttaaccgttacccgttacccgttaccgggttaaccggtcccggggttacccgggggaaaacccttccggtaaacgggttacgtaaccggtaaaaacccggtacgttaggttcccggacttaaccgacgttacccgttaacgtaccccgtttcggtttacctacccgtttaacccgg

SEQ ID NO: 237565 - DNA, 750 bp, Homo sapiens
  misc_feature: GYAE6OF02JEPD4.48.15.B04.1.454.CMB.1.raw
  modified_base (310)..(310): a, c, t, g, unknown or other
  misc_feature (310)..(310): n is a, c, g, or t
  modified_base (424)..(424): a, c, t, g, unknown or other
  misc_feature (424)..(424): n is a, c, g, or t
  modified_base (476)..(476): a, c, t, g, unknown or other
  misc_feature (476)..(476): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcgggacatcgtgatgacccagtctcccagacctccgtgtctgtcgtcttcgtcggcgacgacgcccaccactccaactgccgaagtccacgcagtagtttcgttttcacctacctccatagaacgaaggtacgtactgtacgtttcgtacgtagaccgaacgaacccgnggacaccggtaccctaacctaaacgtacctacgtacgtttaccgtccggacaccttacccggaaccccgggtacttaccggaccggtttcacccggaccgtttacgttcccggngggacccgtaggtcccggttacgtaccggggtataacggtacttttttaccnccttaccgacctaaaccttaccaccttaacccgccgtaaccgaccgtacgtagtaaacgtctaggttcggtactttaatttacgttaccttagtaacctaacgtaactttacttacctttaccgtaacccttcccggttacccgttaccgggtaccgggtcccggggttaaccgaaccgggttagtaaaccgtaaccgtaaacccggtacgttaacggtacgtaccggtacgacccgtaacgtcttaccggttactttaccggttattaccccg

SEQ ID NO: 237566 - DNA, 941 bp, Homo sapiens
  misc_feature: GYAE6OF02H8P8Z.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgccgtgcggggacatcgtgagtcgacccagtcctccagacctccctcggctgtgtctcgtgggcgacgaccggaccaccataccaactcgaccaacgtccaacgccaaggtacgtttcgtttttccgaacctaccctaccaagtaacggaaaacgtaacgggtacgtttaaccgttgggtaccgttttacgggttacccgaacggtaccgaaaaccggtaaaaccggaccgggggacctaaccggtacccctttaaaccccgtaaaaccgttacccttaccgttaaccgtttttaacccgtaccgggtacccttaaacccgttacccccggtaaacccccggggtaacgggttaccccgggttaacgggtttccccgtaaccggttaaaccccggttaccgtttccccgggtaggggtacccgtaacgggttccggggttacccggttaggggaacgtaacggtttaactttttacccgttacccgttacctaaacccgtacctttaacccgtaccccgtttaaccccgacgtccggaacggttccaacggtaaacgtaggttacggtacgggttaacctttaagtttaaccgtttacggtaccgtaaaccttaaacgttaaacgttttaccttacgtttaccgttaacccgtaccccgggttaaccgggttaacccggggttccgggggaaccccggggttaacgtaaccggtaacggttaacaaaccggtaaccggttaacgtaccggtcggacttaccgtaccgaacttcccggtttacttaccggttcccttacgttacccg

SEQ ID NO: 237567 - DNA, 747 bp, Homo sapiens
  misc_feature: GYAE6OF02HJLM5.48.15.B04.1.454.CMB.1.raw
tcagagtatacatacacgaccggtgctcgatttagacagtatatatccgcggggggagctacaacaggcaggcaggggcagcaagatggtgttgcagacccaggtcttcatttctctgttgctctggatctctggtgcctggcggggacatcgtgatcgacccagtcctccagacctcccgtggtctgtcgtctcgtgggcgagaccggccaccatacaactgactaacgtccacgccagtcgttcgttttacacctacctccatacgaaacgtaaggtagtaacgttcggtcgttacggttaccaacgacaacggaaaccgagggaccacgtaccctaacctaaacctactactactttaccgcgactacgtacccgaccggtaacgtccgtacgttcctacggtaccgtacgttccggtacggacgtacgggtccgggttacgtacgggaactacggttaacgttttacctaccgtaccaccgttaaccttaccctaacccgttaacccgtcgtaccggtaggtccgtaggaacgtgtacggtggtacttagttttactactacgtaactaaacgttaattactttacgttacccgttaccgtaccgttacccgggttaccgggttacccggggtacccgggtaaccggtaacggtaacggtaaacgtaccgaaaacggtccgtacgggttcggtaaccgtacgacctaccgtaccgttaccggttcttaccgttccgttacccg

SEQ ID NO: 237568 - DNA, 194 bp, Homo sapiens
  misc_feature: GYAE6OF02JFDMN.48.15.B04.1.454.CMB.1.raw
  modified_base (153)..(194): a, c, t, g, unknown or other
  misc_feature (153)..(194): n is a, c, g, or t
tcagagtatacatacacgaccggtgctcgatttagacagtatatatccgcgggcacgaccggtgctcgatttagacagtatatatccgcgggcacgaccggtgctcgatttagacagtatatatcgaggcggtcgtggacgaggcgctaatgnnnnnnnnnnnnnnnnnnnnnnnnnnnnnnnnnnnnnnnnnn

SEQ ID NO: 237569 - DNA, 779 bp, Homo sapiens
  misc_feature: GYAE6OF02IEU1R.48.15.B04.1.454.CMB.1.raw
  modified_base (184)..(184): a, c, t, g, unknown or other
  misc_feature (184)..(184): n is a, c, g, or t
tcagagtatacatacacgaccggtgctcgatttagacagtatatatccgcgggggagctacaacaggcaggccaggggcagcaagatggtgttgcagacccaggtcttcattttctctgttgctctggatctctggtgcctggcggggacatcgtgatcggacccagtctccagactccctggnttgtgtctcgtgggcgacggaccggtccaaccgatacaactcgctaagtccaagctagtagttgttttccacgtacctcgatagaaaccgagtacgttcgtgcgttgttccagcgtaacaacgacgggtacacggtaccttacctaaacctacttacctaagttttacgaccgacaccttaccgtacccggaagtcctaggttacctggaccctagtccgtacgacgtacggtcgggtacgtcggaacgtacgtttacggttttaaccacttaccgaacctacgtacccgtaacccgtcccgtggtaaccgacgggtactaaaggtaacggttacgtcgggtttacggtacgtttaacggttttaacgtttacgttacgtaaaaccgtaactttaaacggtttaaactttactttacccgttaacgtcccggttaaccccggtagggtttaccccgggaaccggggaaccggttaaacggttacggtaaaacccgtaacgtaaaaccggggacctttaagggaccggttacctaacggggtaacccttaccgtaaccggttccgtttacggtttaacccttacgtttacccccgg

SEQ ID NO: 237570 - DNA, 584 bp, Homo sapiens
  misc_feature: GYAE6OF02G39FA.48.15.B04.1.454.CMB.1.raw
tcagagtatacatacacgaccggtgctcgatttagacagtatatatccgcggggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatacaactgacaagtccagccagtagttcgttttcactacctccatagaacaaggtacgtacgttggtcttggtccagacgaagaaaccgaggcacgcctacctaaactacctactactttacgcgcactccgaacccggtagtccgagttcctgaccgtagttccgtggacgacggcgggtcgtgggactagtactttactctacactatcctactacctgcagctagagtatggtcgacttagttacttagtgactaactaatttacttattccgtacctccggtaccgtcgggttacccggaccggggaacctacggtagtaactaacgtaacgtacgtggtcgacgtgacctactactccgtattcctacgtacc

SEQ ID NO: 237571 - DNA, 841 bp, Homo sapiens
  misc_feature: GYAE6OF02IC0UZ.48.15.B04.1.454.CMB.1.raw
tcagagtatacatacacgaccggtgctcgatttagacagtatatatccgcgggggagctacaacaggtcaggcaggggcagcaagatggtgttgcagacccaggtcttcatttctctgttgctctggatctctggtgcctggcgggacatcgtgatcgaccctagtcctccagtacctcccgtggtctgtcgtctcgtgggcgacgaccgccacctatccgaactcgacaacgtccagaccgtagtgttcgttttaccacgtacctcgtaacgtacgaaacgaagggtacgttacgttggtaccggtttacggggtcccggacgtaaaggaaacccgtaggtacccgtaccgtacccttaaccgttaaaaccttaccgttcttaaacttttccggccggaccttacccgtaaccccgtaccggtaacggtaccggttaccgttccgtaaccggtacccgttacgttacccgggtcggaaccgtgggtccggggttacgtaccggggtaaacttaacgggtttaccttttaccgtacccgtttaccgaacccgtttagtaaaccccgtacccgttacccggtacgtaaccctagggtacccttaaggaaaccggttgttagggtaccggtaacgttttatttaacggtaacttaccggtaactaaactaacgtttcttaaacgttcctaacccgttccgtacccgggtacgggttaaccgggcccggggttaaacttaacggtaacggtaaaccgtccgtaaaacggttctaaccggttagggtacctaccgtaaccgtccttacggtacctttcggttacttaccccgtacttacccccgg

SEQ ID NO: 237572 - DNA, 779 bp, Homo sapiens
  misc_feature: GYAE6OF02GAITJ.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtcgtctcgtgggcgacgacggccacactcaactgacaagtccagccagtagttgttttcacctacctaccatagaacgaaggtacttacgttggtcgtttggtcctagctaacggaaccgacggacacgtacctaccttaaactacctactaactttaccgtaccggtacacctaccggtaacccggtaacggtcccggtaacggtttccctacggtaacccgtacgttccggtacggcgaacggtccgggtacgtaccgggtactacggttacttttaccgtctaccgtaccgtactacccttaaccgtccccgttagacccgtacggtactacggtaaagacgttcgggttacggtaaccgtttaagtttaaccttacgtacgttaacgtaaacctaaagtttaacgttttaccgtttacccttaacccggttccccgtaaccgggttacccgggttaccgggtaacccgggggtaaccgtaaccgggttaccgtaaaacgtacccggtaaaaccgggtaaccgtttacgggtaccggttaccgtacggtaccctaccggttaaccgtccggtttaccgttccttacttaacccgg

SEQ ID NO: 237573 - DNA, 723 bp, Homo sapiens
  misc_feature: GYAE6OF02FUG78.48.15.B04.1.454.CMB.1.raw
  modified_base (261)..(261): a, c, t, g, unknown or other
  misc_feature (261)..(261): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgccgtacggggacatcgtgatgaaccagtctccagagtccctggctgtgtctctgggcgagagggccaccatcctatgacaacgtccacgccagtacgttcttttacacaccaaccaatgaagaanaactactatcgttagaccagcagacgaccaggaaccaacctactaagttcgtacttcttttacggtcgggtccgttccgtcccgggtacggtcccggggtcctcgaccgtacttacgacgtcgccgaggcgggtcgtcgggactacgtaccttcaccttcctacgacctacgtaccgacggtccggaccctggtaccgacggtacgtacgaaacgtgtcgggtaggtccgtttaagtttaccgtttaccgttcggttaacgacgttacccgttacggttttgggttttaccggggttcccggttttaccgttaccccgggtttacgtttccgggggtacggggtaaccggggtaaccgggttaacggggttacgggttaaccggtaaaccgtaaaccggtaaacggttcgggttacggacgttcgggtaccctaaccggttcgtacgttccgttacttaccg

SEQ ID NO: 237574 - DNA, 806 bp, Homo sapiens
  misc_feature: GYAE6OF02HW764.48.15.B04.1.454.CMB.1.raw
  modified_base (523)..(523): a, c, t, g, unknown or other
  misc_feature (523)..(523): n is a, c, g, or t
  modified_base (587)..(587): a, c, t, g, unknown or other
  misc_feature (587)..(587): n is a, c, g, or t
tcagagtatacatacacgaccggtgctcgatttagacagtatatatccgcgggggagctacaacaggcaggcaggggcagcaagatggtgtgcagacccaggtcttcatttctctggttgctctggactctctggtcgtccgtggaccgggggacacttcggtcggtaatcggaacccgtagtacctccaacggtacctccccgtggtccttggttcgttacgtccgtgggggtccggacgaaccggcccaaccactctaaaccgtgaccaaggtccacgccgattacggttgttttaccacctaccttccaagtcgaaaactaaggggtacttcgttaggtaccgtttacggttcccgagaaccgtaacgggaaacccgaggggtacctaccggtacccgttaaccccttaactaaaccctttcgtaaaccggtttcgtacccggactccccgttaacccgaaccccggggttaacgtaccgggtacggttttacccgaccgtaaccggtactttcccgggnggttacggaccggggttccgggtggtttaacggggaacccgttaggtttaacctttttaacccnccgttaccgtaacctaccgttaaccctaccctacccgttacggtacgtcggtacgtaagacgtacgtaggtacgttattacgttagttactactaactaatattacttacgtactcgtaccgtcggttccggtacggaccggtacgtaagtacgtaacgtaaccgtactacggtcgtacgtacgtaccgtcacggttacctcgtacttctaccgttacc

SEQ ID NO: 237575 - DNA, 709 bp, Homo sapiens
  misc_feature: GYAE6OF02J2OWK.48.15.B04.1.454.CMB.1.raw
  modified_base (472)..(472): a, c, t, g, unknown or other
  misc_feature (472)..(472): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctctggtgcctgcgggacatcgtgatcgacccagtctccagacctcctggctgtcgtctcgtcgggcgaggaccggcctaccacttcaactcgacaacgtccaagccaagtgttcgttttcacctccgtccagttagaaccaagggtactacgttcggctttcggttaccagtacgaacgtaaaccgagggccacggcccttaaccgtaaaccttactccgtttaattaccgttcggactaacgtccccgaaccggtaacgtccggtaggttccctagacccgtaactccggttaggacccgtacgggcggtttcacgggggtacctacggtacgtttttaccnccgtacaccgtatacccgacctacccgtacgtaccgagtcctaaggtaacgtacgtaggtcgtacgttacgtttactacgtacgtacgtaaactaatttattacttaccgtaaccgttccgcccgtacggttaccgggaccgggtaccgtaacggtacggtaactacccgtaaaacggtcgttcgtaacggtctaacggtaccgtactaacggttctacgtaccttacgttacccgg

SEQ ID NO: 237576 - DNA, 896 bp, Homo sapiens
  misc_feature: GYAE6OF02JTCJP.48.15.B04.1.454.CMB.1.raw
tcagagtatacatacacgaccggtgctcgatttagacagtatatatccgcgggggagctacaacaggcaggcaggggcagcaagatggtgttgcgagacccaggtcttcatttctctgttgctctggatctctggtcgctggcggggacatcgtgatgacccagtctccaagtcctcccgtggcctgtcgtccgtcgtcgggcgacggaccggccctacactaccaactcgacaacgtccagccagtgttcgtttcacctacctacctagtaacgtaacgaaggttacgttacgttaggtccgtttacggttaccgaccggtaacgaaacggaaacccggtcggggacctaaccggtacccttaacccgttaaaacgttacccttacgttaaccgttttacccgaccgggtaccttaacccggtaccccggtaaaccggggttacccggttaccggttaaccggggttacccctaacggggtaacccggtttacgttacccgggttcggtaccggtaaccggggttaccgggtaccggtaacggggtaaccgttaaacgttaccgtttttaccggtaccctaacccctaaccggttaccttaccccggttaacgttacccccgtaggtacccggtacggtaaccggttaacggtaagttacggttaccgggttagttaccgtttaacggtttacgtttaaccgtaccgttaaccgtaagttaaacctttcgttttaaccgtacccgtttaaccggtcccggttaacccggggttacccggtttaccgggggaacccggaccgttaaccggacgtaaccgtaaccggtaaaccgtggttaacggtccgtacgaccgttacgacccgttattaccgtccggttaccttaccgtacccg

SEQ ID NO: 237577 - DNA, 224 bp, Homo sapiens
  misc_feature: GYAE6OF02I8RQ9.48.15.B04.1.454.CMB.1.raw
  modified_base (143)..(143): a, c, t, g, unknown or other
  misc_feature (143)..(143): n is a, c, g, or t
  modified_base (170)..(170): a, c, t, g, unknown or other
  misc_feature (170)..(170): n is a, c, g, or t
  modified_base (194)..(194): a, c, t, g, unknown or other
  misc_feature (194)..(194): n is a, c, g, or t
  modified_base (196)..(224): a, c, t, g, unknown or other
  misc_feature (196)..(224): n is a, c, g, or t
tcagagtatacatacacgaccggtgctcgatttagacagtatatatccgcgggcacgaccggtgctcgatttagtgtgagtagttccgcgggcacgaccggtgctcgatttagtcgtgagtagttccgcgggcacgaccggtnctcgatttagtcacgcgagaaaggganacggtcgcgtgagacggcactagngnnnnnnnnnnnnnnnnnnnnnnnnnnnnn

SEQ ID NO: 237578 - DNA, 593 bp, Homo sapiens
  misc_feature: GYAE6OF02FG2QV.48.15.B04.1.454.CMB.1.raw
  modified_base (314)..(314): a, c, t, g, unknown or other
  misc_feature (314)..(314): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
tcagagtatacatacacgaccggtgctcgatttagacagtatatatccgcgggggagctacaacaggcaggcaggggcagcaagatggtgttgcagacccagggtcttcatttctctgttgctctggatctctggtgcctgcggggacatcgtgatgacccagtctccagactccctggctgtgtctctgggcgagacggccaccatcaactgcaagtccagccagagttgtttttcacacctccatgaacaaggtagtacttggcttggttccagcagaaccagggcagcctacctaaactactctatttacncggcactccacccggaagtccggacggttcctaggaccgtattccggtggcacggcggtcgtgggacngtattttacnctcaccatcactaccctgcaggtctagaagatggtcgctaagttttactacttgtaccaaacgtaattatttaattccttaactcccggtacccgtacgttaccggggcccgggggtaacccaacgggtacggaaataccgaaaacggtactggtacggctacggacccaccgtaagttccgtagtttaccgttctaaccg

SEQ ID NO: 237579 - DNA, 842 bp, Homo sapiens
  misc_feature: GYAE6OF02HN9OG.48.15.B04.1.454.CMB.1.raw
  modified_base (214)..(214): a, c, t, g, unknown or other
  misc_feature (214)..(214): n is a, c, g, or t
tcagagtatacatacacgaccggtgctcgatttagacagtatatatccgcgggggagctacaacaggcaggcaggggcagcaagatggtgttgcagacccaggtcttcatttctcgtgttgcctctaggactccgtcgtggtcacctggccggggactagtcggtgtatcgaccctagtcctaccgagacctcccgtggtctggtcgcttccgngggacgacggccggtaccaccgactaccgaaccgtggacctaacggtccctacggtacctaaggttaggtttgttttaccaccgtacctaccgtagtacggaaaaccgtaagggtaccgttacgttaggtccgttttacgggtaccaagaccggaacgtaaacccgagggacctaccggtacctaacccgttaaattacccgtacttaacgttaccgccgactaccgtacccgaacccgggtaatccggtaagttcccgtaagtacccgtacgttccgaggcccgtagggtccgggttacgtacggggactaacggttactttaacgtccctaacgtaccacttaaccgaccgtttaacccgcgtacgacgtacgtacgaacggtcttacgggacggttacttaacgttttacgtacgtacgttaacctaaacggttaattaaccgtttactacccgttacgtaccccgggttaccgttaacccgggggtccggaaaccccgggggttaacgtaaccggttaacggttaaaaccgtacccggtaaaacgtaccggtttcgggtaacggtccgtacggtaacccgtaaccttaggtacccccgtttaaggttaccttacccggttaacc

SEQ ID NO: 237580 - DNA, 709 bp, Homo sapiens
  misc_feature: GYAE6OF02I16NZ.48.15.B04.1.454.CMB.1.raw
  modified_base (215)..(215): a, c, t, g, unknown or other
  misc_feature (215)..(215): n is a, c, g, or t
tcagagtatacatacacgaccggtgctcgatttagacagtatatatccgcgggggagctacaacaggcaggcaggggcagcaagatggtgttgcagacccaggtcttcatttctctgttgctctggatctcgtggtgcctggcggggacatcgtgatcgacccgagtcctccagtacctcccgtgctgtctctcgtggcgagaccggccacctanacactcgactacgtccacgccagtacgttgttttaccacctacccttccgatacggaaacgtaaggtacgttacgttggtccgtttcggttaccacggtacgaaacggtaaaccgagggaccgacgtaccccttaacctaaaacctctactaccttacgtccgactaccgtacccgaacccggtaagtcccggtacggttccaccgacggttaccgttccggcggacgcggtcggtacggtaggactagttactttacctcctaccacctactacctacccgttaccgtcgcgtacggactaggaacgtcgttaggtactacgtttacgtttacttacgtactaacctaattaacttaacttcctacctaccgtacccgtaccggttccgggtaccgggaccgggtaaccagggtaacgtaaccgtaacgtaaccggtacgttggtaccgtctaccggacctaccgtacgttacgtcctttacctacgtacccc

SEQ ID NO: 237581 - DNA, 717 bp, Homo sapiens
  misc_feature: GYAE6OF02GHT23.48.15.B04.1.454.CMB.1.raw
tcagagtatacatacacgaccggtgctcgatttagacagtatatatccgcgggggagctacaacaggcaggcaggggcagcaagatggtgttgcagacccaggtcttcatttctctgttgctctggatctctggtgcctggcggggacatcgtgatcgacccagtctccagactcccgtggctgtgtctcgtgggcgagaccggccaccactcaacgtgacaacgaccacgacctaggtacgtttacgtttttaccaacctacctactatacgaaacgaaacggacgttacgttcggctttacggttccgaagctaacgaaaccgagggaccaacgtacctaaccgtaaactacctacgtaacgtttacgcggtactacgtaccccgtaaccggaacgttccggtaacggttccgtacggacccgttagttccggacgaccgtacggtccgggtacgtacgggtaactagtttaaccttttccgtacctcgtaccgtaacttaccctaacctacccgtagtacgtaacggtcgtacggaagtcgtaggttacgtagtttacgtttattacgtagtaccgaaattagttaactttacttacctaccgtaccggtacgttaccggtccggtaccgggaccgtaacggtacgtaaccgaacgtaaacgtacgtacggtccgttcgtaccgacgtccgtaacttcgttacttctactaccg

SEQ ID NO: 237582 - DNA, 721 bp, Homo sapiens
  misc_feature: GYAE6OF02F8D1O.48.15.B04.1.454.CMB.1.raw
  modified_base (85)..(85): a, c, t, g, unknown or other
  misc_feature (85)..(85): n is a, c, g, or t
  modified_base (507)..(507): a, c, t, g, unknown or other
  misc_feature (507)..(507): n is a, c, g, or t
tcagagtatacatacacgaccggtgctcgatttagacagtatatatccgcgggggagctacaacaggcaggcaggggcagcaagntggtgttgcagacccaggtcttcatttctctgttgctctggatctctggtgtcctggcggggacatcgtgatcgacctagtctaccagacctccctggctgtcgtctcgtgggcgaggaccgaccacactcaactgacgaagtccagaccaggtacgtttgttttaccacacctcagataacgaaggtagtacttggtcttaggtttcgacgacgtaagaaccgacggggactaggaccctaccttaaaacgtccttacgtaactttaaccgtcggaccacttaccccggaaccggtaaccggtccggtaacggtttccaacggtaccgaacgtttccggtcgggtcacgggggtacggttacgacgggggtacaagtttacttttaacctcctacaacccgtactacctaaccttacccgngttacgaacggtcgtagtaaacgtagtaggtacggtcttaaggttttaacttacttacgtaacctaaataacttaacgttaacgttccttaccggttacccgaccggttacggtcccggaccggggtaacccgtaacgacggtaacgtaacgtaaacgaacgttacggcgtagtaccgacgtactacgttaccgttataccgtttaccgtaccg

SEQ ID NO: 237583 - DNA, 689 bp, Homo sapiens
  misc_feature: GYAE6OF01BITD9.42.74.G08.1.454.CMB.1.raw
  modified_base (281)..(281): a, c, t, g, unknown or other
  misc_feature (281)..(281): n is a, c, g, or t
  modified_base (312)..(312): a, c, t, g, unknown or other
  misc_feature (312)..(312): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccgggctcagtgacgatttcctgcaaggcttctggatacagcttcagtagttatgctatacagtgggtgcgccaggccccgganaaaggcttgagtggctgggatggatcgtcgnggtcgactacctacactaagtaatattactacacgaagtttacttacgtagtacgaagtacgtacctttaacgttacgaacgacggaccaacaacgtaccgtcccggacgaaccgtaacgtacgtacctaacgtaggtacgggttagtagtagggtacgtaaccgtaagtacttacgtaacggaacgaccggacggttacgttacgttaactttaacgttaccggttaggtcggacgtaaggaacgtagtcccgttaaccgttaaccggaaccgggtaaccgggggtacccgggtaccctttacggtttaacggtaacgtttaccgggggacccgggtaaccggtaacccgggttaacccggttcgggtaaccccgg

SEQ ID NO: 237584 - DNA, 532 bp, Homo sapiens
  misc_feature: GYAE6OF01DJ4AV.42.74.G08.1.454.CMB.1.raw
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctgggatggatcgtcggtggcactcctaacataagatattcacagaagtttcagttcagagtcactttagcagcgacacatccgcgacgacagtctacatggagttgagtgactaagatctgaagacacggctagtctattactgtgcgagagtatgaccttacgacggacggacggggccctacgtttcgagttacgtcggggaccgacgggaaccctgggtcgtaccccgg

SEQ ID NO: 237585 - DNA, 528 bp, Homo sapiens
  misc_feature: GYAE6OF01ET4BD.42.74.G08.1.454.CMB.1.raw
  modified_base (283)..(283): a, c, t, g, unknown or other
  misc_feature (283)..(283): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggcctcagtgacgatttcctgcaaggcttctggatacagcttcagtagttatgctatacagtgggtgcgccaggccccgganaaaggcttgagtggctgggatggatcgtcggtggcactcctaacataagatattcacagaagtttcagttcagagtcacctttagctagcgacacatccgcgacgacagtctacatggagttgagtggcctaagatcgtagaagacacggctagtctatactgtgcgagagatcgccttacgacggacggaggggccctacgtttgacttacgtcgggaccgagggaaccctgggtcgtacccgg

SEQ ID NO: 237586 - DNA, 510 bp, Homo sapiens
  misc_feature: GYAE6OF01BV05R.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccgggcctcagtgacgatttcctgcaaggcttctggatacagcttcagtagttatgctatacagtgggtgcgccaggcccccggacaaaggcttgagtggctgggatggatcgtcggtggcactcctaacataagatattcacagaagtttcagttcagatcactttagcagcgacacatccgcgacgacagtctacatggagttgagtggcctaagatctgaagacacggctgtctattactgtgcgagagatgcctacacgcgaggggcccagtttcgattacgtgggaccagggaccctggtcgtacccg

SEQ ID NO: 237587 - DNA, 532 bp, Homo sapiens
  misc_feature: GYAE6OF01AYHFW.42.74.G08.1.454.CMB.1.raw
tcagtgacgtatgtcacgaccggtgctcgatttagtagctctatcagggacccaacaaccacatccctcctcagaagccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcactcctaacataagatattcacagaagtttcagttcagagtcactttagcagcgacacatccgcgacgacagtctacagtggagttgagtggacctaagatctagaagaccgacggctgtctattacgtgtgcgagagactgtaccttacgacgacggaggggcccctagttcgaacgttacgtcggggaccaagggacccttggtccgtacccg

SEQ ID NO: 237588 - DNA, 516 bp, Homo sapiens
  misc_feature: GYAE6OF01BIDZT.42.74.G08.1.454.CMB.1.raw
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggccccgganaaaggcttgagtggctgggatggatcgtcggtggcactcctaacataagatattcacagaagtttcagttcagagtcacctttagcagcgacacatccgcgacgacagtctacatggagttgagtggacctaagatctagaagacacggctgtctattactgtgcgagagatgcctacgacgacggaggggccctacgttgattacgtcgggacagggaccctggctacccg

SEQ ID NO: 237589 - DNA, 520 bp, Homo sapiens
  misc_feature: GYAE6OF01DLEQB.42.74.G08.1.454.CMB.1.raw
  modified_base (253)..(253): a, c, t, g, unknown or other
  misc_feature (253)..(253): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttctggatacagcttcagtagttangctatacagtgggtgcgccaggcccccggacaaaggcttgagtggctgggatggatcgtcggtggcactcctaacataagatattcacagaagtttcagttcagagtcacctttagcagcgacacatccgacgacgacagtctacatggagttgagtggcctaagatctgaagacacggctgtactattactgtgcgagagatgccttacgacgacggacggggccctactttgattacgtgggaccagggaccctggtcgtacccg

SEQ ID NO: 237590 - DNA, 531 bp, Homo sapiens
  misc_feature: GYAE6OF01AWP80.42.74.G08.1.454.CMB.1.raw
  modified_base (284)..(284): a, c, t, g, unknown or other
  misc_feature (284)..(284): n is a, c, g, or t
  modified_base (419)..(419): a, c, t, g, unknown or other
  misc_feature (419)..(419): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggccccgganaaaggcttgagtggctgtgatggatcgtcggtggcactcctaacataagatattcacagaagtttcagttcagagtctacctttagcagcgacacactccgcgacgacagtctacatggagttgagtgcctaagntctagaagacacggctgtcttattacgtgtgcgagagatcgccttacgacggacggacggggccctacgtttgacttacggtcgggacccgacgggtaacccgtggtacccg

SEQ ID NO: 237591 - DNA, 527 bp, Homo sapiens
  misc_feature: GYAE6OF01DOJSE.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggccccggacaaaggcttgagtggctgggatggatcggtcggtggcactcctaaacataaagatattcacagtaagtttcagttcagagtcacctttagcagcgacacatccgacgacgacagtactacatggagttgagtggcctaagatctagaagacacggctgtctattactgtgcgagagatgccttacacggacggaggggccctacgtttgattacgtggggaccagggaaccctggtcgtacccg

SEQ ID NO: 237592 - DNA, 528 bp, Homo sapiens
  misc_feature: GYAE6OF01AT3QU.42.74.G08.1.454.CMB.1.raw
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagagcccggggcctcagtgacgatttcctgcaaggcttctggatacagcttcagtagttatgctatacagtgggtgcgccaggcccccgganaaaggcttgagtggcgtgggatggatcggtcggtggcactcctaacataagatattcacagtaagtttcagttcagagtctacctttagctagcgacacatccgcgacgacacgtctacatggagttgagtggactaagatctagagacacggctgtctattactgtgcgagagatgccttacgacggacggaggggccctacgtttgattacgtcgggaccgagggaccctggtccgtacccg

SEQ ID NO: 237593 - DNA, 586 bp, Homo sapiens
  misc_feature: GYAE6OF01CT1XN.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctggcaaggcttctggatacagtcttcagtagttatgctatacagtgggtgcgccaggcccccggaacaaaggcttgagtgggctgggatggatcggtcggtggcactcctaaacataagatattcaacagaaagtttcaagtttcaagacgtctaacctttagctagcgaacacatccgacgacgacagtctacatggagttgagtggcctaagatctagaagacgacggctggtcttattactgttgacgagtagagtcgaccttaacgaccggacggtacgggggaccccctaacggttttcgaaacgtttacggtacgggggaccctaagggggaaccccttggggtcccgttaaccccggg

SEQ ID NO: 237594 - DNA, 528 bp, Homo sapiens
  misc_feature: GYAE6OF01D8V8C.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagagcccggggcctcagtgacgatttcctgcaaggcttctggatacagcttcagtagttatgctatacagtgggtgcgccaggccccggacaaaggcttgagtggctgggatggatcggtcggtggcactcctaacataagatatcacagaagtttcagttcagagtcactttagcagcgacacatccgcgacgacagtctacatggtagttgagtggacctaagatctagaagacacggctagtctattactgtgcgagagagtgccttacacggacggacggggccctacgtttgagttacgtcggggaccaagggtaccctggtccgtacccg

SEQ ID NO: 237595 - DNA, 540 bp, Homo sapiens
  misc_feature: GYAE6OF01CI8GY.42.74.G08.1.454.CMB.1.raw
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtctggggctgaggtgcagaagcccgggctcagtgacgatttcctgcaaggcttctggatacagcttcagtagttatgctatacagtgggtgcgccaggcccccgganaaaggcttgagtggctgggatggatcgtcggtggcactcctaacataagatattcaacagaagtttcagttcagtagtcacctttagctagcgacacatccgacgacgacagtctacagtggagttgagtggacctaagatctgaagacgacggtctagtctaattactgtgcgagagatcgccttacgacgacggtaggggccctagtttgaacgtttacgtcggggaccaaggggtaccctggtccgtaccccg

SEQ ID NO: 237596 - DNA, 549 bp, Homo sapiens
  misc_feature: GYAE6OF01BXV1W.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtcgtggggctgaggtgcagacggcccggggcctcagtgacgtatttcctgacaaggctttcgtggatacagtcttcagttagttatgctatacagtggtgcgccaggccccggacaaaggcttgagtggcgtgggatggatcggtcggtggcacgtcctaacataagatattcacgagtaagtttcagttcagagtcacctttagcagcgacacactccgcgacgacagtctacagtggagttgagtggtacctaagatcgtagaagacgacggctcgtcttattacgtgtgcgagagtatgtccttacgacggacggagggggccctagttgacgttacgtcgggaccgagggaccctgggtccgtacccgg

SEQ ID NO: 237597 - DNA, 525 bp, Homo sapiens
  misc_feature: GYAE6OF01BT8U4.42.74.G08.1.454.CMB.1.raw
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttggagtggctgggatggatcggtcggtggcactcctaacataagatattcacagaagtttcagttcagagtcactttagcagcgacacatccgcgacgacagtctacatggagttgagtggacctaagatctgaagacacggctagtcttattactgtgcganagntcgcctacgacgacggaggggccctacgtttgacttacgtcggggaccagggaccctggtctacccg

SEQ ID NO: 237598 - DNA, 572 bp, Homo sapiens
  misc_feature: GYAE6OF01COIDE.42.74.G08.1.454.CMB.1.raw
  modified_base (221)..(221): a, c, t, g, unknown or other
  misc_feature (221)..(221): n is a, c, g, or t
  modified_base (287)..(287): a, c, t, g, unknown or other
  misc_feature (287)..(287): n is a, c, g, or t
  modified_base (358)..(358): a, c, t, g, unknown or other
  misc_feature (358)..(358): n is a, c, g, or t
tcagtgacgtatgtcacgaccggtgctcgatttagtagctctatcaggggacccaacaaccacatccctcctcagaacgcccccagagcacaactcctaaccatggactggacctggaggatcctcttttggtggcagcagccacaggtggccactcccaggtccactttgtgcagtctggggctgaggtgcagaagcccggggctcagtgacgatttccngcaaggctttctggatacagcttcagtagttatgctatacaggtggtgcgccgacggccccggaanaaaggtcttaggacgtggcgtggagtggatcggtcggtggcactccaacataagatatcaactagtaattnagtacagtacgtactacgttagacgtagcgacacacgtaccgacgacgactacgtactacgagtaggtagtgacggtcgtactaagtctcgtagaagacgacggtctagtaccttattcgtgtgacgagagtgtcgaccgttacgacggacggtacgggacctcgtttagacgttacgggtcgggaccgaccgggtaccgtggtcccgtacccg

SEQ ID NO: 237599 - DNA, 699 bp, Homo sapiens
  misc_feature: GYAE6OF01B876A.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtgccactcccaggtccactttgtgcagtcgtggggctggaggtgcaggaacggccccggggcctcgagtgacgtatttcctgcaaggcttctggatacagcttcgagtagttatgctatacaggtgggtgcgccgacggcccccggaacgaaaggcttggaggtggcgtgggatggatcggtcggtgctactacctaacataagatattcaacagtaagtttcagttcagtactctactttagcagcgacacactccgacgacgacacgggggggtactacgtagtaggtagttaggtaggtacggtaccgtaaacgtaagtacgtacgtaaggaaccgaacggtacgttacgttacgtttaacgtttaaccgttaggttacggtacggtacggtaaggtacgttacgtacccgttaaccgtaaccgggtaaccgggtaaccggggggtaccccggttaccggtttacggttaacggtttaaccgggttaccgggggtacccgggtaaccggggtaaccccggttaccggggttacccggtaacccccggg

SEQ ID NO: 237600 - DNA, 708 bp, Homo sapiens
  misc_feature: GYAE6OF01EG6X3.42.74.G08.1.454.CMB.1.raw
  modified_base (289)..(289): a, c, t, g, unknown or other
  misc_feature (289)..(289): n is a, c, g, or t
  modified_base (339)..(339): a, c, t, g, unknown or other
  misc_feature (339)..(339): n is a, c, g, or t
tcagtgacgtatgtcacgaccggtgctcgatttagtagctctatcaggggacccaacaaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatccagtcttcagttagttatgctatacagtgggtgccgccacggcccccganaaaggcttgaggtggctgggatggattcggtcggtggcactcctaactanactaagtattactaacgtaacgaagttacgttacgtagttacgactacgtcctaacttacgacgtaacgacacactaccgtacccgacgtaccgaacgtacgttaccgtaaacgtgggttggaaaagggtttcgtaacgggttaccgtaaaccgttaaggtaacgttacgtaaacgggtaaaccggtaaccgggtaccggttaactttaccggtttaacgtttaacgtttaccggttaggtacggaacggtaaggtaacgttacgttacccggtaacccgttaacgggaccggtaacgggggttaccgggtacccttacggttagtacgtacggggtaccggacggtaccggtacccggtcgtaccccg

SEQ ID NO: 237601 - DNA, 526 bp, Homo sapiens
  misc_feature: GYAE6OF01DM79U.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggctcagtgacgatttcctgcaaggcttctggatacagcttcagtaattatgctatacagtgggtgcgccaggcccccggacaaaggcttgagtggctgggatggatcgtcggtggcactcctaacataagatattcacagaagtttcagttcagagtcacctttagcagcgacacatccgcgacgacagtactacataggagttgagtggcctaagatcgtgaagacacggctgtcttattactgtgcgagagatcgccttacgacgacggaggggccctacgtttcgattacgtcggggaccagggaaccctgggtctacccg

SEQ ID NO: 237602 - DNA, 551 bp, Homo sapiens
  misc_feature: GYAE6OF01B3X4O.42.74.G08.1.454.CMB.1.raw
  modified_base (221)..(221): a, c, t, g, unknown or other
  misc_feature (221)..(221): n is a, c, g, or t
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttccngcaaggcttctggatacagcttcagtagttatgctatacagtgggtgcgccaggcccccgganaaaggcttgagtggctgggatgggatcggtcggtggcactcctaaacataaagatattcacagaaagtttcagttcagatcacctttagcagcgacacatccgcgacgacagtctacatggagttggagtggacctaagatcgtgaagacacggctgttctattaccgtgtgcgagagatcggaccttacgacggaaccgggagggggcccctagtttcgaatttacggtcggggaccaacggggaaccccttgggtccctacccgg

SEQ ID NO: 237603 - DNA, 542 bp, Homo sapiens
  misc_feature: GYAE6OF01EA6E5.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcggtcggtggcactcctaacataagatattcacagtaagtttcagttcagtagtctacctttagcagcgacacatccgcgacgacagtctacatggagtgagtgctaagatctagaagacacggctgtctattactgtgcgagagtagtcgtacctacgacggacggacgggggaccctacgtttacgtagttaccgtcggggaccgaacgggacccgtggtcgtaccccgg

SEQ ID NO: 237604 - DNA, 552 bp, Homo sapiens
  misc_feature: GYAE6OF01D549E.42.74.G08.1.454.CMB.1.raw
  modified_base (290)..(290): a, c, t, g, unknown or other
  misc_feature (290)..(290): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctggaggtgcagaaggcccggggcctcagtgacgtatttcctgcaaggcttcgtggatacagcttcagttagttatgctatacagtgggtgcgccaggcccccgganaaacggctgagtggcgtgggagtggagtcggtcggtggcacgtcctaacataagatatcacagtaattcagtttcagacgtcactttagctagcacacatcccgcgacgacagtctacactggtagttgagtcggactaagatacgtagaacgcaacggtctacgtctaacgttacttggtgaggagagtatcgtccttaacgacggacggacggggccctagttgattacggtcggacgacgggtaccctggtcgtacccg

SEQ ID NO: 237605 - DNA, 570 bp, Homo sapiens
  misc_feature: GYAE6OF01EMQWY.42.74.G08.1.454.CMB.1.raw
  modified_base (222)..(222): a, c, t, g, unknown or other
  misc_feature (222)..(222): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttccngcaaggcttctggatacagcttcagtagttatgctatacagtgggtgcgccgacggcccccggacaaacggcttggagtggcgtgggatggatcggtcggtggctacgtcctaacataagatattcacagtaagtttcagttcagtacgtctactttagcagcgacacactccgcgacgacagtctacactggagttgagtgacctaagatctagaagacacggctgtcttattacgtgttgacgagagtatcgtaccttacgacggtacggacgggggtaccctacgtttacggtaacgttacggtcgggtacccgaacggggtaacccgtggtcccgtaaccccgg

SEQ ID NO: 237606 - DNA, 600 bp, Homo sapiens
  misc_feature: GYAE6OF01CX5QG.42.74.G08.1.454.CMB.1.raw
  modified_base (282)..(282): a, c, t, g, unknown or other
  misc_feature (282)..(282): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggctcagtgacgatttcctgcaaggcttctggatacagcttcagtagtatgctatacagtggtgcgccacggccccgganaaaggcttgacgtggctgggatggatcggtcggtggcacgtcctaacataagatattcaacagtaagtttcagttcagtacgtctaacctttagctagcgacacactccgcgacgacagtctacagtggagttgagtggacctaagatctagaagacgacggctgtcttaattaccgtgtagcgaaggagtagtcgtacccgttaacgaaccggtaccgggtacgggggacccccttacggtttacggtaacgttttaaccggtcggggggtacccgaaacgggggtaacccccgttgggttcccgttaacccccggg

SEQ ID NO: 237607 - DNA, 631 bp, Homo sapiens
  misc_feature: GYAE6OF01C4UY8.42.74.G08.1.454.CMB.1.raw
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
  modified_base (295)..(295): a, c, t, g, unknown or other
  misc_feature (295)..(295): n is a, c, g, or t
tcagtgacgtatgtcacgaccggtgctcgatttagtagctctatcaggggacccaacaaccacatccctcctcagaagcccccagagcacaactcctaaccatggactggacctggaggattccttctttttggtggcagcagccacaggtggccactcccaggtccactttgtgcagtcgtggggctgaggtgcagacgcccgggctcagtgacgtattccngacaaggtcttcgtggatacgagtcttcagttagttangctatacaggtgggtgcgccgacggccccggaanaaaggcttgagtgggctgggatggatcggtcggtggcactcctaaacataagatattacactagtaagtttcaagttcagtacgtctaacctttagacagtaccgaacacgtactcccgacgtacgaactagtacctaactagtggtaagttgaggtcggtacctaagacttcgtagaacgacgacggtctaggttacttattacgtggtgacgagagtagtcgtaccgttaacgaccggtaaccggggtaccggggtacccttacggttttagtaacgtttacgggtaccgggggtacccgaaccggggtaccccgtcggtacccgtacccccgg

SEQ ID NO: 237608 - DNA, 537 bp, Homo sapiens
  misc_feature: GYAE6OF01EQNEL.42.74.G08.1.454.CMB.1.raw
tcagtgacgtatgtcacgaccggtgctcgatttagtagctctatcagggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgagtttcctgcaaggcttctggatacagcttcagtagttatgctatacagtgggtgcgccacggcccccggacaaaggcttcggagtggcgtgggagtggatcggtcggtggcactcctaacataagatattcacagtaagtttcagttcagacgtcactttagcagcgacacatccgacgacgacagtctacatgagttgagtggactaagatctagaagacacgctagtctattactgtgagagagatcgtctacgacggacggacggggccctacgttcgacgttacgtcgggacgacgggaccgtggtccgtacccgg

SEQ ID NO: 237609 - DNA, 669 bp, Homo sapiens
  misc_feature: GYAE6OF01CDI8G.42.74.G08.1.454.CMB.1.raw
  modified_base (280)..(280): a, c, t, g, unknown or other
  misc_feature (280)..(280): n is a, c, g, or t
tcagtgacgtatgtcacgaccggtgctcgatttagtagctctatcagggacccaacaaccacatccctcctcagaagcccccagagcacaactcctaaccatggactggacctggaggatccttcttttggtggcagcagccacaggtggccactcccaggtccactttgtgcagtctggggctgaggtgcagaagcccgggctcagtgacgatttcctgcaaggcttctggatacagcttcagtagttatgctatacagtggtgcgccaggccccgganaaaggcttgagtgctgggatggatcgtcggtgcgactctaacataagatattcacagaagtttcagttcagagtcactttagctagcgacacatccgacgacgacacgtctaacgatacgggagtttgagtggaccttaaagattcgtaggaacgaacgtaaccgggctacggttacttaagtttaccgttaggttacgaccggtaaggtaacgtaagttacggtacccgttttaaccgaaacccggggaaccgggtaaccgggggggtacccccttaaaccgggtttttagggtaaacccggttttaaccggttaccgggggggtaaccccgtaaaccggggggttaaaaccccccgttggggttaacccccggttaaaccccccggg

SEQ ID NO: 237610 - DNA, 550 bp, Homo sapiens
  misc_feature: GYAE6OF01B9XPF.42.74.G08.1.454.CMB.1.raw
  modified_base (289)..(289): a, c, t, g, unknown or other
  misc_feature (289)..(289): n is a, c, g, or t
  modified_base (431)..(431): a, c, t, g, unknown or other
  misc_feature (431)..(431): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagtcttcagttagttatgctatacagtgggtgcgccgacggcccccgganaaacggcttggagtggctgggatggatcggtcggtggcactcctaacataagatattcactagaagtttcagttcagagtcactttagcagcgacacatccgacgacgacagtctacagtggagttgagtggtactaagatntagagaccgacggctagtactattacgtgtgacgagagtgtcgaccttacgacgtacggacggggtccctacgtttagacgttacgtcgggaccaacgggaaccctgggtcctacccgg

SEQ ID NO: 237611 - DNA, 542 bp, Homo sapiens
  misc_feature: GYAE6OF01EFD2P.42.74.G08.1.454.CMB.1.raw
  modified_base (284)..(284): a, c, t, g, unknown or other
  misc_feature (284)..(284): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgcaggcccccgganaaaggcttgagtggctgggatggatcggtcggtggcactcctaacataagatattcacagaagttcagttcagagtcacctttagcagcgacacatcccgacgacgacagtctacatggtagtgagtcgactaagagtctgaagacgacggctagtctattacgtgtcgngagngatcgacctacgacggacggaggggaccctagtttacgaagttacgtcgggggacaaccggggtaaccttgggtcctaccccgg

SEQ ID NO: 237612 - DNA, 544 bp, Homo sapiens
  misc_feature: GYAE6OF01C12LD.42.74.G08.1.454.CMB.1.raw
  modified_base (459)..(459): a, c, t, g, unknown or other
  misc_feature (459)..(459): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggctcagtgacgatttcctgcaaggcttctggatacagcttcagttagttatgctatacagtgggtgcgccaggcccccggacaaaggcttgagtggctgggatggatcggtcggtggcacgtcctaacactaaagataatcacagaagtttcagttcagagtcacctttagcagcgacactatccgcgtacgacagtctacatggagttgagtggacctaagatcgtagaagacacggctgtactattacgtgtagngagagatcgccttacgacggtacggacgggggccctacgtttggacgttacgtggggaccaggggaaccctggtccgtaacccgg

SEQ ID NO: 237613 - DNA, 655 bp, Homo sapiens
  misc_feature: GYAE6OF01COUQI.42.74.G08.1.454.CMB.1.raw
  modified_base (133)..(133): a, c, t, g, unknown or other
  misc_feature (133)..(133): n is a, c, g, or t
  modified_base (171)..(171): a, c, t, g, unknown or other
  misc_feature (171)..(171): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaacgcccccagagcacaactcctaaccatggactggacctggaggatcctcttttggnggcagcagccacaggtgccactcccaggtccactttgngcagtcgtggggctggaggtgcaggacggccccggggcctcgagtgacgtactttccngacaaggtccttgnggaatacagtcttacgaggttagttangtacttaataacgnggtgggtgcgccgaccggccccggaacaaggtctgaggtggcgtgggagtggagtcggtcggtgcgtactacctaagataagatacttcaacgtagtaagtttacagttcaagtagtactacgtttagcaacgacgaacacgtactcccggacgaacgaccgtaagtacctaacgtagtaggtagttaggagtacggacctaaagtacgtcgtaagaagaaccgacggtcgtacgttactaagttacgttggtacggacgaggagtatacggtaccgttaaccgacgggaccggtacggggtacccttacggtttacgtacggttacggtccggggaccgaccggggtaacccgtgggtccctaaccccgg

SEQ ID NO: 237614 - DNA, 711 bp, Homo sapiens
  misc_feature: GYAE6OF01AD36X.42.74.G08.1.454.CMB.1.raw
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
tcagtgacgtatgtcacgaccggtgctcgatttagtagctctatcaggggacccaacaaccacatcccctcctcagaacgccccagagcacaactcctaaccatggactggacctgggaggatccttctttttgggtggcagcagccacagggtcggccacctcccgaggtcctactttgtgcagtcgtggggctggaggtgacaggaacggccccggggcctcgaggtgacgtactttccngcaaggtctttcgnggatacagtcttcaggttagttatcgacttatacgtaggtgggtgccgcccgaccgggaccccccggaagaaacggtcgttaggaggtggcgtaggggatgggagtcggtcgggtcggacctacctacctaatataagtattacttacaactaggtaacgtttcagttacaggtacgttacctaacgtttacgcgtaacgccgacacacgtcccgacgacgactacgtactacgagttagggtagttaggaggttacggactaagtagttcgtaggaacgaccgacggtcgttacgttacttaagtttacgtggtaggacggtagagtacgtccggtaacccttacggaaccgggtacggggtaccgggggtccccttacggtttacggtaaccggtttaccgggtacgggggacccgtaaacccggggtacccgttcggggtcccgtaccccgg

SEQ ID NO: 237615 - DNA, 555 bp, Homo sapiens
  misc_feature: GYAE6OF01APJZB.42.74.G08.1.454.CMB.1.raw
  modified_base (224)..(224): a, c, t, g, unknown or other
  misc_feature (224)..(224): n is a, c, g, or t
  modified_base (427)..(427): a, c, t, g, unknown or other
  misc_feature (427)..(427): n is a, c, g, or t
tcagtgacgtatgtcacgaccggtgctcgatttagtagctctatcaggggacccaacaaccacatccctcctcagaagcccccagagcacgaactcctaaccatggactggacctggaggatcctctttttggtggcagcagccacaggtggccactcccaggtccactttgtgcagtctggggctgaggtgcagaagccccggggcctcagtgacgatttccngcaaggcttctggatacagcttcagtagttatgctatacagtggtgcgccaggccccggacaaaggcttgagtggctggatggatcgtcggtggcacgtcctaacataagatattcacagaagtttcagttcagagtcacctttagcagcgacacatccgcgacgacagtctacatggagttgagtggcctaagatcgtgaanacgacggctgtctattactgtgcgagagatgacccttagacggtacggagggggcccctacgtttacggaacgtttaccggtacgggggtacccgaaggggtaaccccttggggtcccgtaaccccgg

SEQ ID NO: 237616 - DNA, 611 bp, Homo sapiens
  misc_feature: GYAE6OF01DTX21.42.74.G08.1.454.CMB.1.raw
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (282)..(282): a, c, t, g, unknown or other
  misc_feature (282)..(282): n is a, c, g, or t
  modified_base (324)..(324): a, c, t, g, unknown or other
  misc_feature (324)..(324): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtgccactcccaggtccactttgtgcagtctggggctgaggtgcagagcccgggctcagtgacgtatttcctgcaaggcttctggatacagtcttnagtagttangctatacagtggtgcgccacggccccganaaaggcttagagtgctgggatggatcgtggtgcactcctaanataagatatcacagaagtttcagttcagagtctacttagcagcaacacactccgacgaacgactagtactaacagtaggtagttgagtcggacctaaaggacttacgtagaaagaccgtacgtcgttagtacttaagttaacgtggttagacgaagtagattacgacctttaaccgaacgggtacgggtaacgggggaccccttaaggtttacggtaaacgtttaccgggtaccgggggtaacccgtaaaccggggtaaccccgtttgggtaccccgtaaccccggg

SEQ ID NO: 237617 - DNA, 551 bp, Homo sapiens
  misc_feature: GYAE6OF01DJCFZ.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagagcccgggctcagtgacgatttcctgcaaggcttctggatacagtcttcagtagttatgctatacagtgggtgcgccaggccccggacaaaggcttgagtggctgggatggatcggtcggtggcacgtcctaacgataacgatattcacagtaatttcagttcagagtcactttagctagcgacacatccgacgacgacagtctacatggagttgagtggacctaagatcgtagaacgacacggtctagtactattacgtgtgagagagatcgtaccttacacggacggtacggggtaccctacgtttacggactttacggtacggggactaacggggaacccttggtcctacccgg

SEQ ID NO: 237618 - DNA, 674 bp, Homo sapiens
  misc_feature: GYAE6OF01DGX6Q.42.74.G08.1.454.CMB.1.raw
  modified_base (173)..(173): a, c, t, g, unknown or other
  misc_feature (173)..(173): n is a, c, g, or t
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (292)..(292): a, c, t, g, unknown or other
  misc_feature (292)..(292): n is a, c, g, or t
tcagtgacgtatgtcacgaccggtgctcgatttagtagctctatcagggggacccaacaaccacatccctcctcagaagcccccagagcacaactcctaaccatggactggacctggaggatccttctttttggtgcagcagccacaggtggccactcccaggtccactttgngcagtctggggctgaggtgcagaacggcccgggctcagtgacgatttccngcaaggtcttcgnggatacagtcttcagttagttatgactatacagtggtgcgaccgacggccccgganaaacggcttggagtcggcgtgggatggtatcggtcgggtgtccgactcctaacgaagtaacgatatcactagtaagttcagtcagtacgtactactttagctacgcaacacacgtccgacgacgacagtctagacgtggtaagtgagtggactaagatcgagtacgacgacggtctacgtattagttaacctggtacggtacgtaggtacgttaaacgtccggtaaccgtttaaccgaaccgggggaacccgggttaaccggggggtaccccgttaacggtttttaccgggtaacgtttttaacccgggggtcccggggtaaacccgggtaaaccccgggggtaccccgtttaccggggttcccggtttaaacccccccggg

SEQ ID NO: 237619 - DNA, 564 bp, Homo sapiens
  misc_feature: GYAE6OF01CVXM7.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactccccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcggtcggtggcactcctaaacataaagatattcactagtaagtttcagttcagtagtctacctttagcagcgacacactccgcacgacagtctacagtggagttgagtggacctaagatctagaacgacgacggctgtctattactgtgcgagagtagtgccttacgaccggtacgggagggggtacccctacgtttggaactttacggtacggggacccgacggggtaaccccgtcgggtcccgtaccccgg

SEQ ID NO: 237620 - DNA, 758 bp, Homo sapiens
  misc_feature: GYAE6OF01EMKQU.42.74.G08.1.454.CMB.1.raw
  modified_base (226)..(226): a, c, t, g, unknown or other
  misc_feature (226)..(226): n is a, c, g, or t
  modified_base (353)..(353): a, c, t, g, unknown or other
  misc_feature (353)..(353): n is a, c, g, or t
tcagtgacgtatgtcacgaccggtgctcgatttagtagctctatcaggggacccaacaaccacatcccctcctcagaagcccccagagcacaactcctaaccatggactggacctggaggatcctctttttggtggcagcagccacaggtggccactcccaggtccactttgtgcagtcgtggggctggaggtgcagaacggcccgggcctcagtgacgatttccngcaaggcttctggatacagcttcgagttattatgctatactaggtgggtgcgccgacgggacccccggaagaacggcttaggaggtcggcgtgggagtggagttcggtcggtggcaccttaccgaanagtaagattacttacaacgtaagtaacgttttacgagtttacgaagtacgttccttaaccgtttagaccgtagtaccgacctaacgtacgttacccggacgtaccgaaccgtacggtaccttaaccgtagttacgggtagtttacgggaagggttccggtaaccgttaaagtacgttcgtaacggaacgtaaccggaccgggtacgttacggtttaccgttaagtttaccggttacggttacggtacggtaagggttaagtacgttaccgttacccggtaacggaaccggggtaacccggggtaccggggttaccccgtttaagttaccgggttaacggtttaccgggtaccgggggtaacccggtaacccggggtacccgttccggggtacccgttacccccgg

SEQ ID NO: 237621 - DNA, 534 bp, Homo sapiens
  misc_feature: GYAE6OF01BXCHL.42.74.G08.1.454.CMB.1.raw
  modified_base (383)..(383): a, c, t, g, unknown or other
  misc_feature (383)..(383): n is a, c, g, or t
  modified_base (454)..(454): a, c, t, g, unknown or other
  misc_feature (454)..(454): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagagcccgggctcagtgacgatttcctgcaaggcttctggatacagcttcagtagttatgctatacagtgggtgcgccaggcccccggacaaaggcttgagtggctgggatggatcggtcggtggcactcctaacataagatattcacagtaagtttcagttcagagtcactttagcagcgacacatccgngaccgacacgtctacatggagttgagtggactagatctgaagacgacggctgtctattactgtgcgagagntacgccttaacgacggacggacggggccctacgtttgaacttacggtcggggaccaagggacccttgggtccctacccgg

SEQ ID NO: 237622 - DNA, 637 bp, Homo sapiens
  misc_feature: GYAE6OF01C6M21.42.74.G08.1.454.CMB.1.raw
  modified_base (263)..(263): a, c, t, g, unknown or other
  misc_feature (263)..(263): n is a, c, g, or t
  modified_base (297)..(297): a, c, t, g, unknown or other
  misc_feature (297)..(297): n is a, c, g, or t
  modified_base (423)..(423): a, c, t, g, unknown or other
  misc_feature (423)..(423): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtctggggctggaggtgcagaaggcccggggcctcagtgacgtatttcctgccaaggtccttctggatacagtcttcagttagttangtctatacaggtgggtgcgccacggcccccgganaaaggctgagtggctgggatggatcggtggtggcactcctaaacagtaaagatattacacagtaagtttcagttcagtagtctacctttagcgacgcgtacactactccgacgacgacagtactanatggtagtgagtcggactaagatctagaacgacgacggcttacgtacttattacgtgttggacgtaggagtagtaccgtacctttaaccgaccgggtaaccgggtaccggggggtacccccttaacgggttttaccgaacggttttaacccgggtcgggggtaaccccggtaacgggggttaacccccgttgggttaccccgttaacccccggg

SEQ ID NO: 237623 - DNA, 565 bp, Homo sapiens
  misc_feature: GYAE6OF01BDZHJ.42.74.G08.1.454.CMB.1.raw
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagttagttatgctatacagtgggtgcgccaggccccganaaaggctgagtggctgggatggatcggtcggtggcacgtcctaacataagatattcacagtaagtttcagttcagagtcacctttagctagcgacacatccgcgtacgacagtctacagtggtagttgaagtcggacctaagatcgtaggaacgacgacggtctacgtacttattaccgttgtcgacgagagatgtccttaacgacggtacggacgggggccctaacgtttcgacgtttacggtcggggacccgtacgggaacccgtgggtccctacccgg

SEQ ID NO: 237624 - DNA, 542 bp, Homo sapiens
  misc_feature: GYAE6OF01EU798.42.74.G08.1.454.CMB.1.raw
  modified_base (233)..(233): a, c, t, g, unknown or other
  misc_feature (233)..(233): n is a, c, g, or t
  modified_base (284)..(284): a, c, t, g, unknown or other
  misc_feature (284)..(284): n is a, c, g, or t
  modified_base (440)..(440): a, c, t, g, unknown or other
  misc_feature (440)..(440): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttcnggatacagcttcagtagttatgctatacagtgggtgcgccaggccccgganaaaggcttgagtggctgggatggatcggtcggtggcactcctaacataagatattcaacagtaagtttcagttcagtagtcacctttagcctagcgacacatccgcgtacgacagtctacatggagttgagtggacctaagatctgaagacacggntgtactattactgtgacgagagatgaccttacgacggacggtagggggccctacgtttgaacttacgtcggggaccaaggggaacccctggtccgtacccgg

SEQ ID NO: 237625 - DNA, 532 bp, Homo sapiens
  misc_feature: GYAE6OF01DULTX.42.74.G08.1.454.CMB.1.raw
  modified_base (253)..(253): a, c, t, g, unknown or other
  misc_feature (253)..(253): n is a, c, g, or t
  modified_base (340)..(340): a, c, t, g, unknown or other
  misc_feature (340)..(340): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttctggatacagcttcagtagttangctatacagtgggtgcgccacggcccccggacaaaggcttgagtggctgggatggatcgtcggtggcactcctaacataagatattnactagaagtttcagttcagtagtctacctttagcagcgacacatccgcgaccgacagtctacatggagttgagtgacctaagatctagaagacgacggctgtactattacgtgtgacgagagatgccttacgacgacggaggggccctcgttcgtagttacgtcggggaccagggaccctggtccgtacccg

SEQ ID NO: 237626 - DNA, 637 bp, Homo sapiens
  misc_feature: GYAE6OF01DP5JK.42.74.G08.1.454.CMB.1.raw
  modified_base (132)..(132): a, c, t, g, unknown or other
  misc_feature (132)..(132): n is a, c, g, or t
  modified_base (225)..(225): a, c, t, g, unknown or other
  misc_feature (225)..(225): n is a, c, g, or t
  modified_base (472)..(472): a, c, t, g, unknown or other
  misc_feature (472)..(472): n is a, c, g, or t
  modified_base (520)..(520): a, c, t, g, unknown or other
  misc_feature (520)..(520): n is a, c, g, or t
  modified_base (550)..(550): a, c, t, g, unknown or other
  misc_feature (550)..(550): n is a, c, g, or t
tcagtgacgtatgtcacgaccggtgctcgatttagtagctctatcagggacccaacaaccacatcccctcctcagaagcccccagagcacaactcctaaccatggactggacctggaggatcctcttttggnggcagcagccacaggtggccactcccgaggtccactttgtgcagtcgtgggctggaggtgcagacggcccgggcctgagtgacgtattttccngacaacggtctttcgtggataccgagtccttagagttagttatgtctataacgagtgggtcgccgaccgacggacccccggaaagaaacggtcttggaagtcggcgtaggggtaagtggtagtcggtcggtggccaactacctaaacaagtaagtatacttacaacgaagttaagtttacaggttacagtaacggtcctaaccgtttagcagacgaactacgactccgacgacgaactagtacctanagtaggtaagttgagttggacctaaggactcgtaagaacgacgacgtntacgtacttagttacgtgtagacgtagtanagtcgtacctaggaccgacgggtacgggacccttgttaacgacgttacgggtacgggaccgaagggtaccccgtggtccgtaacccg

SEQ ID NO: 237627 - DNA, 665 bp, Homo sapiens
  misc_feature: GYAE6OF01BSS8N.42.74.G08.1.454.CMB.1.raw
  modified_base (229)..(229): a, c, t, g, unknown or other
  misc_feature (229)..(229): n is a, c, g, or t
  modified_base (298)..(298): a, c, t, g, unknown or other
  misc_feature (298)..(298): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtcgtggggctggaggtgcaggaacggcccggggctcgagtgacgtatttccngcaaggctttcgtggatacgagtcttacgagttagttatgctatacagtgggtgcgccacggccccganaaggcttgagtggcgtgggatggatcggtcggtggctacgtcctaaacgattaagattattacaacgtaagtaacgtttcaagtttcagtacgtactaccgttttagctaagcgaactacacgtcccgcgtaacgacgacgttctaacgagttaggtaaggtttaggagttacgggaccttaagtattaccgtaagaacgaccgtacggtccttagttacgttaatttacgtggttaggcggtaagtacgtagtccgtacccgttaacgaaccgggtaccgggaccggggtcccttaacggttttcggaacgtttaccgggtcggggtacccgtaacggggtaccccttgggtcccgttaaccccgg

SEQ ID NO: 237628 - DNA, 577 bp, Homo sapiens
  misc_feature: GYAE6OF01CNVPS.42.74.G08.1.454.CMB.1.raw
  modified_base (222)..(222): a, c, t, g, unknown or other
  misc_feature (222)..(222): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtctggggctgaggtgcagaagcccgggcctcagtgacgatttccngcaaggcttctggatacagtcttcagtagttatgctatacagtgggtgcgccaggcccccggacaaaggcttgagtggctgggatggatcgtcggtggcactcctaacataagatattcacagtaagtttcagttcagagtctacctttgcagcgacacatccgcgacgacagtcctactagtggtagttggagtcgggacctaagatcgtagaagaccgacggctagtactattacgtgtacgcggagagtatcgtaccttacgaccggtaccgggacgggggtaccctacgtttacggacgtttacggtacggggacccgtaacggggtacccctgggtcccttaaccccggg

SEQ ID NO: 237629 - DNA, 609 bp, Homo sapiens
  misc_feature: GYAE6OF01AB84I.42.74.G08.1.454.CMB.1.raw
  modified_base (350)..(350): a, c, t, g, unknown or other
  misc_feature (350)..(350): n is a, c, g, or t
tcagtgacgtatgtcacgaccggtgctcgatttagtagctctatcaggggacccaacaaccacatccctcctcagaagcccccagagcacaactcctaaccatggactggacctggaggatccttcttttggtggcagcagccacaggtggccactcccaggtccactttgtgcagtcgtggggctgaggtgcagaacggcccggggcctcgagtgacgtatttcctgacaaggtcttctggatacagtcttcagttagttatgctatacgaggtgggtgccgccgaccggacccccggagaaacggcttggaggtggcgtgggatggagtcggtggtggcactcctaanataagtatacttcactagtaattcgagttcagtacgtctacgtttagactacgcgacacacgtccgaccgacgactagtactacagtaggtagttgaggttacggtaccttaagacgtcgtaagaacggacgtacggtcttacgtacttagttacgttggtacgacgagtagtactcgtacctacgacggtacgggaccgggaccttagttcgaacgttcggtcgggaccggtaaccgggtcccgtcggtccgtacccg

SEQ ID NO: 237630 - DNA, 546 bp, Homo sapiens
  misc_feature: GYAE6OF01BF3ZN.42.74.G08.1.454.CMB.1.raw
  modified_base (286)..(286): a, c, t, g, unknown or other
  misc_feature (286)..(286): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccacggcccccgganaaggcttgagtggcgtgggatggatcgtcggtggcactcctaacataagatatcacagaagtttcagttcagtagtctacctttagcagcgacacatccgcgacgacagtctacatggagttagagtggacctaagatcgtagaagacgacggctgtctattacgtgtcgcgagagtatgtacctacgacgacggaggggaccctacggtttagacgttacggtcggggaccgtagggtacccgtcgggtcctaccccgg

SEQ ID NO: 237631 - DNA, 538 bp, Homo sapiens
  misc_feature: GYAE6OF01D7LCU.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccacggcccccggacaaaggcttgagtggctgggatggatcggtcggtggcactacctaacataagatattcacagtaagtttcagttcagtagtctactttagctagcgacacatccgcgacgacagtctacagtggtagttgagtggactaagatctgaagacgacggctgtctattactgtgcgagagatgtacctacgacgacggacggggacctcgttagtagttacgtcgggaccgaagggtacccgtggtccgtacccgg

SEQ ID NO: 237632 - DNA, 608 bp, Homo sapiens
  misc_feature: GYAE6OF01ATEGZ.42.74.G08.1.454.CMB.1.raw
  modified_base (335)..(335): a, c, t, g, unknown or other
  misc_feature (335)..(335): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttcgtggatacagcttcagtagttatgctatacagtgggtgcgccacgggcccccggacaaggcttgacggtggcgtgggatggagtcggtcggtggcactcctaanataagatattcactagtaagtttcagttcagtagtctacctttagctagcgacacacgtccgcgacgacacgtctacagtggtagttggagttacggacctaagtactcgtaggaacgaccgacggtctagttactattacgttgtgtacgagtagtacgtacgtaccgttacgaaccggaccgggtacgggggtaccctacggtttacgtaacggtttaccgtccgggggtaacccggtaaccgggtaacccgtccgggtcccgtaccccgg

SEQ ID NO: 237633 - DNA, 559 bp, Homo sapiens
  misc_feature: GYAE6OF01ELE8R.42.74.G08.1.454.CMB.1.raw
  modified_base (221)..(221): a, c, t, g, unknown or other
  misc_feature (221)..(221): n is a, c, g, or t
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggctcagtgacgatttccngcaaggcttctggatacagcttcagtagttatgctatacagtgggtgcgccaggcccccgganaaaggcttgagtggctgggatggatcgtcggtggcactcctaacataagatattcaacagtaagtttcagttcagagtctacctttagcagcgacacactccgacgacgacagtactacagtggagttgagtgacctaagatctagaacgacacggctagtactattactgtgacgagagtatcgccttaacgacggtacggacgggggaccctacgtttcggaacgtttacggtcggggacccgaacggggtacccgtggtcccgtaaccccgg

SEQ ID NO: 237634 - DNA, 741 bp, Homo sapiens
  misc_feature: GYAE6OF01DKTFN.42.74.G08.1.454.CMB.1.raw
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaacgcccccagagcacaactcctaaccatggactggacctggaggatccttctttttggtggcagcagccacagggtggccacctcccaggtcctactttgtgcagtcgtggggctggaggtgcgagaacggcccgggctcgagtgacgtatttccngacaaggtcttacgnggactacagtcttcgagttagttagtgacttatacgnggtgggtcgccgccgacggccccggaacgaaaggtcgttaggaggtcggtcgtggggtagtaggtcgtccgggttcgggtcggacgtaccgttaccgtaaactagtaaagtacttaagttacaagtaacgtaaacgttttcaaggtttacgaagtaacgttcgtaacgttttagccgtaagtccgaactacaccgttaccgcgaacgacgtatcgtaacagttaggagttacggagtcggtaactaacgattaccgtaggaacgacgtacggtcgtacgttacgttaacgtttacggtggttacggtacgaggtaacgtacgttccgaacccgtttaaccggaaccggtaaccgggtaccggggttaacccttacggtttaccggttaaacggttacccggggtacggggtaacccggtaacccggggttacccttaccggggtccgttaacccccg

SEQ ID NO: 237635 - DNA, 565 bp, Homo sapiens
  misc_feature: GYAE6OF01BUNPZ.42.74.G08.1.454.CMB.1.raw
  modified_base (131)..(131): a, c, t, g, unknown or other
  misc_feature (131)..(131): n is a, c, g, or t
  modified_base (189)..(189): a, c, t, g, unknown or other
  misc_feature (189)..(189): n is a, c, g, or t
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (285)..(285): a, c, t, g, unknown or other
  misc_feature (285)..(285): n is a, c, g, or t
  modified_base (365)..(365): a, c, t, g, unknown or other
  misc_feature (365)..(365): n is a, c, g, or t
tcagtgacgtatgtcacgaccggtgctcgatttagtagctctatcaggggacccaacaaccacatccctcctcagaagccccagagcacaactcctaacatggactggacctggaggatcctctttttggnggcagcagccacaggtggccactcccaggtccactttgtgcagtctggggctgaggtncagaagcccgggctcagtgacgatttccngcaaggctttcgnggatacagcttcagttagttatcgctatacaggtggtgcgccacggccccgganaaacggcttggacgtggcgtagggagtggatcggtcggtggacacgtactaacataagatattcacagtagtttcagttnagagtcaacctttagcagcgacacataccgcgacgacacgtactacagtaggtagttgagtggactaagatctagaagacacgtctgtactagtactagtcgacgagagatcgtaccgttaacgacgtacggacggggtaccctcgttacggtacttacggtacgggtaccgtacgggaacccgtgggtccctaacccgg

SEQ ID NO: 237636 - DNA, 556 bp, Homo sapiens
  misc_feature: GYAE6OF01BVQ0A.42.74.G08.1.454.CMB.1.raw
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtctggggctgaggtgcagaagcccgggcctcagtgacgatttcctgcaaggcttctggatacagcttcagttagttatgctatacagtggtgcgccacggccccggacaacggcttgagtggcgtgggagtggagtcgtcggtggcactcctaanataagatattcanagtaagttcagttcagtagtactactttagctagacgacacatccgcgacgacacgtacagtatggtagttggagtggtaccgtaagacgtctagaagaccgacgtcttgtacttagttactgtagcgtagagtatacgcctacgacggacgggacggggtccctgttacgagttacggtcgggaccgtagggacccgtggtccgtacccg

SEQ ID NO: 237637 - DNA, 586 bp, Homo sapiens
  misc_feature: GYAE6OF01AHDVV.42.74.G08.1.454.CMB.1.raw
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagagcccggggcctcagtgacgatttcctgcaaggcttctggatacagcttcagtagttatgctatacaggtgggtgcgccacggcccccganaaggcttgaggtggcgtgggatggatcggtcggtggcactacctaacataagatattcacagtaagtttcagttcagagtctacctttagctagcgacacactccgcgacgacagtctacagtggagttgagtcggacctaagatacgtgaacgacgacggtctacgtcgttacttacgttgtcgcggtagagtagtcgacccgttacgaaccggtacgggaccgggggtacccctacggtttacgaacgtttacgggtcgggggacccgacggggtaaccccgtgggtcccgtaccccgg

SEQ ID NO: 237638 - DNA, 551 bp, Homo sapiens
  misc_feature: GYAE6OF01BQ1TP.42.74.G08.1.454.CMB.1.raw
  modified_base (255)..(255): a, c, t, g, unknown or other
  misc_feature (255)..(255): n is a, c, g, or t
  modified_base (287)..(287): a, c, t, g, unknown or other
  misc_feature (287)..(287): n is a, c, g, or t
  modified_base (459)..(459): a, c, t, g, unknown or other
  misc_feature (459)..(459): n is a, c, g, or t
  modified_base (470)..(470): a, c, t, g, unknown or other
  misc_feature (470)..(470): n is a, c, g, or t
tcagtgacgtatgtcacgaccggtgctcgatttagtagctctatcaggggacccaacaaccacatccctcctcagaacgcccccagagcacaactcctaaccatggactggacctggaggatccttcttttggtggcagcagccacaggtggccactcccaggtccactttgtgcagtctggggctgagtgcagaagcccgggctcgagtgacgtatttcctgcaaggcttctggatacagtcttcagtagttangctatacagtggtgcgccgacggacccccganaaaggcttgagtggcgtgggatggatcgtcggtgctacgtactaacataagatatacacagtaagtttcagttcagtagtcactttagacagcgacacactccgagacgacagtactacagtggtagttgagtgactaagtagtctagaagaccgagtctgtactattacgngtgacgagagntacgtacctaagaccggtacgacggggtccctagtttcgtagttacggtcgggaccgaaggtacccgtggtcctaacccgg

SEQ ID NO: 237639 - DNA, 587 bp, Homo sapiens
  misc_feature: GYAE6OF01B9C5P.42.74.G08.1.454.CMB.1.raw
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaacgcccgggcctcagtgacgatttcctgcaaggcttcnggatacngtcttcagtagttatgctatacgngtgggtgcgccacggcccccggaanaacggtctggagtggcgtgggatggatcggtcggtggcctactaccctaacgataagtatacttcaacgtagtaagtttcagttcagtacgtctaccgtttagcagcgacacgctccgacgacgacagtctacagtggtagtgagtgaccgtagtatcgtagagacacggctagtcgtacttcgtgtcgcgagacgtagtcgaccttaacgaccggtacgggtaccgggggcccttaggttacgtaacgttaccggtccggggtaccgaaccggggtacccctgggtacccgtacccgg

SEQ ID NO: 237640 - DNA, 810 bp, Homo sapiens
  misc_feature: GYAE6OF01DSZC4.42.74.G08.1.454.CMB.1.raw
  modified_base (238)..(238): a, c, t, g, unknown or other
  misc_feature (238)..(238): n is a, c, g, or t
tcagtgacgtatgtcacgaccggtgctcgatttagtagctctatcaggggacccaacaaccacatccctcctcagaagccccagagcacaactcctaaccatggactggacctggaggatccttctttttggtggcagcagccacgaggtggccactcccaggtccactttgtgcagtcgtggggctgaggtgcagaacggcccgggcctcagtgacgtatttcctgcaaggctttcnggactacgagtcttcgagttagtttatcgtacttaagtacgtaagggttcgggttacgcggacccgaccggggaccccccggtaaacgaaaacgggtccgtttagggaacggttcgggtcgttagggggtaacgttgggtaacggttccgggttcggggttcgggaccctaaccgttaccccgttaaaacaagtaaaacgtaacttaatttaccgaaacgtaaggttaaaggtttacctaaggtttaccgaagtacgtttaccctaaccgttttacggaccgtaaggccgtaaaccacgtacgtacccgaacgaccgaacctacggttaccttaacgtagtacgggtaagttacggaacgggtcggtaaccgtaaaggtactacgttaacggaaagtaccaacgggtctttacgtaccttaagttacgttggtagacggtaagtagtacgtacggtacccttaaggaccggtaccgggaccggggttaccctaacggtttacggttaaccgtttaccggtacgggggtacccggaaacggggtttacccgttaggtccccggtttaacccgg

SEQ ID NO: 237641 - DNA, 590 bp, Homo sapiens
  misc_feature: GYAE6OF01BH4X0.42.74.G08.1.454.CMB.1.raw
  modified_base (295)..(295): a, c, t, g, unknown or other
  misc_feature (295)..(295): n is a, c, g, or t
  modified_base (340)..(340): a, c, t, g, unknown or other
  misc_feature (340)..(340): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtgccactcccaggtccactttgtgcagtcgtggggctgaggtgcagacgcccgggctcagtgacgtatttcctgcaaggctttcgtaggactacgagtccttcaggttagttatgctatacagtgggtgcgccgacggccccgganaaggctgagtggcgtgggatggagtcggtcggtggcactcctaanataagatatcacagtaagtttcagttcagtacgtctacctttagcgagcgacacacgtccgcgaacgacagtctacgacgtaggtagtagagtcggactaagtatacgtagaagacgaacggcgttagtacgtattacgttgtgtacgagacgtacgtcgtacttaccgacgtacgggtacggggtacccttaggttcgtacgttacgggtacgggtaccgtaacgggacccttcgggtcctaaccccgg

SEQ ID NO: 237642 - DNA, 862 bp, Homo sapiens
  misc_feature: GYAE6OF01DCAAX.42.74.G08.1.454.CMB.1.raw
  modified_base (133)..(133): a, c, t, g, unknown or other
  misc_feature (133)..(133): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggnggcagcagccacaggtggccactcccaggtccactttgtgcagtctggggctgagtgcagagcccgggctcagtgacgatttcctgacgaaggtcctttacgtggtactaccgaggtcttacgaaggttaagttatacgcttaataccgtaggttgggtgcgtaccgaccggacccccggtaacgaaaccggtaccgttaggtaggtggccgttaggggtacgttagggtacgtccgggttaccggtcgggacctaccgttacccgtaaacgtaagttaaacggtaagttaacttacctaaaccgtaaggttaaacggttttaccgtaacggttttaccgtaaaggtaacggtttaaccctaaccgtttttaacggacccgttaaggacccggtaaccaaccgtaacgttacccccggacggtaaacccggaaccgtaaccgggttacccttaacgtaaaccggtttaggggtaaaccgggtttttacgggaacgggtttcgggtaaccccttaaaacgggtaacttccgttaacggaaacggtaccgtaaccgggtccttacggttaccgttaactttacgtaggtttaccggacgtaaggtaagggaacttacggtaccccgtttaaacgaaccccgggtaaggggtaacccgggggtcccttaacggtttacggactttacggtacggggaccgtaaccggggtaccctacgggtctaaaccccgg

SEQ ID NO: 237643 - DNA, 668 bp, Homo sapiens
  misc_feature: GYAE6OF01C4QYB.42.74.G08.1.454.CMB.1.raw
  modified_base (125)..(125): a, c, t, g, unknown or other
  misc_feature (125)..(125): n is a, c, g, or t
  modified_base (132)..(132): a, c, t, g, unknown or other
  misc_feature (132)..(132): n is a, c, g, or t
  modified_base (171)..(171): a, c, t, g, unknown or other
  misc_feature (171)..(171): n is a, c, g, or t
  modified_base (188)..(188): a, c, t, g, unknown or other
  misc_feature (188)..(188): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (486)..(486): a, c, t, g, unknown or other
  misc_feature (486)..(486): n is a, c, g, or t
tcagtgacgtatgtcacgaccggtgctcgatttagtagctctatcaggggacccaacaaccacatccctcctcagaacgccccagagcacaactcctaaccatggactggacctggagatccttnttttggnggcagcagccacaggtcgccactcccaggtccactttgngcagtctgggctgagtncagaggcccgggctnagtgacgtatttccngcaaggtctttcnggaactcgagtcttacgagttagttatgtactatagtggtgggtcgccgaccgaccgggacccccggtaagaaacggtcgttaggacggtggcgttagggatggattcggtggtacgcacgttaccaatataagtatacgttcaacgtagtaagtttcagttacagtacgtcctaaccgtttagcacggcaactacaccgccggacgtacgacgtagtaccagtagtaggtaagttgacgttaggacctaaggtntacgtagaacgaaccgtgtacttgtaccgtttaagtccgttgtacgacggtagtacgtaagtcgtaaccgttaacggaaccgggtccgggtaacgggttaccccttaagtttacggtaacggtttcccgggtacgggggtacccaaaccggggtttccccgttcgtaccccggttaaccccg

SEQ ID NO: 237644 - DNA, 737 bp, Homo sapiens
  misc_feature: GYAE6OF01BHNT2.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctcttttggtggcaggcagccacaggtggccactcccaggtccactttgtgcagtctggggctgaggtgcagaagcccgggcctcgagtgacgatttcctgcaaggcttcgtggatacgagtcttcgagttagttagtgactataccgtaggtcgggtgccggccgaccgggacccccggaagaaaggtccttaggagtcggcgttgggaagtcggacttcggtacggtcggactaccgtacctaaactataagtactattaccgaactaagtaaacgtttcgaacgttacgaggtaacttacccgtaaccgttttaagacctaacgggtaaccaaccgtaaccgtaaccgttcccggaaccgggaaacccgtacgtacggttaccctaaaccgtgttaagggtacgtttaggacggttacgtaacctaaaggtcgtacgtaacggaagaacccgtcgggtaccttacgttctaaacgttactgggtaccgagtacgagtacgtcgtaccgttaaaccgcgggtaaccggtacccgggtaccttaacgtttaccggaagtttacccgggtcggggaacccgtaccgggttaaaccccgtggtaccccgtacccgg

SEQ ID NO: 237645 - DNA, 579 bp, Homo sapiens
  misc_feature: GYAE6OF01APNEG.42.74.G08.1.454.CMB.1.raw
  modified_base (286)..(286): a, c, t, g, unknown or other
  misc_feature (286)..(286): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgagtgcagaagcccggggcctcagtgacgatttcctgcaaggccttctggactacagtcttcagtagttatgctatacagtgggtgcgccacggccccgganaaggcttgagtggctgggatggatcgtcggtgcactctacataagntatcanagaagttcagttcagtntctactttagctagccganacactccgcgacgacacgtctacagtcggagttgagtgacctaagactcgaggtaagaccgtaacggtcttacggtcttattaccgtgtcgacggtagacgtacgtcgaccttaaccgacggtaaccgggtacggggaccctacgtttacgtacgttaccgggtcggggtacccgaaggggtaccctcgggtcccgtaaccccgg

SEQ ID NO: 237646 - DNA, 609 bp, Homo sapiens
  misc_feature: GYAE6OF01EQT6B.42.74.G08.1.454.CMB.1.raw
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggctcagtgacgatttcctgcaaggcttctggatacagcttcagtagttatgctatacagtgggtgcgccacggccccggtanaaaggcttgagtggcgtgggatggatcggtcggtggcactcgtaacataagatagttacactagtaagttcagttcagagtctactttagctagcgacactactcgacgacgacagtctacagtaggagttgagtcggtacctaagctcgtagaacgtacgacgtctagtacgtaattacgtgttcgacgtagacgtagttcgtacctttaaccggaccggtacgggtaaccgggggtacccctacggttttacggtaacgttaacgggtccgggggaacccgtaacgggggtaacccccgttgggtaccccgttaaccccggg

SEQ ID NO: 237647 - DNA, 620 bp, Homo sapiens
  misc_feature: GYAE6OF01A4KJ5.42.74.G08.1.454.CMB.1.raw
  modified_base (240)..(240): a, c, t, g, unknown or other
  misc_feature (240)..(240): n is a, c, g, or t
tcagtgacgtatgtcacgaccggtgctcgatttagtagctctatcaggggacccgaacaaccacatccctcctcagaagcccccagagcacaactcctaaccatggactggacctggaggatcctcttttggtggcagcagccacaggtggcccactcccaggtcccactttgtgcagtctggggctgaggtgcagagcccgggcctcagtgacgatttcctgcaaggcttctggatacngcttcagtagttatgctatacagtgggtgcgccacggccccggacaaaggccttagagtggcgtggatggatcggtcggtggcacctcctaacgataacgtatattcactagtaacgtttcagttcagacgtactaccgtttagcaggcgacacacgtccggcgacgaacacgtctaacagtaggtacgtttagacggtcggtacctaagtactcgtaggaagaccgacgggtctacggttcgttaacgtttacgtgttacggacggtaggtagtacgtcgtaccgttacgaccgggtaccggacgggggtaccctacgtttacgacgtttacggtacggggtacccgacgggtaaccccgttcgggtccgtaaccccgg

SEQ ID NO: 237648 - DNA, 574 bp, Homo sapiens
  misc_feature: GYAE6OF01D60AJ.42.74.G08.1.454.CMB.1.raw
  modified_base (222)..(222): a, c, t, g, unknown or other
  misc_feature (222)..(222): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttccngcaaggcttctggatacagcttcagttagttatgctatactagtgggtgcgccaggcccccggacaaaggcttgagtgcgtgggatggatcgtcggtggcactcctaacataagatattcacagtaagtttcagttcagtagtctacctttagcagcgacacatccgacgacgacagtactacagtacggtagttgaggtggacctaagactcgtagaacgacgacggctacgtacttattacgtgtgacgagagatcgtaccttaacgacggtacggtacggggcccttacgtttaggtacttaccgggtacgggacccgtaaccgggtacccgtcggtcccgtaccccgg

SEQ ID NO: 237649 - DNA, 577 bp, Homo sapiens
  misc_feature: GYAE6OF01B3XGT.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctgggggctgaggtgcagaagcccggggcctcagtgacgatttcctgcaaggcttctggatacagcttcagtagttatgctatacagtgggtgcgccacggcccccggacgaaaggcttgagtggcgtgggatggatcgtcggtggcactctaacataagatattacacagtaagtttcagttcagagtcactttagcagcgaacacactccgcgacgacagtctacagtggagttggagtcggtctaagatcgtagaagacaggctagtcttatttacgtgtcgacgagagacgtgtacccgttaagaaccggacggtacgggggcccttaacggtttcggtaacgttacgggttcggggacccgtaacggggaaccccgttcgggtcccgtaccccgg

SEQ ID NO: 237650 - DNA, 614 bp, Homo sapiens
  misc_feature: GYAE6OF01BSL9P.42.74.G08.1.454.CMB.1.raw
  modified_base (287)..(287): a, c, t, g, unknown or other
  misc_feature (287)..(287): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccgacggcccccgganaaaggcttgagtggcgtgggatggatcggtcggtgcactctaacataagatatcacagtaagtttcagttcagtatctactttagcagccgacacacgtccgacgacgacagttcctaacgagttacggagtttggagtcggtacctaagtactcgtagaacgacgacggtctagtcttagttacgtgtggcgagagtactacggtacccttaacgaaccgggtaccgggaccgggggtaccccttacggttttacggtaaccgtttacgggtaccgggggaacccgtaaccgggggtaaccccgttgggtaccccggtaaccccgg

SEQ ID NO: 237651 - DNA, 631 bp, Homo sapiens
  misc_feature: GYAE6OF01C68GR.42.74.G08.1.454.CMB.1.raw
  modified_base (134)..(134): a, c, t, g, unknown or other
  misc_feature (134)..(134): n is a, c, g, or t
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
tcagtgacgtatgtcacgaccggtgctcgatttagtagctctatcaggggacccaacaaccacatccctcctcagaacgcccccagagcacaactcctaaccatggactggacctggaggatccttcttttggnggcagcagccacaggtggccactcccaggtccactttgtgcagtcgtggggctgaggtgcaggaacggcccggggcctcgagtgacgtactttccngcaaggtcttcgtggatacagtcttnagttgttatgctatacaggtgggtgcgccgacgggcccccggaagaaacggcttggaggtggcgtgggacgtggatccgggtcgggtggcaacgtaccctaaacactaaagtagttactactacaaggtaagtttacacggttacaagtacgttctaacctttagccgtagacgaccactaactccggcgaaccggactacgtctaccgtagtggtaagttggagtcggtaacttaaggactacgtagaacgacgtacggtctagttacgttacttacgtgtcgacgagagtatacggacttacgacggacgggtacgggtacctcgtttagtacttacggacgggtaccgacgggaaccctgggtcctacccgg

SEQ ID NO: 237652 - DNA, 803 bp, Homo sapiens
  misc_feature: GYAE6OF01C9EGL.42.74.G08.1.454.CMB.1.raw
tcagtgacgtatgtcacgaccggtgctcgatttagtagctctatcagggacccaacaaccacatccctcctcagaacgcccccagagcacaactcctaaccatggactggacctggaggatccttcgtttttggtggcagcagccacgaggtggccacctcccaggtcccactttgtgctagtcgtgggctggaggtgcaggaacggcccggggctcgagtcgacgtactttccgtgacgaaggtcttcgtaggtactacgaggtcctttacgtaaggtttagtttagtcgtacgttaagtaacggtaggttcggggtcggccggacccggaacccggggaccccccggtaacgtaaacggtccgtttagggtacggttcgggcggtaggggtaacgtggacggttcgggtccgggtacggacccgtaccgttacctaaacgtaagtaacgtacgttaacttacgtaacgtaagttaacgtttacgtagttacgtaagtaccttacctaacgtttacgacgacgtaccgacacgtaccgtccgacgtacgaccgagtactaacgtagtaggtacggtagtagtcggaactaagtcgtacgaggtacgacgtacggtctacgtacgttacgttacgtacggttaggacgtaacgacggttagttaccccgtaaccggttaacggaacggggtacccggggtaaccgggttacccttaaacgggttttccggaacggttttaacccggggaccgggttaacccgggtaacccgggttacccggtcccggttaaccggttaccccg

SEQ ID NO: 237653 - DNA, 783 bp, Homo sapiens
  misc_feature: GYAE6OF01BJ91T.42.74.G08.1.454.CMB.1.raw
  modified_base (132)..(132): a, c, t, g, unknown or other
  misc_feature (132)..(132): n is a, c, g, or t
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
tcagtgacgtatgtcacgaccggtgctcgatttagtagctctatcaggggacccaacaaccacatccctcctcagaacgccccagagcacaactcctaaccatggactggacctggaggatcctcttttggnggcagcagccacaggtggccactcccaggtccactttgtgcagtcgtggggctggaggtgcagaacgcccggggctcagtgacgatttccgtgactaaggcttcgtggactacgagtcttacagttagttangctatacgaggtggtgcgccgacggaccccganaaacggcttcgagtggcgtgggacgtggatcggtcggtggctacgtacctaacgagtaacggtattacgtacaacgtagtaagtttcgaacgtttcaaggtacgttacctaaccgttttacgacgaacggtaccgaacaaccgtaacgttacccggaccggtaaccgtaccgtaacgttaccttaaacgtacgttagggtacggtttaggtacgggttacgggaacccgttaaaggtaccgtttacgttaacgggaaacgtaacccggtaacgggtaccgtttacggttaaccgttaacttttaaccggttggtttaaccgggacgggtaacggtaacgtacggttaccggttaccctttaaaccggaaccggggtaaaccgggttacccggggggtaaccccttacggtttacggtaaccgtttacggggtaccggggtacccgtaaacggggtaccccggttccgggtaacccgttaaccccgg

SEQ ID NO: 237654 - DNA, 597 bp, Homo sapiens
  misc_feature: GYAE6OF01EQTCO.42.74.G08.1.454.CMB.1.raw
  modified_base (293)..(293): a, c, t, g, unknown or other
  misc_feature (293)..(293): n is a, c, g, or t
  modified_base (314)..(314): a, c, t, g, unknown or other
  misc_feature (314)..(314): n is a, c, g, or t
  modified_base (451)..(451): a, c, t, g, unknown or other
  misc_feature (451)..(451): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctggaggtgcagaacggcccggggcctcgagtgacgtatttcctgcaaggtcttcgtggatacagtcttcagtagttatgctatacaggtggtgcgccacggccccgaanaacggctgagtggcgtagggntggagttcggtcggtggctactactaactataagatatcactagtaacgtttcagttcagtacgtacgtacctttagctagaccacacacgtaccgacgacgacacgtactacgagtggtagtagagtggactaagntagtagaagcgtacggctacgtctagttacgtacgtagacgtagagatccggacttaaccggaccggaccgggtacggggtacccttacggttagtaacgtttacggacgggtaccgaaccgggtacccgtcggtaccgtaccccg

SEQ ID NO: 237655 - DNA, 704 bp, Homo sapiens
  misc_feature: GYAE6OF01BFCW4.42.74.G08.1.454.CMB.1.raw
  modified_base (132)..(132): a, c, t, g, unknown or other
  misc_feature (132)..(132): n is a, c, g, or t
  modified_base (226)..(226): a, c, t, g, unknown or other
  misc_feature (226)..(226): n is a, c, g, or t
tcagtgacgtatgtcacgaccggtgctcgatttagtagctctatcaggggacccaacaaccacatccctcctcagaagccccagagcacaactcctaaccatggactggacctggaggatcctctttttggnggcagcagccacaggtggccactcccaggtccactttgtgcagtcgtggggctggaggtgcagaacggcccgggctcgagtgacgtactttccngcaacggtctttcgtaggactacgcgtcttacagttacgttatcgtacttagtacgtaggtcgggtcgccgacccgaccgggacccccgaagaacgggtcgttaggacggtcggcggtagggagtggacgttccggtcggtacggacctacgttacctaaagtaacgtaaagtacttacttacgaacgttaagttacgtttacgtagttacgaagtacgttaccgtacgttagacgacggcaacacgtaccgccgtacgaacgacgtctaacgtacgtaggtacggtagttaggacgtacgtacgtaacgtacgtacgaagtacgacgttccgtagttacgttacttgttacgcggactaggacgtaagttcccgtacgtaccggtaaacggtcgggaccgggttaccgtacgttcggtaccggttacgggtaaccgggtccggtaaccgtacccgggttccgcgtccccgttacccg

SEQ ID NO: 237656 - DNA, 600 bp, Homo sapiens
  misc_feature: GYAE6OF01CAB48.42.74.G08.1.454.CMB.1.raw
  modified_base (241)..(241): a, c, t, g, unknown or other
  misc_feature (241)..(241): n is a, c, g, or t
  modified_base (301)..(301): a, c, t, g, unknown or other
  misc_feature (301)..(301): n is a, c, g, or t
  modified_base (423)..(423): a, c, t, g, unknown or other
  misc_feature (423)..(423): n is a, c, g, or t
  modified_base (437)..(437): a, c, t, g, unknown or other
  misc_feature (437)..(437): n is a, c, g, or t
  modified_base (460)..(460): a, c, t, g, unknown or other
  misc_feature (460)..(460): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtctggggctgaggtgcaggaacggcccggggcctcgagtgacgtatttcctgacaaggctttcnggatacgagtcttcagttagttatgctatacaggtgggtgcgccgacgggcccccggaanaaaggcttgaggtggcgtggggagtggagtcggtcgggtggactacctcctaaacagtaaacgtattattacacgaagtaagtttcagttcagagttctacctttagcagcacacactccgngaccgagattccanagtggtagttgagtcgactaagntctagaacgacgcggtctcgtacttagttacctggtgcgagagatacggtcctaacgaccgggtacgggtaccggggacccttacgtttcggtaacgttcggtacggggaccgtaacgggacccttgggtccctacccgg

SEQ ID NO: 237657 - DNA, 566 bp, Homo sapiens
  misc_feature: GYAE6OF01CDXUK.42.74.G08.1.454.CMB.1.raw
  modified_base (486)..(486): a, c, t, g, unknown or other
  misc_feature (486)..(486): n is a, c, g, or t
tcagtgacgtatgtcacgaccggtgctcgatttagtagctctatcaggggacccaacaaccacatccctcctcagaagcccccagagcacaactcctaaccatggactggacctggagatcctcttttggtggcagcagccacaggtggccactcccaggtccactttgtgcagtctggggctgaggtgcagaacgcccgggctcagtgacgatttcctgcaaggtcttctggatacagcttcagtagttatgctatacagtggtgcgccacggccccggacaaggcttgagtggcgtgggatggagtcggtcggtgggcacgtacctaacactaagagtattcacagtaacgtttcagttacagtagtctaactttagcagtcgacactgtccgcgtaccgacagtctacatggagttgagtggtactaagactacgtgtaacgacacggcgttagtcttacgttacgtagtgcgtagatgtacnccgttacacggtacggaggggaccctattacggtaacttacgggtacgggtaccgaacgggaccctgggtcgtaccccgg

SEQ ID NO: 237658 - DNA, 581 bp, Homo sapiens
  misc_feature: GYAE6OF01A6QAB.42.74.G08.1.454.CMB.1.raw
  modified_base (254)..(254): a, c, t, g, unknown or other
  misc_feature (254)..(254): n is a, c, g, or t
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttangctatacagtgggtgcgccacggccccgganaaaggcttgagtggcgtgggagtggagtcggtcggtggcactcctaacataagatattacacagtaagtttcagttcagtatctacctttagctagcgacacatccgcgacgacgagtactacagtaggtagttggagtcggacctaaagactcgtagaacgacgacggcttgtacttattacgtggtgcgagagtacgtcgtaccgtacgacggacgggtacggggacccttacgtttaggaacgtttaccggtcggggtacccgaacggggtacccttcgggtccgtaccccgg

SEQ ID NO: 237659 - DNA, 542 bp, Homo sapiens
  misc_feature: GYAE6OF01EQQQ9.42.74.G08.1.454.CMB.1.raw
  modified_base (286)..(286): a, c, t, g, unknown or other
  misc_feature (286)..(286): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgattttcctgcaaggcttctggatacagcttcagttagttatgctatacagtgggtgcgccaggcccccgganaaaggcttgagtgcgtgggatggatcgtcggtggcactcctaacataagatattcacagaagtttcagttcagagtcacctttagcagcgacacatccgcacgacagtctacatggagttgagtgcctaagactctagaagacacggntcgtntattactgtgcgagtagagtcgaccttacgacggtaccggaggggcccctaacgtttcgaagttacgtcgggggtaccaacggggaaccctgtcgtaccccgg

SEQ ID NO: 237660 - DNA, 559 bp, Homo sapiens
  misc_feature: GYAE6OF01CXUUB.42.74.G08.1.454.CMB.1.raw
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactccccaggtccactttgtgcagtctggggctgaggtgcagagcccggggctcagtgacgtatttccngcaaggcttctggatacagtcttcagtagttangctatacagtggtgcgccaggccccgganaaggcttgagtggctgggatggatcgtcggtggcactcctaacataagatatcacagtaatttcagttcagtagtcctactttagcagcgacacatccgcgacgacacgtactacagtaggtagtgagtggactaagtatcgtagaagaacgcggtactgttacttattactgtagcgagacgtatcgtaccttacgacggacggtacggggaccctacgttacggtagttaccgtcggggaccgacgggtaaccccgtggtaccgtaccccgg

SEQ ID NO: 237661 - DNA, 812 bp, Homo sapiens
  misc_feature: GYAE6OF01CDGI6.42.74.G08.1.454.CMB.1.raw
  modified_base (134)..(134): a, c, t, g, unknown or other
  misc_feature (134)..(134): n is a, c, g, or t
  modified_base (175)..(175): a, c, t, g, unknown or other
  misc_feature (175)..(175): n is a, c, g, or t
  modified_base (230)..(230): a, c, t, g, unknown or other
  misc_feature (230)..(230): n is a, c, g, or t
tcagtgacgtatgtcacgaccggtgctcgatttagtagctctatcagggacccaacaaccacatccctcctcagaacgcccccagagcacaactcctaaccatggactggacctggaggatccttctttttggnggcagcagccacgaggtcggccactcccaggtccactttgngcagtcgtggggctggaggtgcagaacggcccgggcctgagtgacgtatttccgngactaaggtcctttcgtaggtaataccgtaagtccttttacgaaggttaaggtttactgtacttaataacgtaggttggggtcggccggacccggaaccgggaccccccggaaagtaaacgggtcgtttacggaggttcgggacggtaggggtaaggtacgggtagttccgggttacgggttcgggacctaaccttaaccgttaaaacgtaagttaaaaggtaatttaacgtttaaccaaacgtaaggtttaaacgttttaccgtaagtttacggaaacggttaacgttaccgttaaacccgttttaggacgtaacggaaccgaacctaaccgaaccgttacccggacggaaccgaacgtacggttacctaacgtaagtacgggttaaggttaggtacgggtacggtaaccgtaagtacgttacgtaaggaacgaacgacgtcgttagttacttaacgttacgtaggttcgacggagtagtagtcgtaccgtacgaaccgggaccgggacggggtacccttacggttacgtacgttaccgggtacgggaccggtaaccgggacccgttcggtacgtaccccg

SEQ ID NO: 237662 - DNA, 565 bp, Homo sapiens
  misc_feature: GYAE6OF01AOURF.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtgacagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcggtcggtggcactcctaacataagatattcacagaagtttcagttcagagtcactttagctagcgacacatccgcgacgacagtctacatggagttgagtggacctaagatctgaagcacggctgtctagttactgtgcgagagtatgtccttacaccggaccggtacggggggacccctacgttttacggaacgtttaccggtcggggggtaccctaacgggggtaaccccgtggggtcccgtaacccccggg

SEQ ID NO: 237663 - DNA, 590 bp, Homo sapiens
  misc_feature: GYAE6OF01CQW4A.42.74.G08.1.454.CMB.1.raw
  modified_base (220)..(220): a, c, t, g, unknown or other
  misc_feature (220)..(220): n is a, c, g, or t
  modified_base (283)..(283): a, c, t, g, unknown or other
  misc_feature (283)..(283): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccgggcctcagtgacgatttccngcaaggcttctggatacagcttcagtagttatgctatacagtggtgcgccacggcccccgganaaaggcttgagtggcgtgggatggatcgtcggtggcactcctaacataagatattcacagtaagtttcagttcagtatctactttagctagcgacacactccgcgacgaacagtctacagtggtagtgagtggactaagatcgtagaacgaacctacggctgttactagtttacgtcgtagacgagagatcgtacccttacgacggtaaccgggtacgggggccccttaacgtttacggtacgtttaaccgggtccgggggtacccgtaacggggtacccccgttcgggttacccgtaacccccggg

SEQ ID NO: 237664 - DNA, 582 bp, Homo sapiens
  misc_feature: GYAE6OF01AYQ0C.42.74.G08.1.454.CMB.1.raw
  modified_base (223)..(223): a, c, t, g, unknown or other
  misc_feature (223)..(223): n is a, c, g, or t
  modified_base (292)..(292): a, c, t, g, unknown or other
  misc_feature (292)..(292): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcaggaagcccggggcctcgagtgacgatttccngcaaggtcttctggatacagtcttcagttagttatgtctatacaggtgggtgcgccacggcccccgganaaacggtcttgagtggctgggatggatcgtcggtggcactctaacataagatattcaactagtaacgtttcagttcagtacgtctacctttagcagcgacacacgtccgacgacgacagtctaacagtcggagttgaggtcggacctaagacttacgtagaacgacgtacggctcgttacttagttaacgtggtacgcggagagacgtcgtaccgtacgacggaccgggtacggggtccctacgtttggacttacggcgggtaaccacgggtaccctggtcccgtacccg

SEQ ID NO: 237665 - DNA, 555 bp, Homo sapiens
  misc_feature: GYAE6OF01DSALD.42.74.G08.1.454.CMB.1.raw
  modified_base (432)..(432): a, c, t, g, unknown or other
  misc_feature (432)..(432): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggctcagtgacgatttcctgcaaggcttctggatacagcttcagtagttatgctatacagtggtgcgccacggcccccggacaaaggccttggagtggcgtgggatggatcggtcggtggcactctaacataagatatcacagaagtttcagttcagtagtcactttagcagtcgacacatccgcgacgacagtctacagtggagttgagtggtcctaagactactagaanacgacggctagtctattactgtgacgagagtatcgaccttacgacgacggacggggtccctacgtttcgtaagtttaccggtcggggtacccaacggggtaccccgttggtccgttaccccgg

SEQ ID NO: 237666 - DNA, 641 bp, Homo sapiens
  misc_feature: GYAE6OF01BZNER.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttcgtggatacagcttcagtagttatgtctatacagtggtgcgccacggcccccggacaaacggcttgagtgggcgtgggagtggatcggtcggtggcactcctaacataagatatttcaactagaagtttcagttcagtacgtcaccttttagcacgcgtacacactccggacgaccgacgtagtctaacacgttaggaggttgacgttacggtaccgttaaagacgttacgttagaacggtaaccgacggttcgtacgttaccttagtttaaccgtggttagacggacgtagtagtccgtaacccgttaaccgaccggtaaccgggtaccggggaccccttaacgtttaggtaaccttccgggtacggggtacccgtaagggggtaacccctcgggttcccgtaacccgg

SEQ ID NO: 237667 - DNA, 588 bp, Homo sapiens
  misc_feature: GYAE6OF01DYGJH.42.74.G08.1.454.CMB.1.raw
  modified_base (297)..(297): a, c, t, g, unknown or other
  misc_feature (297)..(297): n is a, c, g, or t
  modified_base (423)..(423): a, c, t, g, unknown or other
  misc_feature (423)..(423): n is a, c, g, or t
  modified_base (448)..(448): a, c, t, g, unknown or other
  misc_feature (448)..(448): n is a, c, g, or t
  modified_base (465)..(465): a, c, t, g, unknown or other
  misc_feature (465)..(465): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtcgtggggctggaggtgcagaacgcccggggcctcgagtgacgtatttcctgacaaggtcttcgtggatacagtcttcagttagttatgctatacagtggtgccgccgacggccccggaanaacggtcttaggagtgggcgtgggagtggatcggtcggtggcactacctaacataagatattcacagtaagttcagttcagtatctactttagctacgcgacacgactccgacgacgacagtctanagtggtagtagagtaggacctaagntcgtagaagacgtacgnttcgtacttagttacgttgtacgaggacgagtactcgtaccttacgacggtaccgggacgggtaccctacgtttagcgtttacggcggggacccgtaacgggtaccctcggtacctaccccgg

SEQ ID NO: 237668 - DNA, 631 bp, Homo sapiens
  misc_feature: GYAE6OF01CJTEV.42.74.G08.1.454.CMB.1.raw
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaagcccccagagcacaactcctaaccatggactggacctggaggatccttcttttggtggcagcagccacaggtggccactcccaggtccactttgtgcagtctggggctgaggtgcagaagcccggggcctcagtgacgatttcctgcaaggcttctggatacagtcttcagcagttatgctatacaggtggtgcgcacggccccganaacggctgagtggctgggatggagtcggtcggtggcctacgtactaacgaataagatattacacaagtaagtttcagttacagtacgttactactttagctagacgacacagtccgacgacgacacgtctacagtggagttggacgtggacccgtaagacgttcgtaggaaacgacgaccggtcgttacgttaccttaagtttaccgttggtcgacggtaagagtacgtcgtaaacccgttacgaaccgggtaaccgggtacgggggtccccttaacgggttttacgacgtttaaccggtcgggggtaacccgtaaccgggggtaaaccccgtcggttaacccccgg

SEQ ID NO: 237669 - DNA, 659 bp, Homo sapiens
  misc_feature: GYAE6OF01C7I8W.42.74.G08.1.454.CMB.1.raw
  modified_base (219)..(219): a, c, t, g, unknown or other
  misc_feature (219)..(219): n is a, c, g, or t
  modified_base (253)..(253): a, c, t, g, unknown or other
  misc_feature (253)..(253): n is a, c, g, or t
  modified_base (286)..(286): a, c, t, g, unknown or other
  misc_feature (286)..(286): n is a, c, g, or t
  modified_base (330)..(330): a, c, t, g, unknown or other
  misc_feature (330)..(330): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagacgcccgggctcagtgacgatttccngacaaggcttctggatacagtcttcagtagttangctatacaggtggtgccgccgacggccccgaanaaggcttgagtggctgggatggatcggtcggtggcactcctaanataagatatcacaagtaacgtttcagttcagtacgtacctaactttgacacgccgtaacacctacgtacccgacgacgaacctaggtacctaagagttggtaggttcgagttcggtacctaaagcttacgtaggaacgacctacgggtcttacgggttactttaacgtttaactggtacgtacggagtaagtacgtcgtaacccgttaccgaaccgggtaaccgggtacccggggggtaccccttaacggtttacggtaaacgtttaccgggtaccgggggtaccccggaaccggggtaaccccgttcgggtaccccgttaaccccggg

SEQ ID NO: 237670 - DNA, 737 bp, Homo sapiens
  misc_feature: GYAE6OF01A3TRJ.42.74.G08.1.454.CMB.1.raw
  modified_base (298)..(298): a, c, t, g, unknown or other
  misc_feature (298)..(298): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctgggggctggaggtgcagaaggcccggggcctcagtgacgatttcctgcaagggtcttcgtggatacgagtcttcagtagttatgctatacaggtgggtgccgaccgacggcccccggaanaaacggcttggagtggtcgtggggtatggacgtcggtcggtcggcactcctaaacagtaaagatacgtcaactagtaaagtttcaagttcagtcgtctaacctttagacctagccgaacacgactcccggacgaaccgtacgtacgttactaccgaagttcgggtaagttagggacggttccggtaaccgtaaagtaccgttacggtaacggaacggtaaccgtacgggtaccgtttagttaccgtaacgtttaccgtaggtacccggacggtaacggacggtaacgttaccggtacccgtttaaacggaccccggggtaacggggttaaccggggggaccccctttaaggtttaccggttaacggtttacccggggtacgggggttaccccgaaacgggggttaacccccggttggggtttaccccgtaacccccggg

SEQ ID NO: 237671 - DNA, 685 bp, Homo sapiens
  misc_feature: GYAE6OF01DT2Z5.42.74.G08.1.454.CMB.1.raw
  modified_base (248)..(248): a, c, t, g, unknown or other
  misc_feature (248)..(248): n is a, c, g, or t
tcagtgacgtatgtcacgaccggtgctcgatttagtagctctatcagggacccaacaaccacatccctcctcagaacgcccccagagcacaactcctaaccatggactggacctggagatccttcttttggtggcagcagccacaggtggccactcccaggtcctactttgtgctagtcgtggggctggaggtgcagaacggcccgggcctcgagtgacgtatttcctgcaaggtcttcgtggatacngtcttgaagtagttatgcttaagtacgtaggtggtcgccgccgaccgggacccccggaagaaaggtcttggaggtggcgtgggacgtggagtccggtcggtacggcctaacgtaccgtaaactaataaagtattaacgttccgactaaagtaagtttacacgttacaaggtacgtacctaaccgtttagacgacgtaccgactaacgtcgtacccgacgaccgtaacgtacgtacctaacgagtacggtagttgaaggttcgaacctaagtactacgagaacgacgtacgtctagttacttacgttacgtcgtagtacgagaagttcgtacgtaccgttaacggaccgggaacgggtaccggggtacccttaggttaacggtacggttaccggtacggggtaaccgtaaccgggtacccgttgggtcccgtaacccg

SEQ ID NO: 237672 - DNA, 711 bp, Homo sapiens
  misc_feature: GYAE6OF01B08E8.42.74.G08.1.454.CMB.1.raw
  modified_base (225)..(225): a, c, t, g, unknown or other
  misc_feature (225)..(225): n is a, c, g, or t
  modified_base (594)..(594): a, c, t, g, unknown or other
  misc_feature (594)..(594): n is a, c, g, or t
tcagtgacgtatgtcacgaccggtgctcgatttagtagctctatcaggggacccaacaaccacatccctcctcagaacgcccccagagcacaactcctaaccatggactggacctggaggatccttctttttggtggcagcagccacaggtgccactcccaggtccactttgtgcagtctggggctggaggtgcagaaggcccgggcctcagtgacgtatttccngcaaggcttcgtggatacagtccttagagttagttatgctataacgtggtcgggtgccgccgaccgggacccccggaagaaacggtctaggagtcgggtctgggatggtatcggtcggtcggctaccgtacctaaacataagtactactttacaacgtagttaaacgtttcaacgttacgtagtaagttacccgtaacctttacgaccgaacgaccgtaacaaccgtacgtcccggaccgaacgaccgtacgttactactaggtagggtaagtttggaaggtccggtaaccgttaaaggtattcgaaggaaacgtaccgtacggtccgttaggttacttactttacggtcggtagaaccgtagacggtntaccggtaccttaaaccggaccggtaaccggggtaacggggtccccttaaagttccggtaacgttttacccgggcgggggtaacccgaacggggtacccctggtccccgtaacccgg

SEQ ID NO: 237673 - DNA, 612 bp, Homo sapiens
  misc_feature: GYAE6OF01BKNVC.42.74.G08.1.454.CMB.1.raw
  modified_base (220)..(220): a, c, t, g, unknown or other
  misc_feature (220)..(220): n is a, c, g, or t
  modified_base (282)..(282): a, c, t, g, unknown or other
  misc_feature (282)..(282): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggctcagtgacgatttccngcaaggcttctggataccagcttcagtagttatgctatacagtggtgcgccacggccccganaaggcttgagtggcgtgggatggagtcggtcggtggcactacctaacataagatattacacagtaagtttcagttcagagtcacgtttagctagtcgactacactccgacgacgacagtactagatggagttgagtggacctaagatacgtagaacgacgtacggcttagttacttagttacgtagtcgtacggaacgtagtacgtacgtacccttaacggacccggaacgggtacccgggggccccttaacggtttacggtaacgtttaaccggttacgggggaccctaaaccgggggtaacccccttgggttaccccgtaaccccggg

SEQ ID NO: 237674 - DNA, 522 bp, Homo sapiens
  misc_feature: GYAE6OF01BPPHR.42.74.G08.1.454.CMB.1.raw
  modified_base (218)..(218): a, c, t, g, unknown or other
  misc_feature (218)..(218): n is a, c, g, or t
  modified_base (282)..(282): a, c, t, g, unknown or other
  misc_feature (282)..(282): n is a, c, g, or t
  modified_base (418)..(418): a, c, t, g, unknown or other
  misc_feature (418)..(418): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagagcccgggctcagtgacgatttccngcaaggcttctggatacagtcttcagtagttatgctatacagtgggtgcgccaggcccccgganaaacggcttgagtggctgggatggatcggtcggtggcactcctaacataagatattcacagtaagtttcagttcagagtctacctttagcagcgacacatccgcgacgacagtctacatggattgagtgactaagntctgaacgacgacgctgtactattactgtgcgagagatcgtccttacgacggacggacggggccctagttgattacgcgggacagggaccctggtccgtacccg

SEQ ID NO: 237675 - DNA, 1104 bp, Homo sapiens
  misc_feature: GYAE6OF01AMSDU.42.74.G08.1.454.CMB.1.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtcggccactcccaggtccacttttgtgcagtcgtggggctgaggtgcaggacggcccgggctcgagtgacgtatttccngcaggtcttgnggatacgagtcttagagttagttagtgacttagtacgaggttgggtcgccggtacccgaaccggggaccccccgggaaacgtaaaacgggtccgttagggtaacggtcggggtaccggttaggggtacgtacgggtaacggtttccgggttaccgggggttccgggtaacccgttaacccgtttaaccccgtaaaacgtaaagtttaaaacggtaacttttaaactttaacccgaaaacggttaaacggtttaaacgggtttttacccgtaaacggttttaccgaaacgggttaacccgttttaacccggtttaaacccccgttttttaacgggaaccccgttaaaccggggtaaacccgtaaacccgtaaacccgttaacccgggttacccccgggtaacccgggtaaacccggtaaaccggtaacggttttaaacccccgtaaacggtttaaacgggtttacgggtaaaccgggtttttaaagggtaccggggttaacccggggttaaccccgtttaaaagggtaaccgttttaaccgggaaacgggttaaaacccggtaacccggtaaccggggtttccctttaacgggtttaccgtttttaaaccgttttaccggtttaacgggtaacgggttaaccgggtaaggtaaaccgggttaaccggtttcccggtttaaacccccggttaaaccgggtaaacccggggaacccggggggttaccccggggttaaccccccgtttaggtttttaaaccgggttaccgttttaaccccgggggggaaccgggggtttaacccccgggtaaacccccgggggtttaaaccccggttacccggggttcccccggtttaaaccccccggg

SEQ ID NO: 237676 - DNA, 558 bp, Homo sapiens
  misc_feature: GYAE6OF01C8RDM.42.74.G08.1.454.CMB.1.raw
  modified_base (222)..(222): a, c, t, g, unknown or other
  misc_feature (222)..(222): n is a, c, g, or t
  modified_base (286)..(286): a, c, t, g, unknown or other
  misc_feature (286)..(286): n is a, c, g, or t
  modified_base (328)..(328): a, c, t, g, unknown or other
  misc_feature (328)..(328): n is a, c, g, or t
  modified_base (405)..(405): a, c, t, g, unknown or other
  misc_feature (405)..(405): n is a, c, g, or t
  modified_base (428)..(428): a, c, t, g, unknown or other
  misc_feature (428)..(428): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
tcagtgacgtatgtcacgaccggtgctcgatttagtagctctatcaggggacccaacaaccacatccctcctcagaagcccccagagcacaactcctaaccatggactggacctggaggatccttcttttggtggcagcagccacaggtggccactcccaggtccactttgtgcagtctggggctgaggtgcagaagcccggggcctcagtgacgatttccngcaaggcttctggatacagtcttcagtagttatgcttatacagtgggtgcgccaggccccgganaaaggcttgagtggctgggatggatcgtcggtgcactccaanataagatatcactagtaagtttcagttcagtagtctactttagcaagtcgacacactccgacgacgaacagtactanatggtagtgagtggaccttaagntcgtagaacgactacggcttgtactagttcgtgtgacganagtntcgaccttacgacgaccgggtacggggaccctaagttcgaacgtttacggacggggcccgaacgggtaccctggtcccgtacccgg

SEQ ID NO: 237677 - DNA, 820 bp, Homo sapiens
  misc_feature: GYAE6OF01A3S31.42.74.G08.1.454.CMB.1.raw
  modified_base (133)..(133): a, c, t, g, unknown or other
  misc_feature (133)..(133): n is a, c, g, or t
  modified_base (226)..(226): a, c, t, g, unknown or other
  misc_feature (226)..(226): n is a, c, g, or t
tcagtgacgtatgtcacgaccggtgctcgatttagtagctctatcaggggacccaacaaccacatccctcctcagaacgcccccagagcacaactcctaaccatggactggacctggagatccttcttttggnggcagcagccacaggtgccactcccaggtccactttgtgcagtcgtggggctggaggtgcgagacggcccgggctcgagtgacgtattttccngacgtaaggtctttcgtgggaactaccgagtcctttacgaagttagtttatcgtacttaagttaacgagggttcggggttcgccggaccccgaaccggggacccccccggaaaggtaaacgggtccgttaggtaacggtcgggccggttaggggtaggtcgggtaacgttccggggttcgggtcgggtaccgtaccgttaacccgttaaaacgtaacgtaaacgtattaaccgttacgaaccgtaaggttaaacgtttctaacggtttcgaaacggttacgttacccgttaaccttttaggacctaacggtaccgaaccaccgtacgttacccggaccggtaaccgtaccgtacgttaccgtaacgtaggtacgggtacgttacgggaggttaccggtaaccgttaagtactacggttaagaacggtaccgtaacggtcttacgtactttagttacgtagttcggacgtaggacgtcgtacgttaccgtaccggaaccggacggggttaccgggcccttagtttacggtacgtttaccgggtaccggggtacccggtaaccgggttacccgttaggggtccccttaaccccggg

SEQ ID NO: 237678 - DNA, 572 bp, Homo sapiens
  misc_feature: GYAE6OF01CDTYT.42.74.G08.1.454.CMB.1.raw
  modified_base (283)..(283): a, c, t, g, unknown or other
  misc_feature (283)..(283): n is a, c, g, or t
tcagtgacgtatgtcacgaccggtgctcgatttagtagctctatcaggggacccaacaaccacatcccctcctcagaagcccccagagcacaactcctaaccatggactggacctggagatcctcttttggtggcagcagccacaggtggccactcccaggtccactttgtgcagtctggggctgaggtgcagaagcccggggcctcgagtgacgatttcctgcaaggcttctggatacagcttcagtagttatgctatacagtggtgcgccaggcccccganaaaggcttgagtggcgtgggatggatcggtcggtggcactcctaacataagatattcacagtaagtttcagttacagtagtctaacctttagacaggcgacacactccgacgacgacacgtctaacagtaggagttgagtggtacctaagtactcgtagaacgacgacggtcttagtctagttactgtgacgagagagtgaccttaacgacggaccggtacgggggacccttagtttacgtacgttacggtcggggacctaacggggacccctgggtcccgtaccccgg

SEQ ID NO: 237679 - DNA, 588 bp, Homo sapiens
  misc_feature: GYAE6OF01DBEE3.42.74.G08.1.454.CMB.1.raw
  modified_base (224)..(224): a, c, t, g, unknown or other
  misc_feature (224)..(224): n is a, c, g, or t
  modified_base (286)..(286): a, c, t, g, unknown or other
  misc_feature (286)..(286): n is a, c, g, or t
tcagtgacgtatgtcacgaccggtgctcgatttagtagctctatcaggggacccaacaaccacatccctcctcagaacgcccccagagcacaactcctaaaccatggactggacctggagatccttcttttggtggcagcagccacaggtggccactcccaggtccactttgtgcagtctggggctgaggtgcagaacgcccgggcctcagtgacgtatttccngcaaggcttctggatacagcttcagtagttatgctatacagtggtgcgccacggccccgganaaaggcttgagtggctgggatggatcggtcggtggcacgtcctaacataagatacgttcacagtaagtttcagttcagtacgtctacctttagcaagtcacacactccgacgacgacacgtactacagtggtagttgagtcggtacctaagtactacgtaggtaacgacgacggacttcgtacttagttactgtagcgagtagactcgcccgttacgaccggacggtacggggtaccccttacgtttacgtaagtttaccggtcggggacccgaacgggtaaccccgtggtcccgtacccgg

SEQ ID NO: 237680 - DNA, 542 bp, Homo sapiens
  misc_feature: GYAE6OF01B12L9.42.74.G08.1.454.CMB.1.raw
  modified_base (354)..(354): a, c, t, g, unknown or other
  misc_feature (354)..(354): n is a, c, g, or t
tcagtgacgtatgtcacgaccggtgctcgatttagtagctctatcaggggacccaacaaccacatccctcctcagaagcccccagagcacaactcctaaccatggactggacctggagatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccacggcccccggacaaggctgagtggcgtgggatggatcggtcgggtggcacgtcctaacataagatattcacagtaagtttnagttacagtatactacctttagcagcgacacactccgcgacgactagtctacatgagttgagtgacctaagatcgagaacgacacggtctgtacttattagtgtgcgagagatcgtcctacgacggacggtacggggccctacgttacgagttacggtcgggacccgagggacccgtgtccgtaccgg

SEQ ID NO: 237681 - DNA, 588 bp, Homo sapiens
  misc_feature: GYAE6OF01DUFE9.42.74.G08.1.454.CMB.1.raw
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (281)..(281): a, c, t, g, unknown or other
  misc_feature (281)..(281): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccgggcctcagtgacgatttcctgcaaggcttcnggatacagcttcagtagttangctatacaggtggtgcgccaggccccganaaagctgagtggctgggatggatcggtcggtggcactcctaaacataagatattcacagtaagttcagttacagtagtctaactttagcagcgaacacactccgacgacgactagtactacatggagttgagtgacctaagactctagaacgacgacggtcttgtacttaagttaccgtggttcgacgaggagtaacgttcgacccttaacgacggaacgggtaccgggggacccttaacgtttacggagtttaaccggtcgggggtaacccgaacggggtaaccccgttgggtccctaaccccggg

SEQ ID NO: 237682 - DNA, 644 bp, Homo sapiens
  misc_feature: GYAE6OF01D3NCM.42.74.G08.1.454.CMB.1.raw
  modified_base (134)..(134): a, c, t, g, unknown or other
  misc_feature (134)..(134): n is a, c, g, or t
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggnggcagcagccacaggtcggccactcccaggtccactttgtgcagttcgtggggctggaggtgcgagaacggcccgggctcgagtgaccgtatttccngacgaaggtcttcgtggatacgagtcttcagttagttatgcttatacaggtgggtcgcgccgaggcccccggaanaaaggtcttgaggtggcgtgggatggatcggtcggtggcacgtaccaacataacgattatacactagtaatttcagtacagtagtctaactttgctacgcgacacacgtccgaccgaacgacagtcctagacgttggagttggagtgggaccctaagtacgtcgtaaggaacgaccgacggtcttaggtcttaagtttacgttggacggtacgaggagtaccgttagcccttaaacggaccgggaacgggtacccggggtaccccttaggtttacgacggtttaaccgggcgggggtaaccctaacggggtaccccgttacgggtcccgtaaccccgg

SEQ ID NO: 237683 - DNA, 863 bp, Homo sapiens
  misc_feature: GYAE6OF01DYU4W.42.74.G08.1.454.CMB.1.raw
  modified_base (182)..(182): a, c, t, g, unknown or other
  misc_feature (182)..(182): n is a, c, g, or t
tcagtgacgtatgtcacgaccggtgctcgatttagtagctctatcaggggacccaacaaccacatccctcctcagaacgccccagagcacaactcctaaccatggactggacctggaggattccttctttttggtggcagcagccacgaggtcggccacctcccgacggtccctacgtttgngcacgtcgtggggctggaggtgacgaaggaaccgggccccgggcctcgaggtacggacgttactttccgtagaccgtaacggttcctttacggtaggtaactaaccgacgttccgttacgaaggtttagtttaagtcgtacttaacgtaacgtagggttcgggtcgacccggaccggacccggggaccccggaagaaacgggtcgttaggacgggtcgggcggtacgggagttacggggtacggttccgggtcgggtaccggaccgttaaccgttaacccgttaaaacgtaacgttaaacgttaacgttaactaaccgtaaacgttaaacggtttacgttttaccgtaaacgtttacggaagggttaaccttacgtttaaccggttacgacgtaacgaccgtaaacaccgtaccgtacccggaacgtaccgaacgttacgtacctaacggtagtacgggttagtccggtaagggtaccgtaacgttaagacgtagtaacgaacgacgtacgttagtttacgtacttacggttacgtgacgagtacggtaactgttaacccgtaccggtaacggtccggggaacgggttaccgggtaccctttcgggttaacggtcgggtttaacccggggaccccggggttaacgaaaccccggggtttccgtaccgtccccggttacccg

SEQ ID NO: 237684 - DNA, 744 bp, Homo sapiens
  misc_feature: GYAE6OF01BW0UU.42.74.G08.1.454.CMB.1.raw
  modified_base (134)..(134): a, c, t, g, unknown or other
  misc_feature (134)..(134): n is a, c, g, or t
  modified_base (232)..(232): a, c, t, g, unknown or other
  misc_feature (232)..(232): n is a, c, g, or t
  modified_base (274)..(274): a, c, t, g, unknown or other
  misc_feature (274)..(274): n is a, c, g, or t
tcagtgacgtatgtcacgaccggtgctcgatttagtagctctatcaggggacccaacaaccacatccctcctcagaacgcccccagagcacaactcctaaccatggactggacctggagatccttcgttttggnggcagcagccacaggtcggccactcccaggtccacttgtgcagtcgtggggctgaggtgcgaaggacggcccggggtcctcgagtggactactttccngcaaggtcttcgtggactacgagtccttcgaagttacgttangtaccttaatacgtaggtgggtcgcggaccgaccgggacccccggtaagaaacggtccttacgggaacgttggggtccgaggggtacgtgggtaacgtccggttacgggtacggcctaacccgtttaccaaacgtaggtaaatacctagtttacccaaacgtagttaaacggttttacaacgtttaccgaggtacgtacctaaccgtttagcctaggaccacaacgtcgaccgactaacggactagtccctaagtagtgggtagtttagaagggttctaaccggtatagaccgtagaacggacctagggtcttacggttacttaccgttacgtcgtaggttaccggtaagaaggtcgttacgtaccgttaacgaccggtacgggtaaccgggtcccttagggttaccttacgggtacccgggttacgggacccggtaaccgggttaacccgttccggccgttaaccccgg

SEQ ID NO: 237685 - DNA, 824 bp, Homo sapiens
  misc_feature: GYAE6OF01DCDZA.42.74.G08.1.454.CMB.1.raw
  modified_base (126)..(126): a, c, t, g, unknown or other
  misc_feature (126)..(126): n is a, c, g, or t
  modified_base (134)..(134): a, c, t, g, unknown or other
  misc_feature (134)..(134): n is a, c, g, or t
  modified_base (172)..(172): a, c, t, g, unknown or other
  misc_feature (172)..(172): n is a, c, g, or t
  modified_base (270)..(270): a, c, t, g, unknown or other
  misc_feature (270)..(270): n is a, c, g, or t
  modified_base (424)..(424): a, c, t, g, unknown or other
  misc_feature (424)..(424): n is a, c, g, or t
tcagtgacgtatgtcacgaccggtgctcgatttagtagctctatcaggggacccaacaaccacatccctcctcagaacgcccccagagcacaactcctaaccatggactggacctggagatccttntttttggnggcagcagccacaggtgccactcccaggtccactttgngcagtcgtggggctgaggtgcagacggccccgggctcgagtgacgtactttccgagacgaggtcttcgtaggactacgagtcttacgaagttagttancgtctatacgtaggtgggtgccgaccgaccggacccccggaagtaaacggcgttaggaggtcgggacgttagggagtggacgtcggtcgggtcggacctactaccgtaaacgtaagtaagaactattcaacgtaagtaacgtttactacgttanaacggtacgtacctaaccgtttacgacgaacggaccgtaaacgacgtaccgtacccggacgtaaccggacgtaaccgttacgttaaccgaagtttagggtaaacggtttacggaacgggttagggtaaacccgtaaaggttacgttaccgggtaaacgggttaaagacccgggtaacgggttacttaacggtttacccgtttaaacgtttaacggttacggttacgggaaccggtaggtaacggtagtccggtaaccccgtttaaacggaccgggggttaacccggggaaccggggttaaccccctttcgggtttaaacgggtacccgtttaacgggggtacccggggaacccgggttaaacccgggtaccccggttacgggtaccccgttacccccggg

SEQ ID NO: 237686 - DNA, 756 bp, Homo sapiens
  misc_feature: GYAE6OF01BKDNK.42.74.G08.1.454.CMB.1.raw
  modified_base (248)..(248): a, c, t, g, unknown or other
  misc_feature (248)..(248): n is a, c, g, or t
tcagtgacgtatgtcacgaccggtgctcgatttagtagctctatcaggggacccaacaaccacatccctcctcagaacgcccccagagcacaactcctaaccatggactggacctggaggatccttcttttggtggcagcacgccacgaggtcggccactcccaggtcctactttgtgcagtcgtggggctggaggtgcaggaacggcccgggctcgagtcgacgtattcctgacgtaaggtcttcgnggtactaccgtagtcctttacgaggttattagtcgtactaacgtacgtagggtgggtcgccggcccgaccggggacccccggaagtaacgggtcgtaggacgggtggcgtaggggtactagggtcgttccggtacgggttcgaccgtaaccgttacctaaacgtaagttaaagtacttaacgttaccgaagtaacggttaacgtttacgtacgttacgaagtacggtaccttaaccgtttaggaccgtaacgacgaacctaccgaacgtcccgaacggtaaccacgtacgtactaacgaggtacgtaggttacggacggttacggaacctagtacttcggaacgaagtaccggtacgtcgttacgttccgttaattcggttacggaccgttaggagtaccgtaacgttccgaccgttaaccgaacgggtaccgggtacccgggtaccttacggttacggtaacgttaccggaccggggtaccgtagggtacccgtggtccttacccgg

SEQ ID NO: 237687 - DNA, 717 bp, Homo sapiens
  misc_feature: GYAE6OF01BR4BG.42.74.G08.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttgggtggcagcagccacaggtggccactcccaggtccactttgtgcagtcgtggggctgaggtgcagacggcccgggcctcgagtcgacgtatttccngcaaggtcttcgnggatacagtcttacgagttacgttatgactatacgaggtgggtgccggccgaccgggccccggtaagaaacggtcgttaggagtgggcgtagggtagtgggtacgtccgggtcggtacggtcctaaccgtacctaaacgtaagttaaacgacttaacgtttacaaacgtaagttaaacgtttcgtaacggtttagaacggtacgttacctaaccgtttacgacgtaacggtaccgaacctaacgtaccgtacccggaacggaccgtaacgtacgtacttaacgagttcgggtaagttggtacgtaggaccttaagatcgaagaacggactacggtctcggttactacgttacgtaggtcgacggagtaacgtagtcgtaccgttaacggaccgggacgggtaccggggcccttaggttacgtaacggttacccgggtacgggacccggtaacggaacccgtcgggtcctaacccgg

SEQ ID NO: 237688 - DNA, 579 bp, Homo sapiens
  misc_feature: GYAE6OF01EOXSN.42.74.G08.1.454.CMB.1.raw
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (281)..(281): a, c, t, g, unknown or other
  misc_feature (281)..(281): n is a, c, g, or t
  modified_base (323)..(323): a, c, t, g, unknown or other
  misc_feature (323)..(323): n is a, c, g, or t
  modified_base (378)..(378): a, c, t, g, unknown or other
  misc_feature (378)..(378): n is a, c, g, or t
  modified_base (425)..(425): a, c, t, g, unknown or other
  misc_feature (425)..(425): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggctcagtgacgatttccngcaaggcttctggatacagcttcagtagttangctatacagtgggtgcgcaggccccganaaaggcttgagtggctgggatggatcgtggtgcactcctaanataagatattcaacagtaaattcagttcaagagtacacctttaagctagcgacanactcgcacgacagtactacatggacgttagagtggacctaaagactntacgaagacgacggacgttgtcttaacgttaacctgttaggacaggacagtcgtaccttacgtacggacggtacgggggcccttaacgtttacggtaagtttaccggttacggggaccccggaacgggtaacccggttcggccgttaaccccgg

SEQ ID NO: 237689 - DNA, 838 bp, Homo sapiens
  misc_feature: GYAE6OF01AD1PW.42.74.G08.1.454.CMB.1.raw
tcagtgacgtatgtcacgaccggtgctcgatttagtagctctatcagggacccaacaaccacatccctcctcagaacgcccccagagcacaactcctaaccatggactggacctggagatccttcttttggtggcagcagccacaggtgccactcccaggtccactttgtgcagtcgtggggctgaggtgacaggacggcccgggcctcgagtcgacgtactttcctgacgtaaggtcttcgtaggaactacgacgtcttactaaggttagttacgtcgtacttaagtaccggtagggtcggggtccgccggaccccggtacccggggaccccccggaaacgtaaacgggtccgttggacgggttcgggtacggttagggaagttcggggtacgttccggggtcgggtcggtaccctaacccgttacccgtaaaacgtaagttaaacgtaacttaccgttaaccaaccggttaaacgtttaaacggtttaccgtaacggtttacgaacggttaaccgttaccttaacccggtttaacgaccgtaacggacccgaactaacccgtacgtcccggaaccgaaccgtacgtacgtaccgtaacgtaggttagggtacgtagggtacggtacggtaaccgtaagtacgtacgtaacggacggtaccgacggtcttacgtaactttacggtacgtgggtacgaagacgtagtaccgtaccgtacccgttaacgggaacccgggtaacggggtacccgggttacccttacgggtttacgtacccgggttaccggggtaccgggaacccggtaccgggtaacccggttcggtaccccgtacccgg

SEQ ID NO: 237690 - DNA, 867 bp, Homo sapiens
  misc_feature: GYAE6OF01CMMUE.42.74.G08.1.454.CMB.1.raw
  modified_base (132)..(132): a, c, t, g, unknown or other
  misc_feature (132)..(132): n is a, c, g, or t
  modified_base (710)..(710): a, c, t, g, unknown or other
  misc_feature (710)..(710): n is a, c, g, or t
tcagtgacgtatgtcacgaccggtgctcgatttagtagctctatcgaggggacccaacaaccacatccctcctcagaacgccccagagcacaactcctaaccatggactggacctggagatcctcttttggnggcagcagccacaggtgccactcccgaggtccactttgtgcagtcgtcggggctgaggtcgcaggacggcccgggctcgagtcgacgtactttcctgacaaggtcttacgtggtaatacgaggtcttacgaggttacgttacgtcgacgtatacgtaggtgggtcgaccgtccgaccggcccccggaagaaacggtcgttacgacggtcgggcgtagggtactcgggacgtccgggtcgggtcgtacctaccttaccgtaaacacgtaaagaacttaacgttaccgaaacgtaacggttaacgtttcgtaacgtttaccgaacgtaacgttacccttaaccgttttaacgaccggtaacggtacccgaaaccgtaaccgtaccggtaccccggtaccggaaccggtaaccgtacggttacccttaaaaccgttgggttacggttaaacggggtttacggaacggggtttacccgggaaaccgtttaaagggacccgtttaaccggttaacgggtaaacccggtaacccggtcgggtttaccggttacggttaaccgtttaacggtttacgtttacggngtaacccggtagaaccggttcgaaccggttccccgtaaacggacccgggtaccgggggtaaccgggttcccgtttaccgtttacggtaacggtttacccgggtcccgggggtaaaccctaaccggggtacccgttacccgggtccgttacccccggg

SEQ ID NO: 237691 - DNA, 636 bp, Homo sapiens
  misc_feature: GYAE6OF01DYAAM.42.74.G08.1.454.CMB.1.raw
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
tcagtgacgtatgtcacgaccggtgctcgatttagtagctctatcagggacccaacaaccacatccctcctcagaagcccccagagcacaactcctaaccatggactggacctggaggatcctctttttggtggcagcagccacaggtggcccactcccaggtccactttgtgcagtctggggctgaggtgcagaagcccggggctcagtgacgatttccctgcaaggcttctggattacagcttcagttagttactgctatacgagtgggtgacgccaggacccccgganaaaggcttgagtggcgtgggatggatcggtcggtggctacgtcctaaacngtaaagatagttacactagtaaacgtttcagtttacagtactctaacctttagcagtacgacacactccgacgacgacagtctacagtaggagttgagtggacctaagactcgtagaagaccgaggactacggtacttaacgttacgtcggtacgtacggacggtacgtacgtacggtacccttaacggtaaccgggaacccgggtacgggggtacccccttaggtttaccgtacgtttaaacccggtggggtaaccccgacggggtaaaccccgtgggtacccctaaccccggg

SEQ ID NO: 237692 - DNA, 610 bp, Homo sapiens
  misc_feature: GYAE6OF01EG3DH.42.74.G08.1.454.CMB.1.raw
  modified_base (305)..(305): a, c, t, g, unknown or other
  misc_feature (305)..(305): n is a, c, g, or t
  modified_base (436)..(436): a, c, t, g, unknown or other
  misc_feature (436)..(436): n is a, c, g, or t
tcagtgacgtatgtcacgaccggtgctcgatttagtagctctatcaggggacccaacaaccacatccctcctcagaagcccccagagcacaactcctaaccatggactggacctggagatcctctttttggtggcagcagccacaggtggccactcccaggtccactttgtgcagtctggggctggaggtgcagaacggcccggggcctcgagtgacgtatttcctgcaaggtcttcgtggatacgagtcttcgaagttagttatgtactatacgaggtgggtcgccgccgacggcccccggaanaaacggcttgagtggcgtgggagtggagtcggtcggtggcactactaacataagatattcaactagtaagtttcagttcagtagtactactttagctacgcgacactactccgacgacgaacacgtactanagtaggtagttgagtggacctaagactactagaacgacgacggtctgtacttagttactgtcgacgagagatcgtaccttacgacggtacgggtacggggtacccttacgttaggtacgttacccgggtcggggaacccggtaacgggtaaccccggtggtacccgtaccccgg

SEQ ID NO: 237693 - DNA, 814 bp, Homo sapiens
  misc_feature: GYAE6OF01A97MR.42.74.G08.1.454.CMB.1.raw
tcagtgacgtatgtcacgaccggtgctcgatttagtagctctatcaggggacccaacaaccacatccctcctcagaacgcccccagagcacaactcctaaccatggactggacctggagatccttcttttggtggcagcagccacaggtggccactcccaggtccactttgtgctagtcgtggggctggaggtgcgaggaacggcccgggggcctcgaggtcgacgtatttcctgcaaggtcttctggaatacagtcttacgtagtagttagtgaccttagtaacgtagggtggggtcgccggccgaaccggggcccccggtaaagaaacggtccttagggacggtgggcggtggggtagtcggtacgttcgggtcgggtcggacctaaccgttacctaaaacgtaagttaaagtacgttaacttacgaacgtaagttaaacggtttctaacggtttcgaacggtacgttaccttaaccccgttttaagaccgtaggacccaacctaaccgtacgtaccccggaccggtaacccggtaaccgtaacggttaaccgtaacgtacggttacggggtaaaggtttaccgggtaaggttaccgggttaaaccgtaaaggtacttaacgtacggaaacggtaccgggtaacggtccgttaacgttacgtttaacgtttaacgttcgggttacggaccggtacgtaacggtacgtcgttacccgttaaacgacccgggtaacgggtaccgggtacccctaggttaccgtagttaccgggtacggaccggtaaccgggtacccggtggtcccggtaacccg

SEQ ID NO: 237694 - DNA, 746 bp, Homo sapiens
  misc_feature: GYAE6OF01ET009.42.74.G08.1.454.CMB.1.raw
  modified_base (134)..(134): a, c, t, g, unknown or other
  misc_feature (134)..(134): n is a, c, g, or t
  modified_base (176)..(176): a, c, t, g, unknown or other
  misc_feature (176)..(176): n is a, c, g, or t
  modified_base (243)..(243): a, c, t, g, unknown or other
  misc_feature (243)..(243): n is a, c, g, or t
  modified_base (268)..(268): a, c, t, g, unknown or other
  misc_feature (268)..(268): n is a, c, g, or t
  modified_base (287)..(287): a, c, t, g, unknown or other
  misc_feature (287)..(287): n is a, c, g, or t
tcagtgacgtatgtcacgaccggtgctcgatttagtagctctatcagggacccaacaaccacatccctcctcagaacgcccccagagcacaactcctaaccatggactggacctggagactccttctttttggnggcagcagccacgaggtcgccactcccgaggtccacttttgngcagttcgtggggctggaggtgcgaggaaccggccccgggtcctacgaggtcgacgtacttttccgngacgaaggtcttcgtaggactacgngtctttagaagttagttangtactaataacgtggtggtgccgaccgaccggaccccgaagaaacggtcgttaggtaggtggcggtaggagtcggacgttcgggtcggtcgacctacgtacctaaagtactaaagattacttagacgtaagtactttacgacgttagacgtaagttccttaacgtttagacgtacgacgaaccactaccgtcggaccgaacgtacgtcgtaacgtacgtagtagggtagtttagacgtacgtaacgtaacgtagttcgtaacggaactaccgaacgttcgtacgttacgttaagttaccgcgttagaacgaggaacttacgtaccgttaaacctaccgggaaaccgggtaacgggggtaccgttaaccccgttacggttttacggtaaaccgtttacccgggggtccgggaacccggtaaaaccggggttcccccgttcgggaacccgtttacccccgg

SEQ ID NO: 237695 - DNA, 822 bp, Homo sapiens
  misc_feature: GYAE6OF01ALPTX.42.74.G08.1.454.CMB.1.raw
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
  modified_base (273)..(273): a, c, t, g, unknown or other
  misc_feature (273)..(273): n is a, c, g, or t
  modified_base (485)..(485): a, c, t, g, unknown or other
  misc_feature (485)..(485): n is a, c, g, or t
tcagtgacgtatgtcacgaccggtgctcgatttagtagctctatcaggggacccaacaaccacactccctcctcagaacgccccagagcacaactcctaaccatggactggacctggaggatccttcgtttttggtggcagcagccacaggtcggccactcccgaggtccactttgtgcagtcgtggggctggaggtgcgaggacggcccggggctcgagtgacgtatttccngacgaggtcttcgtaggatacngtccttgacgttagttangtcttagtaacgtaggttgggtccgtaccggtccgaccggggacccccggtaagaaacggggtccttaggtacgggtcggtacggtgggtacgtgggtacgttcgggtcggtggaccctacctaccgtaacagttaacggtaacttacggtacctaggtaacgtttaggttacctaggtttacgagttaccggttacgttaaccggtttaanccgtaaggtaccccggatacggttaaccgtccgaccggtaacgacgtaacgtcctaacgtacggtacggtagggtttaacgagggttacgtacggtaaacggtcgttaaccggtagggtaaacgtacccgggagttaccgttacggtacgtttaacggttccgttaggtccggacgtaagggtacgtacggtccgttaaccccgtacggttaacccgggacggggttaccccgggttacccgttaacggtttaccggttaaggttaccccggggttacgggggtaaccccggtaaccggggttaaacccccggttgggttaaaccccggtaccccgg

SEQ ID NO: 237696 - DNA, 621 bp, Homo sapiens
  misc_feature: GYAE6OF01CQK4A.42.74.G08.1.454.CMB.1.raw
  modified_base (174)..(174): a, c, t, g, unknown or other
  misc_feature (174)..(174): n is a, c, g, or t
  modified_base (295)..(295): a, c, t, g, unknown or other
  misc_feature (295)..(295): n is a, c, g, or t
  modified_base (429)..(429): a, c, t, g, unknown or other
  misc_feature (429)..(429): n is a, c, g, or t
  modified_base (494)..(494): a, c, t, g, unknown or other
  misc_feature (494)..(494): n is a, c, g, or t
tcagtgacgtatgtcacgaccggtgctcgatttagtagctctatcaggggacccaacaaccacatccctcctcagaacgcccccagagcacaactcctaaccatggactggacctggaggatccttctttttggtggcagcagccacaggtggccactcccaggtccactttgngcagtctggggctgaggtgcaggaacgcccggggcctcagtgacgtatttcctgcaaggcttctggatacagtcttcagttagttatgctatacaggtgggtgcgccgacggccccggaanaaacggcttagagtggcgtgggatggatcggtcggtggctacgtcctaacataacgatattacactagtaagtttcagttcagtacgtctaaccttagcagccgaacacaacgtccgacgacgacagtacctanagtggtagttcgaggtacgtacgtaagctcgtagaacgacgtacggtctagttacttagttacgnggtagtacgagaagtcgtacgtaccttaacgaccgggtacgggaccggggtaccctaacggtttacgtaacgtttccgggtaccgggtaccgaaccggggtaaccccgtgggtacccgtaaccccgg

SEQ ID NO: 237697 - DNA, 664 bp, Homo sapiens
  misc_feature: GYAE6OF01DVJW9.42.74.G08.1.454.CMB.1.raw
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
tcagtgacgtatgtcacgaccggtgctcgatttagtagctctatcaggggacccaacaaccacatccctcctcagaagcccccagagcacaacctcctaaccatggactggacctggagatcctctttttggtggcagcagccacaggtggccactcccaggtccactttgtgcagtctgggctgagtgcagagcccgggctcgagtgacgtatttccngcaaggtccttcgtaggtataccgngtcttcgagttgtactgtctagtacgtaggtagggtcgcgtccgaccggccccggaanaacggtcgttgaggtggcgtcgggagtcggagttccggtcggtcggtacctacgtacctaaagtagtaacgtactagttaccacgtaacgtagtttacgtacgttactacgacttcctaaccgtttagactaacggtccaacactacgtaccgacgacgactacgtacgtaactgtaggtagttgtaagtcggtacgtaacgtagtctaaggaacgtaccgacgtcgttacgtacttagtaccgttgtacgtaggaacgtgtaacgtgtaacccgttagacccggtacgggaccgggtccttacgtttcggaaccgttaggtcccggggaactaaccgggtccccttgggtcccgtaacccg

SEQ ID NO: 237698 - DNA, 574 bp, Homo sapiens
  misc_feature: GYAE6OF01EM2L8.42.74.G08.1.454.CMB.1.raw
  modified_base (335)..(335): a, c, t, g, unknown or other
  misc_feature (335)..(335): n is a, c, g, or t
tcagtgacgtatgtcacgaccggtgctcgatttagtagctctatcaggggacccaacaaccacatccctcctcagaagtccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggcgtgggatggattcggtcggtggcactcctaactanaagtatattcaactagaagtttcagttcagagtcactttagctagcgacgacatccgcgacgacagtctacatggagttgagtggactaagatctgaagcacggctagtcttagttactgtgcgagagtatacgtaccttaacgacggtaccggaacgggggtacccctacggttttcgtaacgtttaccggtcgggggacccgtaaggggaacccccgtgggtacccgttaaccccgg

SEQ ID NO: 237699 - DNA, 810 bp, Homo sapiens
  misc_feature: GYAE6OF01DDKMT.42.74.G08.1.454.CMB.1.raw
tcagtgacgtatgtcacgaccggtgctcgatttagtagctctatcagggacccaacaaccacatcccctcctcagaacgcccccagagcacaacctcctaaccatggactggacctggagattccttcttttggtggcagcagccacaggtggccactcccaggtccactttgtgcagtcgtgggctgaggtgcagaacgcccgggcctcgagtgacgtatttcctgacgaaggtccttcgtggaactacgagtcctttacgaaggttagttagttcgacttaactaacgtagggtgggtcgcccgacccggaccggggacccccccggaaagaaacggtcgttaggacggtcgggcgtaggggagtgggtacgttccgggtccgggtggacctaccgttaccctaaaataataaacgtattacgttacaacgtaagttaacgtttacagtttacagtacgtccctttacgttacgacaacgtaccgtaaccgacgtacgtaccccgaccggtaaccgacgtacgtacgtaacgtgtacgggttagttacggacgtggtaacccgtaaagtcgttaccgtaacgaacgtaccgtacgttcgttaagttaccgttaactttaacgtcggtacggacgtaacggtaagtccttaccggtaaccccgttacggaaaccccggggtacggggttaaccccggggttaaccccctttaggtttaccgggtttaaacggtttacccggggtaacccggggtaacccggtacccgggttaaacccccggttccggggttaaccccgttaccccccgg

SEQ ID NO: 237700 - DNA, 732 bp, Homo sapiens
  misc_feature: GYAE6OF01BGV17.42.74.G08.1.454.CMB.1.raw
  modified_base (133)..(133): a, c, t, g, unknown or other
  misc_feature (133)..(133): n is a, c, g, or t
  modified_base (181)..(181): a, c, t, g, unknown or other
  misc_feature (181)..(181): n is a, c, g, or t
  modified_base (227)..(227): a, c, t, g, unknown or other
  misc_feature (227)..(227): n is a, c, g, or t
tcagtgacgtatgtcacgaccggtgctcgatttagtagctctatcaggggacccaacaaccacatccctcctcagaacgccccagagcacaactcctaaccatggactggacctggaggatccttcttttggnggcagcagccacaggtggccactcccgaggtccactttgtgacagtcnggggctggagtgcagacggcccgggctcgagtgacgtattttccgngctaaggctttcgtaggactacgagtcttcgaagtttcggtatcgtctatacgtaggttgggtcgcggccgaccgggcccccggaagaaacggtcttggaggtcggcggtagggtagtggacgtcggtacggtggacctactacctaaacgataagattactacaacgagttaacgttcgtaagttcgaacggtacgtttaccaacgttttacgacgtaacggacgaaccacttacgccgaccgtaacgacgtacgtacctacgaagttacggtaggttacggaaggttccggtaacgtaagacgtttaccgaggaaacggtaccgagggtcctttacggttacgtttaacgttaaccgtgggttacggaccgtaaggacttaggtacccttacggtaaccgtaccgggaacggggtcccggggtaaccctttcggtttaacgacgtttaccgggtaccgggaccgtaaacccggggttacccgttggtccccgttaaaccccgg

SEQ ID NO: 237701 - DNA, 812 bp, Homo sapiens
  misc_feature: GYAE6OF01E5EJ2.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtcgtggggctggaggtgcaggaacggcccggggcctcgagtcgacgtatttcctgcaaggtcttcgtggatacagtcttcgagttagttatgtctatacgaggtgggtcgccgccgacgggcccccgaagtaaacggcgttagaggtcggcgtgggatgggacgttcgggtcgggtcggacctaccgttaaccctaaacgtaattaaacgtatttaactttaccgaaacgttaacgggttaaacgttttaccgaacggtttaccgaaggttaccggttacccttaacccgttttaacgaccgtaacggaccgtaaccgaacccgtaacgtccccggacccggaaccgtaaccgtacgttaccgtaacgtaacggttagggtacggtttacggacgggtttacggtaacccgttaaacgtacgttaccggaacgtaaacggtacccggtaacggttcgttacgttacgttaacggtttacgtggttacggacgtaaggaacggtacgttccggttaaccccgtaaccggaaccgggtaccggggtaccggggtacccccttaggtttacggtaaccgtttaacgggccgggggtacccgtaaaccggggtccccggttacggtcccgttaccccgg

SEQ ID NO: 237702 - DNA, 1083 bp, Homo sapiens
  misc_feature: GYAE6OF01EOBVT.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcaggcagccacgaggtggccactcccaggtccactttgtgcagtcgtggggctggaggtgcagaacggcccgggcctcgagtcgacgtatttcctgcgaaggtcctttacgtgggaactaccgagtcttcgaagttaggttatgtcttaatacgtaggtgggtgtccgccgaccggacccccggaacgaaacggtcttacggaggtcggcgtaggggagtggtagtcggtcgggtggccgtaccgtacctaaacgtaataagtattacgttacgtaactaaggttaacgtttacgttaacggttacgtaacggtacggttaccgttaaccgttttacggaccgtaacggtaccggaacctaaccggtaccgttacccgggaacccggtaacccggttaaccgtaaccggtttacccgtaaaccgttacgggttaacggggtttaagggtttaacgggttacgggttaccgggttaaacccggttaaacggtaacgtttaacggttaacgggtaaaacccgggtaaccgggttaacccgggttacggtttaacccgggtttaaaccgtttttaaaccggtttttaaaccgggttacgggtttaaccgggtaacccggggtaaacgggtaaaccgggtttaaaccgtttaaccccggggtttaaacccccggttttaaaacccccggggtaaaacccccgggggggttaaacccccgggggggggttaaacccccggggggggttaaccccccgtttttaaaacccggggtttttaaccccgggggttttaaaaaccgggtttttaaccccccgggggggttaaaccccggggggggggttaaaccccccgggggtttaaaaaacccccggggggggttttaaacccccccccggggttttaaacccgggggttttaacccccccggggttttaaaacccccccccgggg

SEQ ID NO: 237703 - DNA, 606 bp, Homo sapiens
  misc_feature: GYAE6OF01B1ZMW.42.74.G08.1.454.CMB.1.raw
  modified_base (235)..(235): a, c, t, g, unknown or other
  misc_feature (235)..(235): n is a, c, g, or t
  modified_base (289)..(289): a, c, t, g, unknown or other
  misc_feature (289)..(289): n is a, c, g, or t
  modified_base (489)..(489): a, c, t, g, unknown or other
  misc_feature (489)..(489): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctggaggtgcagaagcccggggcctcgagtgacgatttcctgcaaggcttcnggatacagtcttcagtagttatgctatacaggtggtgcgccacggcccccgganaaaggctggagtggcgtggggatgggacttcgggtacgggtggactacctacgtaacgtataagattattccaacagtaagtttacagtttcagtagtcaacctttagctacgcgtacactacgtccgacgacgacacgtactacgagtaggtaggttagagtcggacctaagtacgtactagaagaccgacgtctagtnttaattacgttgtagcgtagagtacgtgtaccttacgaccggtacggacgggggtacctcggtttagacgtttacggacgggtaccggaaccgggtacccgtcggtcccgtacccgg

SEQ ID NO: 237704 - DNA, 751 bp, Homo sapiens
  misc_feature: GYAE6OF01BH21K.42.74.G08.1.454.CMB.1.raw
  modified_base (127)..(127): a, c, t, g, unknown or other
  misc_feature (127)..(127): n is a, c, g, or t
  modified_base (134)..(134): a, c, t, g, unknown or other
  misc_feature (134)..(134): n is a, c, g, or t
  modified_base (218)..(218): a, c, t, g, unknown or other
  misc_feature (218)..(218): n is a, c, g, or t
  modified_base (563)..(563): a, c, t, g, unknown or other
  misc_feature (563)..(563): n is a, c, g, or t
tcagtgacgtatgtcacgaccggtgctcgatttagtagctctatcaggggacccaacaaccacatccctcctcacgaacgcccccagagccacaactcctaaccatggactggacctggagatcctnttttggnggcagcagccacgagggtcgccactcccgaggttccctattttgtgcagtcgtgggctgaggtgcagacggcccgggtcttagngacgtgttcctgacgaggtcttacgtggaactaccgagtcctttcagttagttactgtactacgtacgtaggttggggtcgtccgacccgaccggacccccggaagtaaccggtccgttagaacgggtcggccggtaggggtagtcggtacgtccgggtccgggtcgtaccggtaccttaccgtaacgtaagtaaacgactttaacgtacaacgtaagttaacgtttactaacgttactagtacgttacctactttagccacgtcgaactacgtacgtaccgacgtaaccgacgtactacctagtaagtggttaacgtaggtacggtagtaacctaaggaccgtntaacggaacgtccgtacgtcttagttactacgttaccgtggttacggacgtagtaccgtagttccggcccgttaaacgtccgggtaacgggacccggtttaacccgtagtttaagggtacccgtaaacccgggttcgggaacccggttaacccggggaccctttacccggttcgtccccggttacccg

SEQ ID NO: 237705 - DNA, 628 bp, Homo sapiens
  misc_feature: GYAE6OF01BMF5U.42.74.G08.1.454.CMB.1.raw
  modified_base (224)..(224): a, c, t, g, unknown or other
  misc_feature (224)..(224): n is a, c, g, or t
tcagtgacgtatgtcacgaccggtgctcgatttagtagctctatcaggggacccaacaaccacatccctcctcagaacgcccccagagcacaactcctaaccatggactggacctggaggatcctcttttggtggcagcagccacaggtggccactcccaggtccactttgtgcagtctggggctggaggtgcagaacgcccgggcctcgagtgacgatttccngcaaggtcttctggataccagtcttcagttagttatgctatacaggttgggtgcgccgacggcccccggaacaaacggtcgttagagtggcgtgggatggagtcggtcggtggctacgtacctaacactaaagatacttcaacagtaagttcagttcagtacgtctactttagcagcgacacacgtccgacgacgactgtactacagtcggtagttgagtcggaccgtaagtacgttacgtaggaacgacgacggtcttagtacttattaccgtgtacgtcgagtacgtcgtacgtaccgtaacgacggtaccggggacggggttaccccttacgtttacggtaagtttacccgggtacggggtacccaacgggggtaaccccttcgggtaccctacccccggg

SEQ ID NO: 237706 - DNA, 670 bp, Homo sapiens
  misc_feature: GYAE6OF01EEQZ2.42.74.G08.1.454.CMB.1.raw
  modified_base (229)..(229): a, c, t, g, unknown or other
  misc_feature (229)..(229): n is a, c, g, or t
  modified_base (513)..(513): a, c, t, g, unknown or other
  misc_feature (513)..(513): n is a, c, g, or t
  modified_base (551)..(551): a, c, t, g, unknown or other
  misc_feature (551)..(551): n is a, c, g, or t
tcagtgacgtatgtcacgaccggtgctcgatttagtagctctatcaggggacccaacaaccacatccctcctcagaacgccccagagcacaactcctaaccatggactggacctggaggatccttctttttggtggcagcagccacaggtcggccactcccaggtccacgtttgtgctagtcgtggggctggaggtgcagaacgcccgggctcgagtgacgtatttccngacaaggctttcgtggactacagctttacaggttagttatgacttatacaggttggtgccgcccgacgggacccccggaagtaaaacggtcgttaggtacggtgggtacggtgggtaagttcgggacgttcgggtcgggttaggcctacctacctaactaacgtaagaattattaccgaactaagttaagtttctagttacagtacgtcttactttagcagtcgaacacacgtccgacgacgacacgtcctaagacgtgggtattggagttggtacctaaagtntaccgtagaacgacgacgcgttgttacttgtagttcgngacgaggtatcgtcgtaccgttaacgacggtaacggggacggggtccctttaaggttacggtaaccgtttacgggtacccgggacggtaacccgggtacccgtcggacccgttaccccg

SEQ ID NO: 237707 - DNA, 874 bp, Homo sapiens
  misc_feature: GYAE6OF01CPTTX.42.74.G08.1.454.CMB.1.raw
  modified_base (132)..(132): a, c, t, g, unknown or other
  misc_feature (132)..(132): n is a, c, g, or t
  modified_base (170)..(170): a, c, t, g, unknown or other
  misc_feature (170)..(170): n is a, c, g, or t
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
tcagtgacgtatgtcacgaccggtgctcgatttagtagctctatcaggggacccaacaaccacatccctcctcagaacgccccagagcacaactcctaaccatggactggacctggagatccttcttttggngcagcagccacaggtcgccactccgaggtccactttgngcagtcgtggggctggaggtgacgagaacggcccgggctcgagtcgacgtatttccgngacaaggtcctttacgnggactacagtccttacgaagttagttactgtacctaattaccgtaggttgggtacgtccggacccgaccgggaccccccgggaaataaacgggtcctttagggaacggttcgggtaccgttaggggtaacgtggggtaacgttccggggttaccgggtcggtaccgttaaccgttacccgttaaacgaacgttaaaggtaaccttacgtttaccgaaacgtaagggtaaacgtttttaccgaaggtttacccgaaaggtaaccgttaccgtaaacccggttttacgacgtaaaccggacgaacctacgtacgtacccggaacgtaacgactacgttaccctaagtacgttaggaacgtttggaacggttacggtaacccgtaaaggtactacggttaacggaaacgtacccgtaacgggttccgttacggttaccgtttaacgttaccgttacggtacggttaaccggtaaggtaacgttaacgttacgtaaccccggtttaacggaacccgggtaaccggggttaccggggtaccccctttaaggttttaccggaaacgttttcccgggaccggggtaacccggtaacccggggtaacccgttccgggtaccccgtttaacccccggg

SEQ ID NO: 237708 - DNA, 677 bp, Homo sapiens
  misc_feature: GYAE6OF01AN41J.42.74.G08.1.454.CMB.1.raw
  modified_base (212)..(212): a, c, t, g, unknown or other
  misc_feature (212)..(212): n is a, c, g, or t
  modified_base (228)..(228): a, c, t, g, unknown or other
  misc_feature (228)..(228): n is a, c, g, or t
  modified_base (300)..(300): a, c, t, g, unknown or other
  misc_feature (300)..(300): n is a, c, g, or t
  modified_base (373)..(373): a, c, t, g, unknown or other
  misc_feature (373)..(373): n is a, c, g, or t
tcagtgacgtatgtcacgaccggtgctcgatttagtagctctatcagggggacccaacaaccacatccctcctcagaagcccccagagcacaactcctaaccatggactggacctggaggatcctctttttggtggcagcagccacaggtggccactcccaggtccactttgtgcagtctgggggctggaggtgcagaaggcccggggcctnagtgacgattttcccngcaaggtcttctggatacgagtcttcagtagttatgactatacaggtgggtagccgtcacggcccccggtanaacggcgttgagtggtcgtgggatggagtcggtcggtggaccgtactacctaactataagtatatttaccaanacggtaagtttagagtttacaaggtacggtctaccgttttacgctacggcgaaccacacgtccgacgtacgacagttacctaacagtgggtagttaggacgtcggaccttaagacttacgtagaagaaccgtacggacttagggttacttaacgtttacgttcgtaggtacgtaggaagttacgtcggtacccttaacggaccggtaacggggaccgggggtacccttacgtttacggtacgtttaaccggggtcgggtacccggtaaccggggacccccgttccggggtcccgttacccccgg

SEQ ID NO: 237709 - DNA, 765 bp, Homo sapiens
  misc_feature: GYAE6OF01BKN97.42.74.G08.1.454.CMB.1.raw
tcagtgacgtatgtcacgaccggtgctcgatttagtagctctatcaggggacccaacaaccacatccctcctcagaacgcccccagagcacaactcctaaccatggactggacctggaggatcctcttttggtggcagcagccacgaggtcggccactcccaggtccctactttgtgcagtcgtggggctgaggtgcagacggcccgggcctcgagtgacgtatttcctgcaaggtcttcgagactacgacgtctttcgtaggttaacgttagtggtacttaagttacggtagggttcgggtcggcccgacccggaaccggggcccccggaaagtaaacggtcgttaggacggttcgggccggtaggggacgttcggacgttcgggtcggtacggcctaaccgtacctaaacgtacgtaaagtactaacgtccaacgtaaggtaacgttttcaacgttcgaacggtcgttactacccgtttagacgaagtaccgactacgtacgtcccgacgaacgaccgtacgtacgtaacgtagttacgggtaagttcggtaacggtacggtaaccttaaaggacgttcgtaacggaacggaccgtacgggtactaggttacccttaaggttacctaggttacggaacggtacggtaaacgtcggttaaccgacccgttaacgggaacgggtaccgggtacccgggtacccgttacggttacgtaccggttacgggacgggtacccgacgggtaccccgtgggtccgtacccg

SEQ ID NO: 237710 - DNA, 623 bp, Homo sapiens
  misc_feature: GYAE6OF01CTF9L.42.74.G08.1.454.CMB.1.raw
  modified_base (226)..(226): a, c, t, g, unknown or other
  misc_feature (226)..(226): n is a, c, g, or t
  modified_base (268)..(268): a, c, t, g, unknown or other
  misc_feature (268)..(268): n is a, c, g, or t
  modified_base (295)..(295): a, c, t, g, unknown or other
  misc_feature (295)..(295): n is a, c, g, or t
tcagtgacgtatgtcacgaccggtgctcgatttagtagctctatcagggacccaacaaccacatccctcctcagaacgcccccagagcacaactcctaaaccatggactggacctggagatccttctttttggtggcagcagccacaggtcggccactcccaggtccacttttgtgcagtctggggctgaggtgcaggaagcccggggctcagtgacgtatttccngcaaggcttcgtggatacagtcttcagtagttatgatatacnggtggtcgcgccgacggcccccggaanaaacggcttggagtggcgtgggatggatcggtggtgcactctaacataagatatacactagtaagtttcagttcaagagtcctaacttacgacagcctaacacaccgtaccgaccgacgtaacacgtactacgtagtcggtaagttcggagtacggtacctaagtactacgtaagaacgtaacggcggtactacgttacgttattacgttgacgtacggagtagacttcgaccttacggaacggtacgggtaccggggtacccttacgttacggtaagttaccggtcggggtaacccaggggtaaccccgtcggtcccgttaacccgg

SEQ ID NO: 237711 - DNA, 619 bp, Homo sapiens
  misc_feature: GYAE6OF01CCZOT.42.74.G08.1.454.CMB.1.raw
  modified_base (244)..(244): a, c, t, g, unknown or other
  misc_feature (244)..(244): n is a, c, g, or t
  modified_base (284)..(284): a, c, t, g, unknown or other
  misc_feature (284)..(284): n is a, c, g, or t
  modified_base (306)..(306): a, c, t, g, unknown or other
  misc_feature (306)..(306): n is a, c, g, or t
  modified_base (400)..(400): a, c, t, g, unknown or other
  misc_feature (400)..(400): n is a, c, g, or t
tcagtgacgtatgtcacgaccggtgctcgatttagtagctctatcaggggacccaacaaccacatccctcctcagaagcccccagagcacaactcctaaccatggactggacctggagatcctctttttggtggcagcagccacaggtggccactcccaggtccactttgtgcagtctggggctgaggtgcagaagcccgggcctcagtgacgatttcctgcaaggcttctggatacgagcttnagtagttatgctatacagtgggtgcgccaggcccccgganaaggtccttgagtggcgtgggntggatcggtcggtggccactcctaacgataagatattcaactaagtagtttcgagtttcagagtactacctttagcagccgacaccagtcccgngaccgactacgtactaacattgggagttgaggtacggtacctaagattcgtagaacgaccgacgggtcttacgtacttagtttaacgttggtacgtcgaagtggtataccggtaccttaacgaccgggaccggtacgggggtccccttaacgggtttacgtaaggtttacccggtcggggtaccggtaaccggtaacccgggttggtaccgtaccccgg

SEQ ID NO: 237712 - DNA, 563 bp, Homo sapiens
  misc_feature: GYAE6OF01AZC0S.42.74.G08.1.454.CMB.1.raw
  modified_base (283)..(283): a, c, t, g, unknown or other
  misc_feature (283)..(283): n is a, c, g, or t
  modified_base (433)..(433): a, c, t, g, unknown or other
  misc_feature (433)..(433): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtggtgcgccaggccccgganaaaggcttgagtggcgtgggagtggagtcgtcggtggcactcctaacataagatattcaacagaagtttcagttcagagtctactttagcagcgacacatcccgacgacgacagtctacagtggagttgagtggacctaagatctagaanacgacggcttgtctattactgtnacgganagtctcgtaccttaccgaacggaccggaggggtacccctacgttttggaacgtttacggtcggggtaccgaacggggtacccctgggtacccttacccggg

SEQ ID NO: 237713 - DNA, 740 bp, Homo sapiens
  misc_feature: GYAE6OF01EBCMQ.42.74.G08.1.454.CMB.1.raw
  modified_base (134)..(134): a, c, t, g, unknown or other
  misc_feature (134)..(134): n is a, c, g, or t
  modified_base (284)..(284): a, c, t, g, unknown or other
  misc_feature (284)..(284): n is a, c, g, or t
tcagtgacgtatgtcacgaccggtgctcgatttagtagctctatcagggacccaacaaccacatccctcctcagaacgcccccagagcacaactcctaaccatggactggacctggaggatccttctttttggnggcagcagccacgaggtcggccacctcccgaggttcctactttgtcgcgtagtcgtggggctggaggtgacgaggaccggcccgggctcgaggtgacgtactttccgagacgtaggtcttcgtagactacagtcttacgtagttattagngtactatacgtaggtggtcgccggtaccgaccggaccccgaacgaacggtcgttagaggtggtcggtagggtagtcggtacggttcggtcggtcgcctaccgtacctaagtataagtacttacgtacaacgtaacgttaagttcgtaagttacgtaagtacggttacctaacgtttacgcgtaacgaccgaacgtactaccggtaccggaccgaaccgtactacgtactaacgtaggtacgtaaggttgacggttaccgaacgttaagtacgttacggtacggaacggtacgtaccggttacttacgtttaacgttacgttacgttacgggttcgaacggtacggaattaccgtacgttaccgttaaccgacgggtacccgggtacggttaccttaacggtttacgtacggttacgggtaccggaccggtaaccgtcccggtacgtcccgtacccg

SEQ ID NO: 237714 - DNA, 700 bp, Homo sapiens
  misc_feature: GYAE6OF01B5F73.42.74.G08.1.454.CMB.1.raw
  modified_base (133)..(133): a, c, t, g, unknown or other
  misc_feature (133)..(133): n is a, c, g, or t
  modified_base (219)..(219): a, c, t, g, unknown or other
  misc_feature (219)..(219): n is a, c, g, or t
tcagtgacgtatgtcacgaccggtgctcgatttagtagctctatcaggggacccaacaaccacatccctcctcagaacgcccccagagcacaactcctaaccatggactggacctggaggatcctcttttggnggcagcagccacaggtggccactcccaggtccactttgtgcagtctgggctgagtgcagagcccgggctcgagtgacgtatttccngacaaggtcttctaggatacagtctttcagtagttatgctatacgtagtgggtagcgccgacggccccggagaaggcttaggacgtggcgtgggactggatcggtcggtggcctacgtaccctaacgaactaagattaattcctaaataacggtaagtttacgtaagttcgtaagtacgttctaaccgttttagacaacggaccgacaaccgacttcccggaacgaacgaccgtagtacctaacgtagtacgggtagttaggagttcggaccttaaagctacgagtaacgaacgtacggaccttagttacgttaacgtttacctaggttacgacggtagaacggttagttaccggtaccctttaacggacggtaacccggggtaacggggtcccccgttacgttttagggtaaccctttaacgggtcccggggtaacccgaacccgggggttaaccctccgggtacccgttaaccccccgg

SEQ ID NO: 237715 - DNA, 851 bp, Homo sapiens
  misc_feature: GYAE6OF01CJM2A.42.74.G08.1.454.CMB.1.raw
  modified_base (259)..(259): a, c, t, g, unknown or other
  misc_feature (259)..(259): n is a, c, g, or t
tcagtgacgtatgtcacgaccggtgctcgatttagtagctctatcaggggacccaacaaccacatccctcctcagaacgcccccagagcacaactcctaaccatggactggacctggaggatccttctttttggtggcagcagccacgaggtcggccacctcccgaggtcccactttgtgcagtcgtggggctggaggtgcaggacggcccggggcctcagtgacgtactttcctgcgaaggtccttcgaggtactacngtcttcgtagtagttatgctatacgaggtgggtcgccggtaccgaccgggacccccggaaacgtaacggtcgttagggacggttcgggccggttaggggtacgttcggggtacttccggggtacgggtcgggtaccctaaccgttaacccgtaaaacgtaagttaaacggtaacttaaccgttaccgaaacgtaaggttaaacgttttacgtaacggttactaaagggtaccttaaccgttaacccgtttagaacccgtaggtaacccgacctaaccgtaccggtacccggaccgaaccggtaacgtaccgttacgtaaaccgtggttaacgggtacggttagggtacggttaccggtaaccgttaaagtacgtacggtacgtaaacggtaccggtaaccggtcttacggttaccgttaacgtttcgtaacggtcggtaccgaggtaacgtacgtaaccgttaccccgttaaaccgggaccgggtaaccgggtaccgggggttacccttcggttttaaccgggtacgttaccggggtaccggggttaaccccggaaccggggttacccggttcccggtacccggtaccccgg

SEQ ID NO: 237716 - DNA, 676 bp, Homo sapiens
  misc_feature: GYAE6OF01DY17H.42.74.G08.1.454.CMB.1.raw
  modified_base (407)..(407): a, c, t, g, unknown or other
  misc_feature (407)..(407): n is a, c, g, or t
  modified_base (454)..(454): a, c, t, g, unknown or other
  misc_feature (454)..(454): n is a, c, g, or t
tcagtgacgtatgtcacgaccggtgctcgatttagtagctctatcaggggacccaacaaccacatccctcctcagaacgcccccagagcacaactcctaacatggactggacctggaggatccttctttttggtggcagcagccacgaggtggccactcccaggtcctactttgtgcagtcgtggggctggaggtgcagaacggcccgggcctcgagtgacgtatttcctgacgaaggtcttacgtggtataccgagtcttactaggttagttatgtctaatacgaggtggtgccgccgaccggaccccggacgaaaggtccttggaggtggcgtagggatggtagtcgggtcggtcggactacctaccgtaactagtaagatatacgacgtaagtaagttcagttnacgtatacctacgtttcacacgcacacacgtccgaccgtacgacgtntactacagtacggtagttgagggtaccgtataagcgttagtaggaacgtacgtacggtcgttacgttacgttacgtttacgtaggtcggacggtacggtagttaactcggtaacccttaacggacccgggttaaccggggtacgggttacccttacggttacggttacggttaccggtacggggaccggtacgggtaccccggtgggtacccgtaccccggg

SEQ ID NO: 237717 - DNA, 785 bp, Homo sapiens
  misc_feature: GYAE6OF01C67XK.42.74.G08.1.454.CMB.1.raw
  modified_base (137)..(137): a, c, t, g, unknown or other
  misc_feature (137)..(137): n is a, c, g, or t
  modified_base (657)..(657): a, c, t, g, unknown or other
  misc_feature (657)..(657): n is a, c, g, or t
tcagtgacgtatgtcacgaccggtgctcgatttagtagctctatcgaggggacccaacaaccacatcccctcctcagaacgcccccagagcacaacctcctaaccatggactggacctggagatccttcgttttggnggcagcagccacaggtcggccacctcccgaggtcctactttgtgcagtcgtggggctggaggtgacgaggaacggcccggggctcgaggtcgacgtactttccgtgcgtaaggtccttcgtggaacgttacgagtccgttagagttagttatgtctagtacgtaggtcgggtcgccgccggaaccggacccccggaagaaacggtccttaggacgggtcggtcgtaggggtagtacgggtacgttccgggtcggtacggctaaccgttaccctaaagaacgtaagtaattacgttcaaacgttaagtaacggtttactagttaccgtaacgtacgtaccgttaacttacgaaccgtaggaccgtaaactaaccgacgtacccgtaacggaaccgtaaccgtaattaccgtaacgtaagtttaagggtaagtttcggaacggttccggtaaacctaaagtaagttacgaacggtaaacgtacccggtaaccggtcgttacgtttacccgtaagtttaacgngggttaaccgacggttagtaacgtacgtacggtaacccgtaacggaaccggtacggggaacggttacccgttcgttacgtaacggtacgggtcggacccggacggttacccgtaacggtcgtaacccg

SEQ ID NO: 237718 - DNA, 649 bp, Homo sapiens
  misc_feature: GYAE6OF01AXRW4.42.74.G08.1.454.CMB.1.raw
  modified_base (220)..(220): a, c, t, g, unknown or other
  misc_feature (220)..(220): n is a, c, g, or t
  modified_base (284)..(284): a, c, t, g, unknown or other
  misc_feature (284)..(284): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
tcagtgacgtatgtcacgaccggtgctcgatttagtagctctatcgaggggacccaacaaccacatccctcctcagaacgccccagagcacaactcctaaccatggactggacctggaggatcctcttttggtggcagcagccacaggtggccactcccaggtccactttgtgcagtctggggctgaggtgcagaagcccgggctcagtgacgatttccngcaaggcttgtggatacagcttcgagtagttatgctatacagtggtagcgccgacggccccganaaaggcttgacgtggcgtggatggatcgcggtgcactctaacactaagntactcanagtattcagttcagctactacttagcagacgacactactccgactacgacgtacgtacctacgtagtagggtaagtttcggaggtacgggtaccttaaaggtactccgttaacggaacggtaaccgtacggtccgttacggtaccgttaacgtttacgtggttacgccggtaaggtacgacgttacggtacccgttaacggaaccgggtacgggtaccgggggttacccttacggtttacggtaacgtttaacccgggtaccggggacccgtacggggtaaccccttacggggttcccgtaaccccggg

SEQ ID NO: 237719 - DNA, 783 bp, Homo sapiens
  misc_feature: GYAE6OF01CD6J7.42.74.G08.1.454.CMB.1.raw
  modified_base (173)..(173): a, c, t, g, unknown or other
  misc_feature (173)..(173): n is a, c, g, or t
  modified_base (243)..(243): a, c, t, g, unknown or other
  misc_feature (243)..(243): n is a, c, g, or t
tcagtgacgtatgtcacgaccggtgctcgatttagtagctctatcaggggacccaacaaccacatccctcctcagaacgcccccagagcacaactcctaaccatggactggacctggagatccttctttttggtggcagcagccacaggtggccactcccaggtccactttgngcagtcgtggggctgaggtgcagaacggcccggggcctcgagtgacgtactttcctgcgaaggtcttcgnggaatacagtcttacgaagttagtttagtcgtacttaatacgagggttgggtcggccgaccgaaccgggacccccggaagaaacggtcgttaggaggttcggcgtgggagtgggacgttcggtcggtggacctaccttaccaaactagtaacgtattacgttacaacgtaaggttaacgtttctaaggttacgaacggtaacgttaccgttaaccgttttaggcccgtaaacggcccgtaactaacccgtaccggttcccggaaccggtaaccggtaacgtaaccggttactaaaccggtagttacgggacggtttaggtaaccgggtggttaaccctaaggtaccgttacggttaacgaaacggtaccggtacggttaccgtttacgttaccgttttaaagttaccggtaggtacgggtaaccgtaggtaacgtacgtaccggtaccgttaacgaccgggaccggggttaccggaccctttaggttacgtaccgttacgggcgggtaaccggaaccgggtaccttcgggcttaccccgg

SEQ ID NO: 237720 - DNA, 587 bp, Homo sapiens
  misc_feature: GYAE6OF01DNDWM.42.74.G08.1.454.CMB.1.raw
  modified_base (286)..(286): a, c, t, g, unknown or other
  misc_feature (286)..(286): n is a, c, g, or t
  modified_base (350)..(350): a, c, t, g, unknown or other
  misc_feature (350)..(350): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtctggggctgaggtgcagaagcccggggcctcagtgacgatttcctgcaaggcttctggatacagcttcagtagttatgctatacaggtggtgcgccaggcccccgganaaacggcttgagtggcgtgggatggatcggtcggtggcacgtcctaaacataagatattaccanagtaagtttcagtttcagactctacctttagcagtcgaacacgtactccgacgacgaacagtactacagtacggtagttcgagtgtacgtaagactctagaacgacgacggcttaggtctaagttacgtgtcgacgagagtacgtacgacctttaacgacggtaccgggacgggtaccctacgtttagtacgttaacggtcggggtaccacggggtaaccccgtggtccgtaccccg

SEQ ID NO: 237721 - DNA, 657 bp, Homo sapiens
  misc_feature: GYAE6OF01CLD3A.42.74.G08.1.454.CMB.1.raw
  modified_base (367)..(367): a, c, t, g, unknown or other
  misc_feature (367)..(367): n is a, c, g, or t
tcagtgacgtatgtcacgaccggtgctcgatttagtagctctatcaggggacccaacaaccacatccctcctcagaagcccccagagcacaactcctaaccatggactggacctggaggatccttcttttggtggcagcagccacaggtggccactcccaggtccactttgtgcagtcgtggggctgaggtgcaggaacgcccggggcctcgaggtgacgtatttccgtgacgaaggtcttcgtgggaattacagtcttcagttacgttatgcttaatacaggtggtcgcgaccgaccgggaccccgaacgaaaggcttggacggtggcgtgggagtggacgtcgtacgggtgcctactaccgtaanataagatacttacactagtaagtttcgagttacagacgttactacgtttacgacagaccaacactacgtacccgaccggtaacgaacgtacgtaactacgtacgtgggtagttagagggtcggaaccgttaaagtcttacgtaacggaacgtaaccgtacggtcttaggttacttacgtttaacgtggttacgacggtagaacgttgtaccgtactaccgaggaccgggtagggtaccctgtttacggacgttacggccggggacctaggggacccgtggtacctcccgg

SEQ ID NO: 237722 - DNA, 971 bp, Homo sapiens
  misc_feature: GYAE6OF01CZ4TP.42.74.G08.1.454.CMB.1.raw
  modified_base (133)..(133): a, c, t, g, unknown or other
  misc_feature (133)..(133): n is a, c, g, or t
  modified_base (230)..(230): a, c, t, g, unknown or other
  misc_feature (230)..(230): n is a, c, g, or t
tcagtgacgtatgtcacgaccggtgctcgatttagtagctctatcagggacccaacaaccacatcccctcctcagaacgcccccagagcacaactcctaaccatggactggacctggagatccttcttttggnggcagcagccacaggtggccactcccaggtcctactttgtgcagtcgtggggctgaggtgcgagaacggcccgggctacgaggtgacgtattttccngacgaaggtcctttcgaggtactaaccgaggttcctttacgaaggtttagtttacgtacgtacttaacgtaccgtaagggttggggttacggcccggacccggaacccggggacccccggaaacgtaaacggtcgtttagggacggttcgggcggttaggggacgtagggtacggttccggttccggggttacgggtaccctaaccgttaacccgttaaactaaacggttaaataacttacgttaaccacgttaaacggttaacgttttaacgtacgttacgtaacggtaacgtaccgttaaccgtttacgacgtaacggaacccgaactacccggtacctacccgggaaccgtaaccggtaaccgtaacgttaaccgtaaacgttaacggttaggggtaaacggttttcggaacgggttacgggtaaaccccgtttaaaggacgtttaaccggtaaggaaacccggtaaccggtaaccggtaacgtttacgttaaccgtttacgtttaaccggttggtaacggtacgggtaacgttaacggtacgttacccggttaacccgttacgggaaacccgggggtacccggggggtaacccccggggtttacccctttaaaacccgggttttacggttaaacccggggttttaccggggtaaccccggggggttaaacccggggtaacccccggggtttaaaacccccgggttccggtttaaccccccgggttaaaccccccggg

SEQ ID NO: 237723 - DNA, 649 bp, Homo sapiens
  misc_feature: GYAE6OF01CU441.42.74.G08.1.454.CMB.1.raw
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (425)..(425): a, c, t, g, unknown or other
  misc_feature (425)..(425): n is a, c, g, or t
tcagtgacgtatgtcacgaccggtgctcgatttagtagctctatcaggggacccaacaaccacatccctcctcagaagcccccagagcacaactcctaaccatggactggacctggagatccttcttttggtggcagcagccacaggtggccactcccaggtccactttgtgcagtctggggctgaggtgacagaacggcccggggctcaggtgacgtatttcctgcaggctttcgtggaataccagtccttacgaagttagttatgacttatacgaggtgggtcgccgccgaacgggcccccggaacgaaaggtccttaggaggtggtcgtaggggatgggagttcggtcgggtgcctacgtcctaaacgataagattataccanagtagtttnagttcagtacgtctaaccttgcagcacacnctccgagacgactacgtctacgagtaggtagtgtagtacggtactaagactagtagaacgacgacggtcttagtacttagttacgttgtacgacggagtaagtgtaccgtccgttaacggaacgggtaccgggtacgggggtaccccttaggtttacggttaaccgtttaccgggaccgggggtaccgtaaccggggttaacccgtgggttaccccgtacccgg

SEQ ID NO: 237724 - DNA, 582 bp, Homo sapiens
  misc_feature: GYAE6OF01DNXWX.42.74.G08.1.454.CMB.1.raw
  modified_base (260)..(260): a, c, t, g, unknown or other
  misc_feature (260)..(260): n is a, c, g, or t
  modified_base (291)..(291): a, c, t, g, unknown or other
  misc_feature (291)..(291): n is a, c, g, or t
  modified_base (316)..(316): a, c, t, g, unknown or other
  misc_feature (316)..(316): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaaggcccggggcctcgagtgacgtatttcctgccaaggtcttctggatacagcttcagttagttangctatacagtgggtgcgccacggccccgganaaaggcttgagtggctggggatggntcggtcggtggcctacgtcctaaacataagattattacactagtaagtttcagtttcaagtacgtctaaccgtttagcagcgacacatccgacgacgacagtacactgtaggtaagttggagtgggacccttaaagcttcgtaagaagacacggcttgtaccttagttctaggtgacgagagcgtcgaccttacgaccggacggacggggtccctagttagtcgttaacgtcgggaccgtacgggaacccgttgaccgtaccccgg

SEQ ID NO: 237725 - DNA, 821 bp, Homo sapiens
  misc_feature: GYAE6OF01BPEO7.42.74.G08.1.454.CMB.1.raw
tcagtgacgtatgtcacgaccggtgctcgatttagtagctctatcaggggacccaacaaccacactccctcctcagaacgccccagagcacaactcctaaccatggactggacctgggaggtattccgttctttttggtggcagcagccacgaggtggccactcccaggtccactttgtgcacgtcgtggggctggaggtgcaggacggcccggggcctcgagtcgacgtatttccgtagcgtaacggtctttccgtgggtaactaccgtagtcctttacgtaaggtttagtttagtcgtacttaataacgtagggttgggtcgccggacccgacccggggacccccgggaaagtaaacggggtccttaggacgggttgggtcggtaggggtagttagggacgttccgggttacgggtcggtacctaccgttaccctaaaacgtagttaaacgtaacttacttacgaacgtaaggttaacgttttacgtacgtttacgaacggttacttaccgtaacccgtttagacgtaaggaccacaccgtacgtacccggaacgaccgtacgtaccgttacttaacgtagttagggtagttacgggagtaccgggtacctaaagttcgtacgtaggaacgtacctcggtaccgttattacgtttaacgtttcggtaggtcggtaacggagtacggttacgtaccgttaccgttaaccgggacggttaccgggggtacccggtaccgttttacgttacgggttaccgttaccggggtaccgggtaacccgggaaccggggttacctttcccgggtaccttaccccgggg

SEQ ID NO: 237726 - DNA, 813 bp, Homo sapiens
  misc_feature: GYAE6OF01CW6MJ.42.74.G08.1.454.CMB.1.raw
  modified_base (229)..(229): a, c, t, g, unknown or other
  misc_feature (229)..(229): n is a, c, g, or t
tcagtgacgtatgtcacgaccggtgctcgatttagtagctctatcagggacccaacaaccacatccctcctcagaagcccccagagcacaactcctaaccatggactggacctggagatccttcttttggtggcagcagccacaggtgcccactccccaggtccactttgtgcagtcgtggggctggaggtgcaggaacggccccggggcctcagtgacgtatttccgngaccgaaggtcttcgtggataccgagtctttcagttagttatgactatacgaggtgggttcgccgcccgacggacccccggaacgaaaggcgtggaggtggcgtgggacgtaggacgtcggtcgggtggtccaccgtacctaacgaataagtacttaacttcactaagtaagttttacagttacgaagtacgttcctaaccgtttagacgtacgaccgaacctacacgttaccccggaccgtaaccgaaccgtacgttacctacgtaacgtacgggttaggttacggtaaggtcggtaaccgttaaacgtacttaccggtaacggaaacgtaccgtaacggggtcccgtttagtaccgttttaaagtttaccgtacggttaggtaaccgggtaggtaacggttaaccgtttccggtaccccgtttaaccggtaacccgggggtaaaccccggggtacccggggggttaccccctttaaacggtttttacccgggttaaacccgttttaccggggtaacccgggggtacccccggtaaaccggggggttaaaccccccgtttcgggtaccccggtaccccccggg

SEQ ID NO: 237727 - DNA, 693 bp, Homo sapiens
  misc_feature: GYAE6OF01BJ9BR.42.74.G08.1.454.CMB.1.raw
  modified_base (266)..(266): a, c, t, g, unknown or other
  misc_feature (266)..(266): n is a, c, g, or t
tcagtgacgtatgtcacgaccggtgctcgatttagtagctctatcaggggacccaaacaaccacatccctcctcagaagcccccagagcacaactcctaaccatggactggacctggaggatcctctttttggtggcagcagccacaggtgccactcccaggtccactttgtgcagtcgtggggctggaggtgcagaacgcccggggcctcagtgacgtatttcctgacaaggtcttctggatacagtcttcgagttagttatgtntatacagtgggtgcgccgacggccccggaagaaggtcgtgaggtggcgtgggagtggtagtcggtcgggtggcaccgtcctaaacataagtaatattacaacgtagttaagtttcgtacgttactaagtacgttacctaaccgttttacgacgtacgacgaccaactacctaccggaccgaccgaactcgttaacctacgtagttacgggtagtttacggaggttccggtaacctaaggtacgttaccgtaggaacggtaccgtacgcgttagttacgttacgttacgttgtacggtagtaggaagtacgtcgttaccgttaaccggacggtaacccggggtacggggtacccgttaggtttcgttaacgttaccgggtcggggacccggtaacccgggtaacccgttccgggttcccgttaccccg

SEQ ID NO: 237728 - DNA, 744 bp, Homo sapiens
  misc_feature: GYAE6OF01D2N9F.42.74.G08.1.454.CMB.1.raw
tcagtgacgtatgtcacgaccggtgctcgatttagtagctctatcaggggacccaacaaccacatccctcctcagaacgcccccagagcacaactcctaaccatggactggacctggagattccttctttttggtggcagcagccacaggtggccacctcccaggtcctactttgtgcagtcgtggggctggaggtgcgaggaacggcccggggcctcgagtgacgtattttcctgcaaggtcttcgtggatacgagtctttcgaagttagttatcgtcttaataacgtagggtggggtcggccggacccgaccggggaccccccggaacgaaacggtcgttaggaggtgggccggtaggggtagtgggtacgttcggtcgggtcggcctacctaccgtaaacgtaagtaaagtacttatccaacgtaagttaacggtttcagttcgaagtacgttactacttacgctacgaccgactaacgactcccggacgaccgactacgtactaacgtaggtaggtagttggaggttcgggtaacctaagtacttacgtaacggaaacgtaccgtaccggttcgttacgtttacgtttacgtttacgttaggcggaacgtaggaagtacgtacggtacccgttaacgaccggacgggtacccggggttacccttacggttacgttaacggttaccggggtaccggggtaacccggtaaccgggtaccccgttcggtcccgttaaccccgg

SEQ ID NO: 237729 - DNA, 754 bp, Homo sapiens
  misc_feature: GYAE6OF01B25EZ.42.74.G08.1.454.CMB.1.raw
  modified_base (170)..(170): a, c, t, g, unknown or other
  misc_feature (170)..(170): n is a, c, g, or t
  modified_base (226)..(226): a, c, t, g, unknown or other
  misc_feature (226)..(226): n is a, c, g, or t
  modified_base (275)..(275): a, c, t, g, unknown or other
  misc_feature (275)..(275): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtgccactcccaggtccactttgngcagtcgtggggctgaggtgacaggaacggcccgggcctgagtcgacgtatttccngcgaaggtcttcgtggatacagtcttcgagttattactgactagtacgnggtgggtcgccgacccgaccgggacccccggaacgaaacgggtccgttaggaggttcgggcggtagggggtagtcgggtacgttcgggttcggggtcggaccctaccgttaaccgtaaactaagtaaagtaatttacttaccgaacgttaaggttaaacgtttacgaacggtttacaaacggtacgttaccgttaacccgtttaggacgtaacggacccgtaaaccaaccgtacgtaccccggaccgtaaccgaacgtacgttacctaacgtaggttcgggtaaagttggtaacgggtacgggtaacctaaggtaactagtaacggaacgtacccggtacgtccgttacgtacttacgttaggttcggtagtacggagagtacgttcgtacccgtacggaaccggcggggtaaccgggacccttgttacgtacgttacgggtccgggaccggtacggtacccgttaggccccgtacccg

SEQ ID NO: 237730 - DNA, 773 bp, Homo sapiens
  misc_feature: GYAE6OF01ATAYN.42.74.G08.1.454.CMB.1.raw
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttgggtggcagcagccacaggtggccacctcccaggtccactttgtgcagtctggggctggaggtgcaggacggcccggggctcagtgacgtatttccngacgaagtcttcgtggatacngtcttnagtagttatgtctatacgaggtgggtcgccgccgaccgggcccccggaagtaacgggtccttagacggtacgggtcgtaggggtagtgggtacgttcgggttcgggtacggacctaccgttaccctaaaccaagttaaacgtaattaacttaccgaactaaggtaacgttttcgaacgtttcgaggtaaccttacttaccgtttagacacggtaccaacacgtacgtacccggaccgaccgtaacgtacgtacctaacgtaggtgggtaacgtttaggacgggttacggaccgttaagtcgtaccgtaacggtaaggacccgtagggtcccgttacggttacgttaacgtttaccgtcgggttagaaccggaaggtacgtacggtaccgtaaccccggttaaggacccgggtacggggttacccggggaccttttaccgggttacgtaaccggtttaccggggtaccgggtaacccgggtaaaccgggtaccccggttggtaaccccgttaccccggg

SEQ ID NO: 237731 - DNA, 544 bp, Homo sapiens
  misc_feature: GYAE6OF01EABOQ.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctggggatggatcgtcggtggcactcctaacataaagatattcacagaagtttcagttcagagtcacctttagctagcgacacatccgcgacgacagtctacatggagttgagtggacctaagatctgaagtacgacggctgtctattactgttagcgagagatgccttacgaccggacggacgggggccctacgtttcgaatttaccggtcggggaccacggggaacccgtggtccgtaccccg

SEQ ID NO: 237732 - DNA, 849 bp, Homo sapiens
  misc_feature: GYAE6OF01CMPKB.42.74.G08.1.454.CMB.1.raw
  modified_base (134)..(134): a, c, t, g, unknown or other
  misc_feature (134)..(134): n is a, c, g, or t
  modified_base (236)..(236): a, c, t, g, unknown or other
  misc_feature (236)..(236): n is a, c, g, or t
tcagtgacgtatgtcacgaccggtgctcgatttagtagctctatcaggggacccaacaaccacatccctcctcagaacgcccccagagcacaactcctaaccatggactggacctggaggatccttcttttggnggcagcagccacaggtcggccactcccgaggtccactttgtgcagtcgtggggcttaggaggtgacgaggaacggcccgggctcgagtgacgtactttccgngacaggtcttacgtaggactacgtagtcttcgagttacgttatcgcttaagtacgagggttcggtcggaccgcccgaccgggacccccggaaagaaacggtccgtttaggaaggtcgggtacgtggggatacgggtagttcgggttcgggtcggacctaaccgtaacccgtaaagacgttaaaggacttacgttaccaacgtaacggtttaactttacggtaagtttaccgaagttaccgtacttaaccgtttacgaccgttaacgggacccttaaacgaccggttaccgttacccggggaacgtaaacccgggtacgttaaccggtaaccctaaacggttcggtaaggggttacttttaacgggaggttaccccgggtaaacgtttaacggactttaccgggaaagaaccggtacccggtaacggtcgttaaccggtttaccgtaactttacgggtacgtaacgggtccgaaggtagttaccgacgttaccgttaaacggaacccgggaccggggtaacccgggtcccttaggtttaacgggccgttttaaaaccggggccgggtaacccgggtaacggggttaaccccgttggggtaaaccccttcccggg

SEQ ID NO: 237733 - DNA, 580 bp, Homo sapiens
  misc_feature: GYAE6OF01CYRQK.42.74.G08.1.454.CMB.1.raw
  modified_base (134)..(134): a, c, t, g, unknown or other
  misc_feature (134)..(134): n is a, c, g, or t
  modified_base (193)..(193): a, c, t, g, unknown or other
  misc_feature (193)..(193): n is a, c, g, or t
  modified_base (255)..(255): a, c, t, g, unknown or other
  misc_feature (255)..(255): n is a, c, g, or t
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
tcagtgacgtatgtcacgaccggtgctcgatttagtagctctatcaggggacccaacaaccacatccctcctcagaacgcccccagagcacaactcctaaccatggactggacctggaggatccttcttttggnggcagcagccacaggtggccactcccaggtccactttgtgcagtcgtggggctggaggngacagaacggcccggggcctcagtgacgtatttcctgcaaggtcttcgaggatacagtcttnaagtagttatgactatacaggtggtgcgaccgacggcccccgaanaaggctagagtggcgtgggatggatcggtcggtcggacactaccaaagataaanatatacaacgtaagtaagttcagttacaggtactactaccgtttaagcagaccaacacacgtccgacgaacgacacgtactaagagtaggagttacgagtcggactaagcttacgagaagaccacggcttgtactaattcgtgagagagagatcgacttacgacggacgggacgggtaccctaggtttgacgttacggcgggacaacgggacccttggcctacccg

SEQ ID NO: 237734 - DNA, 740 bp, Homo sapiens
  misc_feature: GYAE6OF01BRYYO.42.74.G08.1.454.CMB.1.raw
  modified_base (248)..(248): a, c, t, g, unknown or other
  misc_feature (248)..(248): n is a, c, g, or t
  modified_base (727)..(727): a, c, t, g, unknown or other
  misc_feature (727)..(727): n is a, c, g, or t
tcagtgacgtatgtcacgaccggtgctcgatttagtagctctatcaggggacccaacaaccacatccctcctcagaagcccccagagcacaactcctaaccatggactggacctggagatcctcttttggtggcagcagccacgaggtcggccactcccaggtccactttgtgcacgtctggggctggaggtgcagacggcccgggcctcagtgacgtatttcctgacgaaggtcttcgaggatacgngtcttcgtaagttagttatgacttaatacgtagggttcgggtcgaccggacccggacccggggacccccgaaagtaaacggtcgttaggaggtcggccggtgggacctgggtacgttcggtcggtcggtaccaaccttaccgtaaactaagttaacgtattacgtttacgaacgtaagttaacgttactacgtttcaagtacggttaccttaacccgtttaggactaacggaccgtaacctaccaacgtcccgaacgtaacccggtagtaaccgtacctaacgtaaggttaggggtaacgtttcgggtaagttccggtaaccgttaaaggtctaacggtaacgaacggaccgttaacggtcgttagtttaacgttacgttaccgtggtaccggagtaagtacgtactcccgtaccgttacgaaccgggtacgggaccggttacctcgttagacgttacggtcgggaccgacggttaccncggtccctacccg

SEQ ID NO: 237735 - DNA, 599 bp, Homo sapiens
  misc_feature: GYAE6OF01AZ7GO.42.74.G08.1.454.CMB.1.raw
  modified_base (289)..(289): a, c, t, g, unknown or other
  misc_feature (289)..(289): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtgccactcccaggtccactttgtgcagtctggggctgaggtgcagaacgcccgggctcagtgacgatttcctgcaaggtcttcgtggatacagtcttcagttagttatgctatacaggtgggtgcgccacggcccccgganaacggtcttggagtcggcgtgggatggatcggtcggtggctactctaacataagattattcaactagtaatttcagttcagacgtctaacctttagacgtacgcgacacacgtccgacgacgactagtctaacagtggagttaggagtcgtacgtaagtactcgtaggaacacgtacggtcttgtaccttattacgtgttcgacgagagtcgtagtaccgttacgaccggacggtaccgggggtacccttagtttacgtacgttacggtcggggacccgtaacgggtacccgttgggtcccttaccccgg

SEQ ID NO: 237736 - DNA, 767 bp, Homo sapiens
  misc_feature: GYAE6OF01AO5MF.42.74.G08.1.454.CMB.1.raw
  modified_base (235)..(235): a, c, t, g, unknown or other
  misc_feature (235)..(235): n is a, c, g, or t
  modified_base (251)..(251): a, c, t, g, unknown or other
  misc_feature (251)..(251): n is a, c, g, or t
tcagtgacgtatgtcacgaccggtgctcgatttagtagctctatcaggggacccaacaaccacactccctcctcagaacgcccccagagcacaactcctaaccatggactggacctggagactccttcttttgggtggcagcacgccacgaggtgccactcccacggtccactttgagctagtcgtggggctggaggtgcgaggacggcccgggcctcgagtcgacgtatttccngacgtaggtcttacgnggactacgcgtctacgtagttagttatcgtactacgtacgtacgggtgggtcgccgtacccggaccggaccccggaagaacggtcgttaggcggtcgggtcgtagggacgtacggcggttccggtcgggtacggtacctactaaccctaacgtaagtaacgtacttacgttcaaaccgtaggttaacgtttactacgttacgaggtacgtaccttaccttaggaccgtacgacgtaccaccgtacgtacccaccggaccaccgtacgttactacgtaaggttacggtaggttcggtacgtacggtaaccgttaagtacgttacgtaacggaaccggtacgtaaccgttacgttacgttaacctttacgttacggtgggttacgacggttaagtccgtaacggtccgtaaccgttccgggtaaacgggacccgggtacggggtacccttagggttactacccggggttacgtaccggggaccgttaacgggtaccccgtgggttaccccctacccgg

SEQ ID NO: 237737 - DNA, 758 bp, Homo sapiens
  misc_feature: GYAE6OF01DN21R.42.74.G08.1.454.CMB.1.raw
  modified_base (180)..(180): a, c, t, g, unknown or other
  misc_feature (180)..(180): n is a, c, g, or t
  modified_base (221)..(221): a, c, t, g, unknown or other
  misc_feature (221)..(221): n is a, c, g, or t
tcagtgacgtatgtcacgaccggtgctcgatttagtagctctatcaggggacccaacaaccacatccctcctcagaacgcccccagagcacaactcctaaccatggactggacctggagatccttctttttggtggcaggcagccacaggtgccactcccagtccactttgtgcagtcgngggctgagtgcagagcccgggctcgagtgacgtactttccngacgtaaggtcttcgtaggatacgagtcttacgagttattagtgtactaagtaccgtaggtggtcgaccgccgaccggacccccgaacgaacggtccgttaggacggtgggacgtgggtaggtggtagttccgggtcgggcggtaccacttaacccgtaataaagtaagtaacttaattaccgaaacgtagttaaagtttacaacgttacgaagtacgttacctaacgtttacgacgtaggacgaaccaactacgtcccgaacggaacaccgtacgtactaacggtaagttcggttaaggtacggttacggtaccggtaaactaacgtacttaccgtaggaaacgtaaccgtaacgtcgtttaaccgtgttaacgttacggttgtaaccggtagggaacgtagtaccggttcgtaacccttagggaaacccggtaacggggtacccgggtaacccgttacggtttacgggtaacgtttacccgggtaccggggtaaccgtaacccgggttccccggttacggttaccccgtacccgg

SEQ ID NO: 237738 - DNA, 761 bp, Homo sapiens
  misc_feature: GYAE6OF01AX6L6.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatccttcttttggtggcagcagccacagggtggccactcccaggtccactttgtgcagtcgtggggctgaggtgcagagcccgggctcgagtgacgtatttcctgcaaggtcttctggtatacagtcttacagttagttatgtctatactaggtgggtcgtcgcccgacgggccccggaacaaaggtccttaggtaaggtcggtcggtaggggatcgggtagttcggtccgggtggcctaccgttacctaaacgtacgttaaagactttacgttacctaacgtaagttaaacgtttacgtaagttacgtagtacttaccgttaacctttaggactacggtacggacctacgtacgtaccggtaccacggtacctacggttactaacgtacgtagggtaggttaggtacggtacgggtaccttaaaggtacgttacgttacggaaaccgtaccggacgggtacttacggtacgtttaacgttccgttacgggttcgacgggtaacgtagtaacgttccgtaccgttaaaccggtaccggtaacgggtacccgggggacccctttacggttacggtaaacgtttacccgggtccggggtaaccgtacccggggtaaacccggttacggtcccgttaacccccgg

SEQ ID NO: 237739 - DNA, 780 bp, Homo sapiens
  misc_feature: GYAE6OF01DIH5Z.42.74.G08.1.454.CMB.1.raw
  modified_base (183)..(183): a, c, t, g, unknown or other
  misc_feature (183)..(183): n is a, c, g, or t
  modified_base (227)..(227): a, c, t, g, unknown or other
  misc_feature (227)..(227): n is a, c, g, or t
tcagtgacgtatgtcacgaccggtgctcgatttagtagctctatcaggggacccaacaaccacatccctcctcagaagcccccagagcacaactcctaaccatggactggacctggaggattccttctttttggtggcagcagccacaggtggccactcccaggtcctactttgtgcagtcgngggctgaggtgcaggacgccccgggctcgagtgacgtatttccngactaaggtcttcgtggatacgagtcttacgagttagttagtcgtactataacgtagggttgggtcgccgaccgacccggggtacccccgaacgtaaacgggtcttggtaacggtggtccggttagggtacgtggggtacttccgggtcgggttaggcctaaccgttaccctaaaacgtagtaaaacgttacttacgttaccaaacgtaagttaacgttttaccgagttacgacgttaacgtacctaccgtttagacctaagcgtaacactaccgtacccgacggaacctacgtacgttaacctagtacgtagggttaacgtagggtacgtagggtaccctaagtacgtacgaacggtaacgtaccgtcggtctttacggtaacctttagttaacggttcgtagggtacgtacggtaagtacgttaccggacccgtttaacggacccggggaaaggggttaccccggggttctttaaaccgggtttaacgtaccggtttaaccgggtcgggaacccgttaccccggggtacgtaccggtccccggttaacccg

SEQ ID NO: 237740 - DNA, 671 bp, Homo sapiens
  misc_feature: GYAE6OF01C6N58.42.74.G08.1.454.CMB.1.raw
  modified_base (239)..(239): a, c, t, g, unknown or other
  misc_feature (239)..(239): n is a, c, g, or t
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (340)..(340): a, c, t, g, unknown or other
  misc_feature (340)..(340): n is a, c, g, or t
tcagtgacgtatgtcacgaccggtgctcgatttagtagctctatcgaggggacccaacaaccacatccctcctcagaacgcccccagagcacaactacctaaccatggactggacctggagatccttctttttggtggcagcacgccacgaggtcggcccacctcccgaggtcctactttgtgcagtcgtggggctggaggtgcaggaacggcccggggcctcgagtgacgtatttccngacaaggctttgaggatacagtcttnagtagttatgctatagnggttgggncgccaccggaccccggaanaaggtctaggacgtggccgtggggattcggntcggtcgggtgcctactaccgtaataagtaatacttacttacaacgaagttaaagttttcaaggttcaagttacgtaccgttaccttaggctaaggaccgaactacgaccgccgacggaccacgacgtactactaagtaggtaggtagtaggtacggacgtaagtactacgtaacggaacgaacggtacgtcgttcgttacgttaccgttagtaggtaggacgagtacgtagtacgtaccgtacgaccggacgggtaccgggaccgtaccgttcgtacgttacggtaccgggaccggaaccggagtccccccccccccggtggttaccccg

SEQ ID NO: 237741 - DNA, 541 bp, Homo sapiens
  misc_feature: GYAE6OF01C9DB8.42.74.G08.1.454.CMB.1.raw
  modified_base (255)..(255): a, c, t, g, unknown or other
  misc_feature (255)..(255): n is a, c, g, or t
  modified_base (289)..(289): a, c, t, g, unknown or other
  misc_feature (289)..(289): n is a, c, g, or t
  modified_base (395)..(395): a, c, t, g, unknown or other
  misc_feature (395)..(395): n is a, c, g, or t
  modified_base (436)..(436): a, c, t, g, unknown or other
  misc_feature (436)..(436): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaacgcccggggctcagtgacgatttcctgcaaggtcttctggatacagtcttcagtagttangctatactaggtgggtgcgccacggccccggaanaaaggcttgagtggctgggatggagtcggtcggtggctacgtcctaaacataacgatattcaacagtaagtttcagttcagtactctaactttagcagacgacacnctaccgcgacacagtcaatgtgtagtgagtcggacctaagnttctagatacgcgtctgtacttatctgngtgagnatcgacctacgacggtcgggacgggtcctagttgaacttcggtcgggaccagggtaccctggtcctacccg

SEQ ID NO: 237742 - DNA, 756 bp, Homo sapiens
  misc_feature: GYAE6OF01C58IY.42.74.G08.1.454.CMB.1.raw
  modified_base (132)..(132): a, c, t, g, unknown or other
  misc_feature (132)..(132): n is a, c, g, or t
  modified_base (249)..(249): a, c, t, g, unknown or other
  misc_feature (249)..(249): n is a, c, g, or t
  modified_base (270)..(270): a, c, t, g, unknown or other
  misc_feature (270)..(270): n is a, c, g, or t
  modified_base (598)..(598): a, c, t, g, unknown or other
  misc_feature (598)..(598): n is a, c, g, or t
tcagtgacgtatgtcacgaccggtgctcgatttagtagctctatcagggacccaacaaccacatccctcctcagaacgcccccagagcacaactcctaaccatggactggacctggagatccttgttttggngcagcagccacgaggtcggacccacctcccgaggtccctacgtttgtgactgtcgtgggctggaggtgacgacggaaccggccccggggtcctcgacggtcgtaacgttcgtttccnggaccgtaaggttccttacgngtaactacgagtccttagtagttagtacgttgacttagtacgtaggtggtccgccggcccggaccggaccccggaagaacggtcgttcggaaggtccggacgttagggcgtttaggacgttcggtacgggtaccgacctaaccgttacaaagtaacgtaagtactacgttacaacgttagtaaactttcgtagtaccgtaacgtacgttaccgttaacgtttaacgcctaacggtacccgtaacgaaccgttccgacccgaacgtacgaccgtacttacgagtacggtaggtagttaggacgtacggtactaagacgtacgagtaacncgacgttctcgtacttagttagttcgacggagacgtatcgacgtaccggtaaccgacgggtaccgggtaccggttcccttaacgggtttcgtaaccggttacgggtacccgggtaacccgtaaccccgggtttcccgtaacggtcccccggttacccg

SEQ ID NO: 237743 - DNA, 723 bp, Homo sapiens
  misc_feature: GYAE6OF01BCIO0.42.74.G08.1.454.CMB.1.raw
tcagtgacgtatgtcacgaccggtgctcgatttagtagctctatcagggacccaacaaccacatccctcctcagaagcccccagagcacaactcctaaccatggactggacctggaggtactccttctttttggtggcagcagccacgaggtggccactcccgaggtcctactttgtgcagtcgtggggctggaggtgcgaggaacggccccggggcctcgagtgacgtactttccgtgacgtaaggtccttcgtaggatacgagtccttgtagttagttatgaccttatacgagggttgggtcgccgtcccgaccggccccggaagaaacggtcgttaggaggtggcgtgggagtggagttcggtcgggtcggcctaccgtacctaactaagtaagaattactacaacgtaggttaacgtttcgagttacgaaggtacgttactaccgtttacgacgtagaccgaccaacgtaccgtaccggaccgtaaccgaaccgtacggttactaacgtagttacgggtaggttcggtaaggtacggttaccgtaaagttcgtacggaaggaaccgaccgacggttctagttacttaacgttcgtggtggtaccgagtacgacgttaccgtcctaaacggtacccggggacgggtacccgggtacccgttggttacgtacggttacgggtcggaaccggtaccgggacccgttggtaccggttaccccg

SEQ ID NO: 237744 - DNA, 787 bp, Homo sapiens
  misc_feature: GYAE6OF01DYPNU.42.74.G08.1.454.CMB.1.raw
  modified_base (133)..(133): a, c, t, g, unknown or other
  misc_feature (133)..(133): n is a, c, g, or t
  modified_base (173)..(173): a, c, t, g, unknown or other
  misc_feature (173)..(173): n is a, c, g, or t
  modified_base (228)..(228): a, c, t, g, unknown or other
  misc_feature (228)..(228): n is a, c, g, or t
tcagtgacgtatgtcacgaccggtgctcgatttagtagctctatcaggggacccaacaaccacatccctcctcagaagcccccagagcacaactcctaaccatggactggacctggagatccttctttttggnggcagcagccacaggtcggccactcccaggtccactttgngcagtcgtggggctgaggtgcaggacggcccgggcctcgagtgacgtactttccngacacggtcttgtaggactacgacgtcttagaagtttagttatcgtactatacgtaggttcgggacgtcccgccggtaaccgggacccccggaaacgaacgggtcgttacgggtaggtcgggcggtacgggggtagttcgggtacgttccgggtcggggtcggtacctaaccgttaacctaaacgtaagtaaagtaactttaacgtacgtaaacgtaaggttaacgtttactagttaaccgagtacttaccgtaactttacgacgtacggaccgtacacgttaccgacccggagaaacccgctaacggtacctaagttaacggcggtttaagtacgggttaggtacgtaaccgttaggtacttaccggaggaacgtaccgtacggttctttacggttaacgttacgtttagtcgggtacggtacgaaggttactcggtacggtaccctaacggggacccggtaaccgggggtaacccgttaccgttacggttttacgaacccggtttaccgggaaccgggacccggttaaaccgggtcccgttagggtcccccggtacc

SEQ ID NO: 237745 - DNA, 737 bp, Homo sapiens
  misc_feature: GYAE6OF01CZMGM.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggagatcctcttttggtggcagcagccacaggtggccactcccaggtccactttgtgcagtctggggctgaggtgcagaaggccccggggtctcgaggtgacgtatttcccgtggacgaaggtctttaccgtgggtaataccgaagtcttctagttagtttaatgtactataacgtagtgggtcggccgcccgaccgggtccccccggaacgaaaacggtccgttaggaggtacgggcgttaggggtagtgggtaagtcgggttccgggttagggcctaccctaaccgtaaaccgtaataaaaggtatacttacgaacgtaaggtaagttttaccgaagtttcgaaggttagtaccctaaccttttagccgtaacggtaccgtaaactaacctccgtaacccggacccgtaccgaaccgtaacggttactaacgtacgtacgggttaagtgggtaagtacgggtaaccgtaaagtatacgtaagaacgtaccgtacggtcgttagtaccttattacgtgttggacgagtaggatcgtacccttacgaccgggtaaccggtcggggtaccctaacgtttcgaagttaggtccgggaccggtacggacccgtgtacccgtacccg

SEQ ID NO: 237746 - DNA, 642 bp, Homo sapiens
  misc_feature: GYAE6OF01BSOZJ.42.74.G08.1.454.CMB.1.raw
  modified_base (297)..(297): a, c, t, g, unknown or other
  misc_feature (297)..(297): n is a, c, g, or t
  modified_base (445)..(445): a, c, t, g, unknown or other
  misc_feature (445)..(445): n is a, c, g, or t
  modified_base (479)..(479): a, c, t, g, unknown or other
  misc_feature (479)..(479): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggcccactcccaggtccactttgtgcagtcgtggggctgaggtgcagaacggcccggggcctcagtcgacgtatttcctgcaaggcttcgtggatacagtcttcagttagttatgctaatacgagtgggtgcgccgacggccccgganaacggctgagtggcgtgggagtggatcggtcggtggcacgtcctaactataagatattcgaacgagtaacgtttcgagttacaagtacgtacctactttagcgtagaccgaacacctactccggacgaaccgacgtacgttccgtaanacgtaggtaacgtggacgttcgggtaacctaagngtacgtcgaacgacgtacggacgttcgtactttaagttcgttaggtgacggagtagtagtccgtaccgtacgtaccggacgggtaacggggtaccctacgtttacggtacgtttaccgggtacggggaccccgtaggggaaccccttgggtccctaccccggg

SEQ ID NO: 237747 - DNA, 731 bp, Homo sapiens
  misc_feature: GYAE6OF01BMLWD.42.74.G08.1.454.CMB.1.raw
  modified_base (132)..(132): a, c, t, g, unknown or other
  misc_feature (132)..(132): n is a, c, g, or t
  modified_base (138)..(138): a, c, t, g, unknown or other
  misc_feature (138)..(138): n is a, c, g, or t
  modified_base (144)..(144): a, c, t, g, unknown or other
  misc_feature (144)..(144): n is a, c, g, or t
tcagtgacgtatgtcacgaccggtgctcgatttagtagctctatcagggacccaacaaccacatccctcctcagaacgcccccagagcacaactcctaaccatggactggacctggagatcctctttttggngcagcngccacnggtgccactcccaggtcctacgttttgtcgactaggtcgtggggctggaggtcacgaggaacggcccgggcctacgagtacgacgtactttcctcgacgtaaggtcttcgtaggactacgagtcttacgagttagtatgtacttatacgtaggtgggtcgccgtaccgaccggtaccccgaagaacggtcttaggacggtcggtcgtagggagtcggtacgttccggtcggtcgtacctacgtaccgtaagtaacgttaagtacttacttacgaacgttaagttactttacgtaacgttactacgtacgtaccttaacgttacgcgtaacggcctaaaccgtacgtaccgtacccgacgtaacgaacgttacgtacctaacgtaggtacgtaagtttgaacgttacggtaccgtaagtcttaccgaaggaacgtaccgacggttacttacgttaacctttgtacgttacgtacggaccgtaagcgttacgtcccgtaccgtaaaggacccggtaccgggtacgggtacccttagttacgtacggttaccgccgggtaccgaccgggttacccttcggtacccctcgg

SEQ ID NO: 237748 - DNA, 718 bp, Homo sapiens
  misc_feature: GYAE6OF01ENAO1.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacgaggtggccactcccgaggtcccactttgtgcagtcgtggggctggaggtgcaggaacggcccggggcctcgaggtgacgtactttccgtgacaaggtcttcgtaggatacgagtcttcgaaggttagttatgtctaagtacgtagggttgggtcgaccgaccggaccgggacccccggaacgaacggtcgttaggagggtcgggcggtaggggtagtcgggtacgttccgggtcgggtacggcctaacgttacctaaacgtagtaaagtattacttaccaagtaagttaacttgtagttacaaggtactacgttaccgtttaggaccgtaggaccgtaactaccgtacgtcccgacgacgacctacgtctacgaggtacggtaggttggacgtacggtactaagtactagagtaacgacgtacgtcgtacgttcttacgttacgtggtagacgagtagtacgttccgtaccgttaccgacggggtaccggtaccggggtaccttcggtttacgttacggttacgggtacggggacccggtaaccgggtaccccgttggtccccgtacccgg

SEQ ID NO: 237749 - DNA, 788 bp, Homo sapiens
  misc_feature: GYAE6OF01B9U1N.42.74.G08.1.454.CMB.1.raw
  modified_base (174)..(174): a, c, t, g, unknown or other
  misc_feature (174)..(174): n is a, c, g, or t
tcagtgacgtatgtcacgaccggtgctcgatttagtagctctatcagggacccaacaaccacatccctcctcagaacgccccagagcacaactcctaaccatggactggacctggagatccttcgttttggtgcagcagccacgaggtcgccacctccacggtccctagtttgncgagtcgtggggctaggaggtgacaaggaccggcccgggcctacgtaggtcgaaccgttcgttttccgacggaccgtaacgggttcctttacgtaggtaactaacgacgttccttagaaggttacgttatcgtactagtacgtaggtcggacgtcccgaccggaccgggacccccgtaacgaacggtcgttacggtaggtacggtcggtagggacgttcggtacggttaccggtcggtcggacctaccgtaaccgttaaacctaagtaacgtagttaacgtacctaacggtaaagttaacgtttacgtagttaacgtacgtaacgttaccttaaccgtttaacgacttaacggaccgtaaccgtacgtaccgttacccgacgtaccgaacgttacgtaccgttaacgagttaacggttacggttcggtaacggtcggtaaacccttagtaaccgtacgtaacggaaaccgtcgacccggttaagttccgttattaaccggttcgtacggtacgtacggtagaaccgtttagaccgtttcgaaccggtccggaccggtcggttacctaggttcgaacggtccgtacgggacctaccgggtactcggtcctacccg

SEQ ID NO: 237750 - DNA, 862 bp, Homo sapiens
  misc_feature: GYAE6OF01C824L.42.74.G08.1.454.CMB.1.raw
  modified_base (73)..(73): a, c, t, g, unknown or other
  misc_feature (73)..(73): n is a, c, g, or t
  modified_base (136)..(136): a, c, t, g, unknown or other
  misc_feature (136)..(136): n is a, c, g, or t
  modified_base (843)..(843): a, c, t, g, unknown or other
  misc_feature (843)..(843): n is a, c, g, or t
tcagtgacgtatgtcacgaccggtgctcgatttagtagctctatcgagggacccaacaaccacatccctcctnagacgccccagacgcacaactcctaaccatggactggacctggagacttccttcgttttaggnggcagcacgaccacaggtcggcctaccgtccccgtaggtcctacgtttgcgccgtagttccgtgggggccttaggacggttgaccgtaggaaccgggcccccgggggtccttagaacggttcggaccgttacttttcccgaggtaccgtaaacggttccgtttacgtaggtaactacccgtagtcccgttttaacgaaggtttaagtttaccgtagtaccttaacgtaacggtaggttacggggttccgtacccggacccggaacccggggtaaccccccgggaagttaaaaccggggtcgtttacggaacgggttacgggtaccgttaggggtacgttacggggtacgttcccgggtcgggtacggaccttacccgttacccgttaaaacacgttaaacgtacttacggtaaccaacgtaagttaacgtttaccggtagttaccgaagttccgtaccttacgttacgacgtacgacgaacacgtacctccggaccgtaacgactcgtaaccgtagtaacggtaggttagtacggaggtcgtaacgtagtacgtcgtaagacgaccgtacgtagtacgttaccttagtacggttgacggtaccgaggtaaaccgtcgtaccgtacccttacggaccgtaaaccggggcccgtaacccgttagtaccggttacgttacgggaccgggttaacccaccgggttaacccngggttccccttaaacccgg

SEQ ID NO: 237751 - DNA, 784 bp, Homo sapiens
  misc_feature: GYAE6OF01BH5NY.42.74.G08.1.454.CMB.1.raw
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
tcagtgacgtatgtcacgaccggtgctcgatttagtagctctatcaggggacccaacaaccacatccctcctcagaagcccccagagcacaactcctaaccatggactggacctggagatcctcttttggtggcagcagccacgacggtggccactcccaggtccactttgtgcagtcgtggggctggaggtgcaggaacggcccgggctcacgtgacgtatttccngacaggtcttcgaggatacngtcttcgagttagttatcgctatacgaggttgggtgccgaccgaccggacccccggaacaaacggtccgttaggacggtgggtccggttaggggacgttgggggaacgttccgggtacggggtcgggacccgtaccgttaacccgttaaacctaacgttaaaacgtattaaccgtttacctaaacgtaaaggttaaacggtttacgtacgtttacggacggtaacgttaccgtaaccccgttttaggacgtacggaccgtaactaaccgtacgtaccccgtaccggaaccgaaccgtacggttacgtaacctaaggtacgggttaacgttacggacgggttacggtaacctaagtacgtcgtaaggaacggaccgtacgggtctacggtactaagtttccgtaggtcgacggtagtacgtagtccgttaccgtaacggaaccggaccggggtacggggtacccttacgtttacggtaccgtttacgggtcggggtaccggtaaccgggttaccccggtcggtacccggtaaccccgg

SEQ ID NO: 237752 - DNA, 844 bp, Homo sapiens
  misc_feature: GYAE6OF01CLBKC.42.74.G08.1.454.CMB.1.raw
tcagtgacgtatgtcacgaccggtgctcgatttagtagctctatcaggggacccaacaaccacatccctcctcagaacgccccagagcacaactcctaaccatggactggacctggaggatccttcgtttttgggtggcagcacgccacgaggtcggccaccttcccaggtcctacttttgtcgctaggtcgtcgggggctggaggtgacgaggaaccggcccggggtccttcgagtcggtacgttacgtttcccgtaggaccgtaagggtcctttcggtagggaacttaacgacgtccgttcgtaaggtttacgtttagtcggtacttaacgtacgtacgggttggggtacgccggtacccggaccgggaacccccggaacggtaaacgggtccgttaggacggttcgggccggttaggggtagttacgggacggttccgggttcgggtaccgggtaccctaccgttaacccgttaaaacaacggttaaacgtaacgttacttaaccgtaacgttaaaggtttaaaccggttttacgtacggttacgtaaacgttaccgttaacgtttaacccgtttacgacgtaacggtccgtaaccgtaccgaaccggttacccgacggtaactacgtacgtacgtaacgtagtacggtaggttcggacgtacggttaacgtaagttcgaggtaacggacgtaccgtacggtccgtttattagtttacgtgtaggtcgtacgagtactcgtacgtaccgaggtaaccggtacgggtaccggtacgtttacggttcgtaaacgggttccgtacggggtaccgtaaccgggtaccgtcggttacccgtaccgg

SEQ ID NO: 237753 - DNA, 854 bp, Homo sapiens
  misc_feature: GYAE6OF01DEFRF.42.74.G08.1.454.CMB.1.raw
  modified_base (237)..(237): a, c, t, g, unknown or other
  misc_feature (237)..(237): n is a, c, g, or t
  modified_base (532)..(532): a, c, t, g, unknown or other
  misc_feature (532)..(532): n is a, c, g, or t
tcagtgacgtatgtcacgaccggtgctcgatttagtagctctatcaggggacccaaacaaccacatccctcctcagaacgcccccagagcacaacctcctaaccatggactggacctgggagattccttctttttgggtggcagcagccacgaggtcggccactcccgaggtcctactttgtcgcagtcgtggggctgaggtgcagacggcccgggcctcagtgacgtattttccgngaccgaagggtccttcgaggtaacttaacgcggtctttacgaaggtttacgttatcgtacttaagtaaccgtaggttggggtcgccggacccgaaccggggaccccccggaaagaaagggtcgtttcggaacggttggggaccgttggggaagtcgggtacgtccggggtcggggttcgggacttaaccttaaccgtaaactaagtaaaaccgtatttaagtactaacgaaggtttaacgtttgaacgttacgtaagtacgtctaaccgtttagacacggtaccaacgacgtacncccgggtacgaaacgaacgtactactaacgtaggttaacggtaggttacggtaacggtacgggtaaacccttaaggtaacgtttacgaacggaaaccggtaaccgttaccggggtctttaacggtttacctttaaaacggttttcgacggttcggaacggtaagtaacgggtccgttaacgtaccccggtaacggtaacccgggggtaaaccgggaaccgggggttccccttaaacgggttttacggtaaccggttaccggggttaacgggggtaaccccgtaacggggttaaccccggttacggtccccggttaaccccgg

SEQ ID NO: 237754 - DNA, 852 bp, Homo sapiens
  misc_feature: GYAE6OF01AYG0T.42.74.G08.1.454.CMB.1.raw
tcagtgacgtatgtcacgaccggtgctcgatttagtagctctatcaggggacccaacaaccacatccctcctcagaacgcccccagagcacaactcctaaccatggactggacctggaggatccttcgtttttggtggcagcagccacgaggtggccacctcccaggtccactttgtgcagtcgtggggctggaggtgcgaggacggccccgggcctcgagtgacgtactttccgtgacgaaggtcttcgtggtaattacgacgtcttacgagttagttagttcgacttagtacgtaggttgggtacgcccggtacccgacccggggacccccgggtaaacgtaaacgggttccgttacggtacgggtcgggtcgggttacggggaagttacgggtacggttaccgggttccggggtacgggtaccctaacccgttaacccgtttaaacgaaacgttaaacggtaattaccgtttaaccgaaaccggttaaagttaaacgggtttttaccgtaaggtttaccgtaacggttaacgtttaccgttacccgttttaacggaccgtaaccggtaccgaaccgtaccgtaaccgtcccggtaacggaaccgtaacgtaacgttaccctaaggtacggttagggtacggtttacggtaggttaccggtaaccgttaagtacgtacgtaggaacggtccgtacggtcgttacgttacgtacgtttacgtcgtaggtacgagtgtacgtactaccggtaacgaccgggtaacgggtaccggggtaaccttcgggttacgtacggtttaccggaccggggtacccggtaaccgggtacccgttcgggtaccccgtcccgg

SEQ ID NO: 237755 - DNA, 987 bp, Homo sapiens
  misc_feature: GYAE6OF01BJVGK.42.74.G08.1.454.CMB.1.raw
  modified_base (136)..(136): a, c, t, g, unknown or other
  misc_feature (136)..(136): n is a, c, g, or t
tcagtgacgtatgtcacgaccggtgctcgatttagtagctctatcgaggggacccaacaaccacatccctctcagaacgccccagagcacaactcctaacagtggactggacctggagtacttccttcgttttggnggcaggcagccaacgagggtcgcccacgttcccgaaggttccctacgtttggtcgacgtaggttccggtggggcgtaggaggttcgacgaacgggaaccgggccccgggtcctcggaggtacgaacgttcttttccgacggaccgtaaggttcctttcggtaagtaacgttaccgacgttcttaacgtaaggtttaacgtttacgtcgtaccgtaagttacggtagggttcgggaccgacccggtacccggtaacccgggacccccggaaaggtaacggtccggttaggtaaccggtcgggtacgggttagggtaacggttcgggtaaccggttccgggttaccgggtaccggtacccttaaccgttaaccccgttaaaagtacgtaaaggttacttaacgttacgaagtaacgtttaacgttacgtacgttacgtaacggtaccgttaacgttacgttacggaccgtaacggtcctaaacgacctaccgggttacccgaaccggtaccgtaactacggttaaccgtaagtacggtagggttaccgtaaggttaccggtagttaaccggtaacgtacggttacgaaacggtaaccggtaaccgttcggtaccgtttacgttaaccgttaggtttcccggtaagggtcgtaacgggtaacggttaccggttaccttaacccggggtaaccgttaaacccggggtcccggggtaaacccgggggtaccccggtttttaaccctttaacggggttaaaccgtttccgggggtaaaccccgggttacccggggggttaaaccccgtttaaacccgggggtacccgtttacccgggttaaccccggttaacccccg

SEQ ID NO: 237756 - DNA, 765 bp, Homo sapiens
  misc_feature: GYAE6OF01B3JWJ.42.74.G08.1.454.CMB.1.raw
  modified_base (132)..(132): a, c, t, g, unknown or other
  misc_feature (132)..(132): n is a, c, g, or t
tcagtgacgtatgtcacgaccggtgctcgatttagtagctctatcaggggacccaacaaccacatccctcctcagaagcccccagagcacaactcctaaccatggactggacctggagatccttcttttggnggcagcagccacaggtggccactcccaggtccactttgtgcagtcgtggggctgaggtgcagacgcccgggctcggtgacgtattcctgacaaggtcttctggactacagtcttcagttagttagtgactatacaggttgggtcgccgacccgaccgggacccccggaagaaacggtccgtttggaggtggccggttggggagttgggtacgtcgggtccgggtacggcctaccttacctaaaccgaagttaaacggaacttaactttcgaaacgtagttaaacgtttcctaggtttacaacggtacgttaccgttaacctttaagcgaacggtccgaacctaccgaacgttcccggaaccgaccgtaacctacgtacccgttaagtacggttagggtacgttacggacgtcgggtaaccttaagtactaccgttaaggaaccgtacgtaccggtcgttacgttacttacgtttacgtacggtcgtacggaagtacggacttaccggtaccttaaccggaccgggtaacggggtaccggggtaccccttaggtttccggaacggtttacccgggacgggggtaccccggtaacgggttaacccccggttcggtacccggtcccggttaccccg

SEQ ID NO: 237757 - DNA, 738 bp, Homo sapiens
  misc_feature: GYAE6OF01EB53F.42.74.G08.1.454.CMB.1.raw
  modified_base (134)..(134): a, c, t, g, unknown or other
  misc_feature (134)..(134): n is a, c, g, or t
  modified_base (248)..(248): a, c, t, g, unknown or other
  misc_feature (248)..(248): n is a, c, g, or t
tcagtgacgtatgtcacgaccggtgctcgatttagtagctctatcagggacccaacaaccacatccctcctcagaacgcccccagagcacaactcctaaccatggactggacctggagattccttctttttggnggcagcagccacgaggtcgccacctcccgaggtcctactttgtgctagttcgtggggctggaggtgcgaaggaaccgggtcccccggggcctcgaggtcgacgtacttttccgngacaaggtcttcgtagactacgagtcttacgtagttagttatcgtacttatacgtaggttgggtcgccgaccgaccgggacccccggaaagtaaacggtcgttaggtacggtggtcggtggggtaagtcgggtagttccggtcgggtcggacctaaccgtacccgtaaactaagttaaactattacgttaccgaactaaggttaactttacgtacgttacagtaacgttccttaaccgttagctaacggacgaacctaacgtacgtcccgaacggtaaccaacgtacgtactaacgagttacggaagtttacggacgtacggtaaccgttaagacgttacgtaacggaacaccggaggtcctttagtaccttaagttcgtagttagacgtacgaagtactaccggtaacctacggaccggacggggtaccggtacccttagttagtacgttacgggtccgggaacgtaccggaccgttcggaccgttccg

SEQ ID NO: 237758 - DNA, 799 bp, Homo sapiens
  misc_feature: GYAE6OF01ANQ2W.42.74.G08.1.454.CMB.1.raw
  modified_base (141)..(141): a, c, t, g, unknown or other
  misc_feature (141)..(141): n is a, c, g, or t
  modified_base (288)..(288): a, c, t, g, unknown or other
  misc_feature (288)..(288): n is a, c, g, or t
  modified_base (397)..(397): a, c, t, g, unknown or other
  misc_feature (397)..(397): n is a, c, g, or t
  modified_base (412)..(412): a, c, t, g, unknown or other
  misc_feature (412)..(412): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
tcagtgacgtatgtcacgaccggtgctcgatttagtagctctatcgaggggacccaacaaccacatccctcctcagaacgccccagagcacaactcctaaccatggactggaccgtggaggacttcctttcgtttttgggnggcagcacgaccacgtagggtcggacccaccgtcccgaggtccctacttttggcgactaggtcggtggggcttaggaggtgacagggaaccggtcccgggtcctagacggtcgaacggtactttccgaggacctaagggtcctttangggtaacctcgtacgtcctttacagggttttattacgtcgtacttagtaaccgtgggtcgggtggacccgaccggaccggggacccccggtaagaaccggtcgttaggnggtcggtaggtaggngtcggtcggtcggtgggcgtcaaccggtacctaanacgtaaancttaactacggtaaccgtagttaactttcggacgttagacggtttaactacctacggttacgaccgtacgaccgtaacgacccttaccgggaccgaaccgggtacgtaacccgtaggttacccttaggtaaggttacggttaaggtacgttccgggtaagtaacccgtaagtgttacccggtaaggtacccctaaggccgtacgtttacgggtttactacggtttacgtaggttccggaaggtaccgtagtaccttcgaccgttaaccggaacgggtcggtaccgggtctacttcggtacgtacggggtaccgacggaccgggtttacgccggtcccgttccgg

SEQ ID NO: 237759 - DNA, 759 bp, Homo sapiens
  misc_feature: GYAE6OF01A6VUH.42.74.G08.1.454.CMB.1.raw
  modified_base (123)..(123): a, c, t, g, unknown or other
  misc_feature (123)..(123): n is a, c, g, or t
  modified_base (130)..(130): a, c, t, g, unknown or other
  misc_feature (130)..(130): n is a, c, g, or t
  modified_base (142)..(142): a, c, t, g, unknown or other
  misc_feature (142)..(142): n is a, c, g, or t
  modified_base (171)..(171): a, c, t, g, unknown or other
  misc_feature (171)..(171): n is a, c, g, or t
  modified_base (193)..(193): a, c, t, g, unknown or other
  misc_feature (193)..(193): n is a, c, g, or t
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
tcagtgacgtatgtcacgaccggtgctcgatttagtagctctatcagggacccaacaaccacatccctcctcagaacgcccccagagcacaactcctaacatggactggacctggagatcctnttttggnggcagcagccanaggtggccacctcccaggtcctactttgngcagtcgtggggctggaggtgnaggacggcccgggctcgagtcgacgtatttccngactaaggtcttcgnggactaacgagtcttacgagttagttancgtacttaagtacgtaggttcgggtcgtaccggaccgtaacccgggacccccggtaaagaaccgggttacgttagggtacggtacggggtccgtaggggtacgttcggtacggtttccgggtacgggttacgggacctaaccgtacgtaaaacctaagttaaagtacttaacttaccgtaaacgtaagttaacggtttcaacggtttacgaacggtacgtacctaaccggtttagcgaacggacaacgactacgtcccgtacgaacgaaccgtacgtaacgtaacaaggttacggtacggtagacggtacggtaactaagtagtacgtaacgaacgtacgacggtacgttacgttctaacgttacgtagttagacggtaggacgtacgttaccgacgttaacggacgggtaacggtaccgggtaccttacggttacgtacgttacggtaccgggtaccggtaaccggtaacccggtgtacccgtaacccg

SEQ ID NO: 237760 - DNA, 780 bp, Homo sapiens
  misc_feature: GYAE6OF01D6D69.42.74.G08.1.454.CMB.1.raw
  modified_base (138)..(138): a, c, t, g, unknown or other
  misc_feature (138)..(138): n is a, c, g, or t
  modified_base (184)..(184): a, c, t, g, unknown or other
  misc_feature (184)..(184): n is a, c, g, or t
  modified_base (242)..(242): a, c, t, g, unknown or other
  misc_feature (242)..(242): n is a, c, g, or t
  modified_base (350)..(350): a, c, t, g, unknown or other
  misc_feature (350)..(350): n is a, c, g, or t
tcagtgacgtatgtcacgaccggtgctcgatttagtagctctatcaggggacccaacaaccacatccctcctcagaacgcccccagagcacaactacctaaccatggactggacctggaggactccttcgtttttggnggcagcagccacgaggtcggcccacctcccaggtccctacttttgngcctagtcgtggggctggaggtgacaggacggcccgggcctacaggtgactatttccngacgaggtcttcgtaggactacagtcttagagttagttgtctactagtacgtagggtccgggtaccgccgaccggtaccccggaagaacggttcgttaggaggttggnggtcgggagttgggaccgtttcgggtcgggtaccggtacctaaccgtacctaaactaagttaatacgtttactagtaacgtaaaggtttcttacgtacgtataaggtaccttaccttagtcggacaggacctacactacgtaccgacgaactacgtactctaagtacggtaggtaagtcggtaaggtaccgtaaagtacgtagtacgaacggtacgtaaccggtaccgttcgttaaacgttacgtttacgtttccggtagtacgggaaaccgggtaataccggttaccgtaccggtaaccggttaaacccgggaccgggtaccggggggttaaccctcccggtttttaaaggtcgggttaaccgtttaccggggaccccgggtacggtaacccccggggttacccgtacggtttacccggccccttaccg

SEQ ID NO: 237761 - DNA, 710 bp, Homo sapiens
  misc_feature: GYAE6OF01BD943.42.74.G08.1.454.CMB.1.raw
  modified_base (135)..(135): a, c, t, g, unknown or other
  misc_feature (135)..(135): n is a, c, g, or t
  modified_base (233)..(233): a, c, t, g, unknown or other
  misc_feature (233)..(233): n is a, c, g, or t
tcagtgacgtatgtcacgaccggtgctcgatttagtagctctatcaggggacccaacaaccacatcccctcctcagaacgcccccagagcacaactcctaaccatggactggacctggagatccttctttttggnggcagcagccacaggtcggccacctcccaggtcccacttttgtgcagtcgtggggctggaggtgcaggaacggcccgggcctcagtgacgtatttccngcaaggtcttcgtaggatacgagtcttacgagttagttatgacttatacgtaggtgggtcgccgaccgaccgggacccccggaagaacggtcgttgaggtggcgtgggagtggtacgtcggtcggtcggactacctacctaacgagtaagtattactacaacgtagtaacgttacagttacagtacgtactacgttagacacgacgtacactaccgtacgacgaaccgacgacgttactacgtagtggtagttcgaggtacgacgttaagacgtagtacggaacgtaccgacggttacgttacgtttacgttagttacgttggtacggtcggaaggtacgtacggttacgttacccgttaaccggaacgggtaacccggggtacccgggggtacccctttaacggtttcgtaacggtttaccgggtccggggtaacccgggtaaccgggttaacccgtccgggtacccgtaccccgg

SEQ ID NO: 237762 - DNA, 762 bp, Homo sapiens
  misc_feature: GYAE6OF01D3AY7.42.74.G08.1.454.CMB.1.raw
  modified_base (135)..(135): a, c, t, g, unknown or other
  misc_feature (135)..(135): n is a, c, g, or t
  modified_base (178)..(178): a, c, t, g, unknown or other
  misc_feature (178)..(178): n is a, c, g, or t
tcagtgacgtatgtcacgaccggtgctcgatttagtagctctatcaggggacccaacaaccacatccctcctcagaacgccccagagcacaactcctaaccatggactggacctgggagatccttctttttgggnggcagcagccacgaggtcggccactcccgaggtcctactttgngcagttcgtggggctggaggtgcaggaacggcccggggtctcgaggtgacgtacttttccagcgtaaggtccttacgaggtactacgagtcttcgaagttagtatcgtactagtacgtaggtgggtcgaccggtaccgaccggggacccccggaaagtaaaacgggtccttagggtacgggtgggtaccggtggggtaaggttgggtacggttccgggtcggggtacgacctaccttacaaacgtagtaaagtacttataccaacgtaagtttacgttctagttacgagtaccgtactacgttagacaacggtacaacacgtacgtccgaaccggtacgtacgtacgttactaacgtggtacggtaagggttcgtacgggtacggtaaccttaaggtaactcgggtaaacggtaaccggacgtacggtaccgtttagttacgtttactttacggtcggttaggacgtaggtacgtacgttaaccgtaccgttaacggaccggggtaccgggtacgggtacccttaagtttcggaggttccgggtacggtaccgggtacccggtaccgggttcgacccgttaccg

SEQ ID NO: 237763 - DNA, 883 bp, Homo sapiens
  misc_feature: GYAE6OF01C6HEQ.42.74.G08.1.454.CMB.1.raw
  modified_base (251)..(251): a, c, t, g, unknown or other
  misc_feature (251)..(251): n is a, c, g, or t
tcagtgacgtatgtcacgaccggtgctcgatttagtagctctatcaggggacccaacaaccacatccctcctcagaacgccccagagcacaactcctaaccatggactggacctggagactccttctttggtggcagcagccacgaggtggccactcccgaggtcctacgtttgtgcaggtcgtggggctaggaggtgacgtaggaaccggccccggggtaccttcgaggtcggaaccgttacttttccgngaccgtaacggtcctttcgaggacttaacgagtcctttacgaggttagttaatcgtacttaacgtacgtagggtcgggtacgcccggacccggaccgggtacccccgggaaacgaaacgggtccgtttagggaagggttcgggtaccggttggggtaacgttacggggtaacgttcggggttaccggggttcggtaacccgtaaccctttaacccgttaaaacgtaaacgttaaaacggtaacttttaacgttaaccgaaccgttaaaggtttaaacgtttttccgaaacgggttttacaaacggttaccgttaccgttaacccggttttacgacgaacggtacgaacctaaccgtaccgtaccggaccggtaaccgaacgtacgtacgtaactaggtacggtaggttcggaggtacggtaccgtaaagcgttacgtaacgaacgtacgtacggtacgttacgtacttacgttacgtcggtacggacggtagaacgttagtaccgtacccgttacggaacccggtaacggggtacccgggtacccgtttaacgtttacggttaaccgttacccggggttaccgggtaacccgggtacccgggttaaacccggtcggttacccgtaaccccgg

SEQ ID NO: 237764 - DNA, 958 bp, Homo sapiens
  misc_feature: GYAE6OF01CA9J7.42.74.G08.1.454.CMB.1.raw
  modified_base (138)..(138): a, c, t, g, unknown or other
  misc_feature (138)..(138): n is a, c, g, or t
  modified_base (280)..(280): a, c, t, g, unknown or other
  misc_feature (280)..(280): n is a, c, g, or t
  modified_base (314)..(314): a, c, t, g, unknown or other
  misc_feature (314)..(314): n is a, c, g, or t
tcagtgacgtatgtcacgaccggtgctcgatttagtagctctatcgaggggacccaacaaccacactccctcctcagaacgccccagagcacaactcctaaccatggactggacctggagtacttccgttcttttggnggcagcagccacgagggtcggacctacgtcccgaggtccctacgtttggtcgctacgttcggtcgggggcttagggaggttcgacgaagggaaccgggtcccccggggtacctcggacggtcggaaccgttacttttcccgnggacgtaacgggtcctttacggtagaactaccgngtacctttcaaggtttagtttacgcgtaccttagtaccggtaggtcgggtacgacccggtacccgaccgggaacccccggaagtaacggtccgtttagggacggttcggtccggttaagggtgtacggttcggttccggtacggtcggtacctacttacccgtaaagtaacggtaatacgttactaacgtaacggtacggttaagtttccggagttacgtacggttaaccttaccgttaacgttacggaacgtacgtaaccgtaaccgtaaccgttaccgggtaccccggaaccggtaaccgtacggttaaccgtaaccgtttacggtaaacggggtttggtttaacggggttacccggtaagggtttacccgtaacccgtttaaaaggtcggttaaccggttaagaaacccgggttacgtaaccggttcgttttacgttaacgttttaaccggtacgttacgggaccgggttaacgacgtttaaacgggtcgtttaaccggtaaccctttaaaccggggaacccgggggtttacccggggtaacggggtttaccccttaggttttaccggtaaaggttacccgggggtaaccgggtacccgggttacccggtaaacccggtttccgggcccgtttaaccccgg

SEQ ID NO: 237765 - DNA, 793 bp, Homo sapiens
  misc_feature: GYAE6OF01B896Q.42.74.G08.1.454.CMB.1.raw
  modified_base (232)..(232): a, c, t, g, unknown or other
  misc_feature (232)..(232): n is a, c, g, or t
tcagtgacgtatgtcacgaccggtgctcgatttagtagctctatcaggggacccaacaaccacatccctcctcagaagcccccagagcacaactcctaaccatggactggacctggagatccttcttttggtggcagcagccacaggtggccactcccaggtccactttgtgctagtcgtaggggctggaggtgcgaagaacggcccgggcctcgagtgacgtactttccgngacgaaggtctttacgaggtaactacgtagtccttacgaagttagttaactgtacttaactacgtaggttgggtcgaccgtccgaaccggacccccggaagtaaacggtcgtaggaggtcggtcgtagggtagtcggtacgttccgggttacgggtacggacctacctacctaaacgtaagtaagtaactactttaccaacgttaggttaacttttcgacgtttacgaaggtaccttaccgtaaccgtttacgacgaccggacccgtaactaccgtacgtacccgggaacctaaccgacgtaacgttctaaagtacggttagggtacgtaggacggtacgtaaccgtaagtaccgtcgtaacggaaaccggtccgtacggtacgtttaacggttaacctttacgttaccgtaggttcggacggaagttacggttaccgtaccgtttaccgaaccgggtacggaaccggggttccccggtaacccttacgtttaggtaacccgttacggggtacccggtaacccgggtaaccgggttaacccgtggttacccccttaaccgg

SEQ ID NO: 237766 - DNA, 783 bp, Homo sapiens
  misc_feature: GYAE6OF01EA1AA.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacgaggtcggccactcccgaggtcctactttgtgcaggtcgtggggctggaggtgcgaaggaacggccccgggggcctcgaggtgacgtacttttccgtgaccgaacggtcttcgtagggtactacgacgtccgtttacgaaggtttaagtttaacgtgtactaacgtaaccgtaggggtgggtcggacccgacccggaacccggggtaccccccggaaacgtaaaggtcgttacggaggtcggacggtaggggtagtggtacggttccggtacggggtcgacctactacccgtaaataacgtaagtattactagacgtaagtaagtttcgagttacgaagtacgtaccttaacgttagacgtacgacgactactacgtccgaacgaccgtaacgacgttaacctaagagttacgggtaggttacggtacggtacggtaccgtaaagtccgttacgacggtaaaccgtacgtaaccgggttcttaacgttacttacgtttacgtggtaacgacggagtacggtactaccggtacccgtaacgggacccggtacggggtaacccggccctttaaggttaccgtacggttaaccgggtccgggtaacccgaacgggtttaccgccggttacgtacccccgg

SEQ ID NO: 237767 - DNA, 900 bp, Homo sapiens
  misc_feature: GYAE6OF01CLODA.42.74.G08.1.454.CMB.1.raw
  modified_base (134)..(134): a, c, t, g, unknown or other
  misc_feature (134)..(134): n is a, c, g, or t
  modified_base (181)..(181): a, c, t, g, unknown or other
  misc_feature (181)..(181): n is a, c, g, or t
tcagtgacgtatgtcacgaccggtgctcgatttagtagctctatcaggggacccaacaaccacatccctcctcagaacgccccagagcacaactcctaaccatggactggacctggagattccttcttttaggnggcagcacgccacgaggtcggaccacgtcccgaggtcctacgtttgngctagtcgtggggctggaggtcgacgtaacggaaccggcccccggggtacctacgtacggtcgtaaccggttaccttttccccgaggaccgtaagggtcctttacggtacgggaacttaccgacggtacctttacgaaggttagttaacgtcgtacttaagtacgtagggttcgggtcgtcccgacccggaccgggacccccggaaagtaaacgggtcgtttaaggacggttcggaccggtaggggtacgtcgggttacgtccgggtaccgggtacggtcccaaccgtttaacccgtaatacggttaaagtaacgttacgttaccgaacgttaacggtttaacgttttacgaacgtttagaacggttacgttaccgttaaccgtttagaacccgaggtaacccaaccgtacgtaccgtcccggtaacggaccgtacgtacggttacctaaggtaggttacgggtaacgtttggtaccggtacggtaaccgtaagtcgttaccgaacgggtaacgtaccgggaacgttccgtaacgttacgtttaacgttccggaggttaccggtaacggtaacgacggttccgttaaccgtacccgttaaccgggaacgggtacccggggtacccggtttaccgtttaacggtttcggtaacccgggtttccgggacccgggtacccggtaaccggttaacccccgggtgttaccccgttaaccccggg

SEQ ID NO: 237768 - DNA, 865 bp, Homo sapiens
  misc_feature: GYAE6OF01EYAGU.42.74.G08.1.454.CMB.1.raw
  modified_base (757)..(757): a, c, t, g, unknown or other
  misc_feature (757)..(757): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtcccactttgtgcagtcgtggggctgaggtgcagaacggccccggggcctcgagtcggaacgtacttttccgtgaccgtaaaggtcctttaccgttagggaacttacctacggtcctttacgaaggtttaagttaacttcggtacttaagtaaccgtaggttcggggtcggccggacccgtacccggggaccccccggaaagtaaacgggtcgttacgggaggttggggtccggtagggggtacgtacggggtacgttaccggggttccggggtcggtaccgtaacccgtacccgttaaaactaagttaaaacggtaactttaacgttacctaaagtaaacggttaacgtttaaccctaggttacccaaaggttaaccgttacccttaaaccgtttacgggaaccgaacggtacccgtaaccgtaacccgtacgttaacccccgggaacgtaaacccgtaacgtaacgggtttacccctaaaaggtaccgggttaagggttaacggtttcgggaacggttcggaacccgttaaagtacgtacgtacggaacgtaccgtacggtcttaggttaccttattacgtgacgaacgganagttaactccgtaccctaaaggccgggaacgggtaccgggtaccttacggttaggtacccgttagggtcccggggtaacgaaccgggttcctccggtaccctacccgg

SEQ ID NO: 237769 - DNA, 771 bp, Homo sapiens
  misc_feature: GYAE6OF01BBQCI.42.74.G08.1.454.CMB.1.raw
  modified_base (178)..(178): a, c, t, g, unknown or other
  misc_feature (178)..(178): n is a, c, g, or t
  modified_base (236)..(236): a, c, t, g, unknown or other
  misc_feature (236)..(236): n is a, c, g, or t
tcagtgacgtatgtcacgaccggtgctcgatttagtagctctatcaggggacccaacaaccacatccctcctcagaacgcccccagagcacaactcctaaccatggactggacctggaggactccttctttttggtggcagcagccacaggtggccactcccgaggtccacgttttgngcagtcgtggggctggaggtgcaggacggccccgggcctcgagtgacgtactttccgngcgtaacggtcttcgtaggactacgagtcttactaaggttagttatcgtacttaacgtacgtaggtcgggtacgccgtacccggaccgggtacccccggaacgtaaacgggtccgttacggtaacgggtcgggtacggtacggggtaggttcgggtaccgttccgggttcgggtacggtacctaaccgtaccctaaacgtaagtaaacgtaagttacgttacgaacgtaaggttaacgtttacgtaagttacgacgtacgttacctaacctttagactacggcgaactacacgtccgacgacgtactacgtactacgtagtaggtagtaggtcgtacggtaccgtaagtcgtacgtaagacgtacgacgtcgttacgtattacgttacgtgtaccggagacgtagtacgttaccgtaccttaaccgggaccgggtaccgggtaccggggttacccttacgggtttacgtaacggttccgggtaccggggaacccggtaaccgggttacccgttcgggtaccccgttaaccccggg

SEQ ID NO: 237770 - DNA, 876 bp, Homo sapiens
  misc_feature: GYAE6OF01B557E.42.74.G08.1.454.CMB.1.raw
  modified_base (142)..(142): a, c, t, g, unknown or other
  misc_feature (142)..(142): n is a, c, g, or t
  modified_base (155)..(155): a, c, t, g, unknown or other
  misc_feature (155)..(155): n is a, c, g, or t
  modified_base (189)..(189): a, c, t, g, unknown or other
  misc_feature (189)..(189): n is a, c, g, or t
  modified_base (639)..(639): a, c, t, g, unknown or other
  misc_feature (639)..(639): n is a, c, g, or t
tcagtgacgtatgtcacgaccggtgctcgatttagtagctctatcgagggacccaaacaaccacatcccctcctcagaacgcccccagagcacaactcctaaccagtggactggacctgggagacttcccttcgtttttggnggcagcacgccanacgggtcgccacctcccgaggtcctacgttttgngccgtagtcggtggggactggaggtgacaggaaccggccccggggtcttacggagtcgtaaccgtactttccgagtacgaggttccttcgttaggacttacgcgttcttacgaaggtttattacgtcgtacttaacgtaacgtggggttcggtacggcccggaccggaacccggtacccccggaaaacaacggggttcgttacggaggtttcgggacggttggggaacgtttacgggccgtttcggggttccggtcggtacccttaaccgttaaccgaaacttaagacgtaattacgtaaccaagttaacgttagtttactaacggttcgaagggtcttaccctaacgttgaacgacggacctaactacccggtaacgtacccggacgaaccggtacctagtacccgtagtagggttgtaacggttggaccggttacacggttaaacgtntaccggttaaagacggtaccgtacggttaccttcgttaaacgttacgttacggtaggtacggacgtaacgtacggttaccgtaccgtttaaaccccggaaccggaccggggggtaacccgggttaccgggttaaccctttaacggttacggggtaaaaccgggttttccccggggaacccgggttaacccggggtaacccgggtttaaccccgggtcgtttaccccccggtaacccg

SEQ ID NO: 237771 - DNA, 1057 bp, Homo sapiens
  misc_feature: GYAE6OF01E4OK9.42.74.G08.1.454.CMB.1.raw
  modified_base (142)..(142): a, c, t, g, unknown or other
  misc_feature (142)..(142): n is a, c, g, or t
tcagtgacgtatgtcacgaccggtgctcgatttagtagctctatcaggggacccaacaaccacactccctcctcagaacgcccccagagcacaacctcctaaccatggactggacctgggaggacttccttcgtttttgggnggcagcagccacgaggtcggccaccgttcccggtacgtacctttacgtttggtcgacgtacggtcgggtgggtcgtaggggtaggtcggacggaaacgggacccggggccccgggtaccttacggtaggtacggtaaccgttttccgtttccgtacgaacggtacgttccgttcgtacggtaactaccggttaccgttccgttaacgtttaagttttaagttacgttcgttaacgttaacgttacggtcggggttacgggtccggaccccggacccgggaacccccgggaacccgggtaaaacggtaaccggttcggttaacgggtacggggttcgggtacggggttaggggtaacggttacggggttccggtttccgggggtaccgggttaccgtaacccttaaacccgtttaaaacctaaaacggttaaaacgttaatttaacgtttactaaacggtaaacgtttaaacggttttaaccgttaacggtttaaacgtaccggtaaacgtttacccgtttaaccgtttaacgttaacgtaccaaccgggttacccaaccgtaacccgtaccgtaccgggaaccgtaccgtaacgttacttaccgtaaggttaacgggttacgggttaggtttacggacgggttaaccgttaaaccgtaagttacgtaagggtaaaccgacggtaccgtacgttccggttaactttacgttttaacggttgttaccggaacggttaggaaacggttaccttaacggtacccggttaccggaaaccgggtaacccgggggttacccggggttaacccgttaccggtttttaacgggttacgggtttaaccccgggttaccggggtaacccgggggtaaacccggttaccgggtttaaccccgggtcccgggttacccgttacccccg

SEQ ID NO: 237772 - DNA, 950 bp, Homo sapiens
  misc_feature: GYAE6OF01E15JL.42.74.G08.1.454.CMB.1.raw
tcagtgacgtatgtcacgaccggtgctcgatttagtagctctatcaggggacccaacaaccacatccctcctcagaacgccccagagcacaactcctaacatggactggacctggagacttccttcgtttttggtggcagcacgccacgaggtggccactcccaggtcctactttgtgacagtcgtggggctggaggtgcgaggacggcccgggcctcgagtgacgtatttccgtcgacgtaacggtccttcgtaggtactaccgagttccttacgtaagtttagttactcgtacttaacgttacgtagggttcgggtcggcccgacccggaacccggggtacccccgggaaacgtaacggttcgttacggtggttccgggtccggtagggtaaggtcggggttacgttccggggttacgggtccgggtaccctaacccgttacccgttaaacgtaaacgttaaacggtaactttaaccgttaccggtaaaaggttaaccggtttaaacgttttacgtaaacgttttccgaaacggtttaccgtttaacccgttacgttttaaacccgggacgaccgtaaccgaccttaaaccgtcccgttaacccggaaccgttaaccgtaccgtaacgttaccgttaacgtaacggttacgggttacgtttaaccgggacgggtttaaccggaaccgttaaaggtaaccccgttaggtaaccggaaaccgttaccgggacccggtttccgtttaacgttaacggtttaaccgttacgttacgggtacggaaacggtacgtaacggtaaccgttccggttaaaccccgtaaacgggtaccggggtaaccccgggtacggggttttaaaccccttggtttaaccgggttaaccggttaccggggtacccggggtaacccggaaccccgggtttacgtcccggttaccccgtacccccggg

SEQ ID NO: 237773 - DNA, 739 bp, Homo sapiens
  misc_feature: GYAE6OF01EPHTQ.42.74.G08.1.454.CMB.1.raw
  modified_base (133)..(133): a, c, t, g, unknown or other
  misc_feature (133)..(133): n is a, c, g, or t
  modified_base (178)..(178): a, c, t, g, unknown or other
  misc_feature (178)..(178): n is a, c, g, or t
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (251)..(251): a, c, t, g, unknown or other
  misc_feature (251)..(251): n is a, c, g, or t
tcagtgacgtatgtcacgaccggtgctcgatttagtagctctatcaggggacccaacaaccacatccctcctcagaacgcccccagagcacaactcctaaccatggactggacctggagatcctgtttttggnggcagcagccacgaggtcggccactccccgaggttcccactttgngcagtcgtggggctggaggtncaggacgcccgggctcagtgacgtatttccngacaaggtcttcgtgataacngtcttcgagttatagtgactatacgaggtggtgccgaccgaccggaccccgaacgaaaggcgttggaggtggacgtggggatgggacgttcggtacggttcggactaccgttaaccctaaactaactaaagtaagttacttaccgaacgtaaagttaacgtttactaaggttacaaggtacgttacctaaccgtttagacgtacggaaccgtacaacgtacgttacccggaccggtaaaccgaacgtaacgttacctaacgtacgttacgggtagttcggaaggttcgggtaacctaaagtacttacggtaagaaacggaccgaacggtcgttagttaccgttaagtttacctaggttgaacggtagacgtacgtacggttacccgtaacgaacggggtacccgggtaacgggggccccttaacgggttacgtaacgtttacgggtccggggtaaccggaaccggttacccggtagggtccctacccg

SEQ ID NO: 237774 - DNA, 1096 bp, Homo sapiens
  misc_feature: GYAE6OF01BBW82.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatccttcttttggtggcagcagccacgaggtggccactcccgaggtccactttgtgctagtcgtggggctgaggtgcgaaggaacggcccggggcctccgaggtcggacgtacttttccgtagacgaaggtcctttcgtaggaactaacgtagtcctttacgtaaggttaacggtttagtcggtacttaacgtaaccgtaagggttcggggtacggtccccggtaacccggtaacccggggtaccccccggggtaaaaggtaaaccgggttccgtttaacggggtacgggttccggggtaccggggttacggggggttacggtttaaccgggggtaacggtttacccgggggttccgggggttacgggtacccttaaaccccgggtttaaacccgtttaaaaaaccggtaaaacggttttaaaacggtaaaccgttttaacccttaaccggtaaaacccggtttaaacgggtttaaaacggtttttaccccggaaacggtttaacccggaaaaccgggtttaaccggttaaccccgtttaaaacccggttttacggacccggtaaacggtaaccccggtaaaaccctaaacccggtaacccgttaacccgggtaacccggtaaaccccggtaacgttaaccggtttaccgtaaaacgttacccgggttaaggggttaaccgggttacggaaaccgggtttccgggtaaaacccgttaaggttaaacccgtacgggttaagggaaaaccgttaccgggtaccgggttaactttaccgttaaaccggttttacttaccgggtttacggtaaccggtaccgggtaagggtcgtttaaaccgtccccgggttaaacgttaaccgggaacccgggtaaccgggggttaccggggtaccctttacggtttaagaacccgggtttaccgggtaccggggaaaccccgtttaacggggaccccgttccggtaacccggtaccccg

SEQ ID NO: 237775 - DNA, 902 bp, Homo sapiens
  misc_feature: GYAE6OF01C21Z5.42.74.G08.1.454.CMB.1.raw
  modified_base (135)..(135): a, c, t, g, unknown or other
  misc_feature (135)..(135): n is a, c, g, or t
  modified_base (147)..(147): a, c, t, g, unknown or other
  misc_feature (147)..(147): n is a, c, g, or t
  modified_base (181)..(181): a, c, t, g, unknown or other
  misc_feature (181)..(181): n is a, c, g, or t
  modified_base (269)..(269): a, c, t, g, unknown or other
  misc_feature (269)..(269): n is a, c, g, or t
tcagtgacgtatgtcacgaccggtgctcgatttagtagctctatcaggggacccaacaaccacatccctcctcagaacgccccagagcacaactcctaaccatggactggacctgggagactccttcgttttggnggcagcagccanaggtcggcctactcccgaggtccctacgttttgngccagttccgtggggctaggacggtgacgaacggaaccgggtccccggggtcctacgtacggttacggaaccggttacttttccccgnggaaccggtaaagggttcctttaccgtacgggaactacgtaacggttcctttaccggaaggtttagtttaacgtcgtaacttacgtacggtaagggttcggggttacgcccggtacccggaccggggtaccccccggaagtaaaacgggtccgttttagggaacggtttacggggcggttaggggtactttacggggtaacgttcccggggtacggggtaccgtccgtaacccgttaccttaaaaccgtaggttaaaccgtaaacgtttcgtttaacgaaactaacggtttaaccgtttacggttacggttaacgtacgttaaccgtaaccgtttaacccgttcggtaaccgttaaacggccgtaaaactccctaaccggttacccggaaccggttaccgaccgttaacgtacttaaaccgtggttagggtaacgttcggtaacgtccgtaaacgtaacgtactagacggtaacggtaccgacggttacgttacgtacttacgttacgtacggttacgaacggtgaacgttacgtcgtaaccgttacggaccgggtacggtaccggttaccttacggttacgtaaccggtacggtccgggtaacccgtacgggtaccctggtaaccgttcccg

SEQ ID NO: 237776 - DNA, 749 bp, Homo sapiens
  misc_feature: GYAE6OF01C3JDS.42.74.G08.1.454.CMB.1.raw
  modified_base (135)..(135): a, c, t, g, unknown or other
  misc_feature (135)..(135): n is a, c, g, or t
  modified_base (142)..(142): a, c, t, g, unknown or other
  misc_feature (142)..(142): n is a, c, g, or t
  modified_base (177)..(177): a, c, t, g, unknown or other
  misc_feature (177)..(177): n is a, c, g, or t
  modified_base (240)..(240): a, c, t, g, unknown or other
  misc_feature (240)..(240): n is a, c, g, or t
  modified_base (625)..(625): a, c, t, g, unknown or other
  misc_feature (625)..(625): n is a, c, g, or t
  modified_base (631)..(631): a, c, t, g, unknown or other
  misc_feature (631)..(631): n is a, c, g, or t
tcagtgacgtatgtcacgaccggtgctcgatttagtagctctatcgaggggacccaacaaccacatccctcctcagaacgcccccagagcacaactcctaaccatggactggaccgtggagatccttgttttggnggcagcngccacaggtcggccactcccgaggtcctactttgngcagtcgtggggctaggagtgcgaaggaaccggccccgggctagaggtcgacgttacgttccnggacgtaacggtccttgtaggaattacgaacgttccttagtagttagtttagtcgtacttagtaaccggtgggttagggccggacgacccggacccgggaccccggaacgtaaacgggtcgtacgggaggttcgggacgtagggtagtcggcggtccgggttcggcggacctaaccgttaccgaaagtaagtaacgtacgttaactaccgaagttaacgtaacgttttacgacgtttacgaagttaccggtacctttacgtacgacgtaacgaccgtaactaccggtacgcccggtacgtaacgatacgtactacgtagtaggtaagttcggagtacggatacgatacgacgtacacggtcgtacgttcgtaacttgttaaccgngggtanacgggtaactaacggtcgttaccgaaccgtacgggaaccgggtacgggaccggttaccgttagttaccgtacggttacgggacgggacccggttacggacccgtggtccctaaccccg

SEQ ID NO: 237777 - DNA, 959 bp, Homo sapiens
  misc_feature: GYAE6OF01AUPTH.42.74.G08.1.454.CMB.1.raw
  modified_base (184)..(184): a, c, t, g, unknown or other
  misc_feature (184)..(184): n is a, c, g, or t
  modified_base (254)..(254): a, c, t, g, unknown or other
  misc_feature (254)..(254): n is a, c, g, or t
tcagtgacgtatgtcacgaccggtgctcgatttagtagctctatcaggggacccaacaaccacatccctcctcagaacgccccagagcacaactcctaaccatggactggacctgggacggatccttcgtttttggcggtcagccacgccacgaggtggccaccgtcccaggtcctacgtttgngcagtcgtggggctaggaggtcgcacggaacggccccggggtccttcgagtcggaaccgtattttcccgnggtaccgaacggtcctttcgtacggtaactaccgtaggtctttaccgtaaggttaggttacacggtacttaagtacgtagggttcgggtcgacccggaccccgaccggggtaacccccggtaagaaaccggggtccgttagggtaaccgggtcggggtacggttagggtacggttcgggtacgtttaccggggttccgggtacggacccttaaccgttaccctaaaagtaaccttaaaggtacttaacggttaaccgaacgtaaggttaaaccggtttctaacggtttaacggtaaactacggtttaacccttaaccgtttaggtacccgaacggtccgtaaacctaccgtacggtaccccgaacggttaaccgaaacttcggttacctaaaccgtaggttaccggggtaacttacgggtaaccgttcccggaaacgttacgtaacgtacgttaacggaaacgtacccgtaggttaccgtttacggtaaccctttaacgggttacttagggtaccgggttaaacggtgtaaaccgggttccttcggtttaaacccccgggttaagggaaacccggggttaccgggggacccgggtttaaacccctttcgggttttaaccgggttaaccggttaacccgggtacccgggggtaaccccgttaaaccccgggggttaccccttaccggggggttcccctaaccccgg

SEQ ID NO: 237778 - DNA, 800 bp, Homo sapiens
  misc_feature: GYAE6OF01EKU6J.42.74.G08.1.454.CMB.1.raw
  modified_base (121)..(121): a, c, t, g, unknown or other
  misc_feature (121)..(121): n is a, c, g, or t
  modified_base (134)..(134): a, c, t, g, unknown or other
  misc_feature (134)..(134): n is a, c, g, or t
tcagtgacgtatgtcacgaccggtgctcgatttagtagctctatcgaggggacccaacaaccacatccctcctcagaacgcccccagagcaccaactcctaaccatggactggactggagntccttgttttggngcagcagcacgaggtgccactccaggtcctactttgtcgctagtcgtggggactgaggtgcgaggaccggcccgggcttcgaggtcgacgtatttccgagtccaaggtcttcgtaggataccgagcttacgagttacgttaactgcttaactacgtaggttgggcgacccggtaccgacccgggaccccggtaaacgtaaaccggttcgttaggtacgggtcggtaccggtaggggtacgtagggtcgttcgggttaccgggtccggtaccgtaacccgttaccgtaaacgttaagttaacgtaatttaaccgtaccgtaacggttaacgttaaacggttttcgtaacggtttacgaacggttaccttaaccgtaaccgttttacgacgtaaccggtacctaacccgtaacgtaacccgtaccggtaaccgtaaccgtaaccgtaacgttaccgtaacgtacggttaggtacggttaaggtacgtcggtaactagtacgtacggtagaaccgtacgtacggtcgttactcgtttagtaccgttggtaccgtagtaacgtgtaccgtcgtaccgtaacggtaccgggtaccggtaccgggttccgttaacggtcgtaccggttaaccggtcggaacccggtaccggtccggttcgtcccgtaccccg

SEQ ID NO: 237779 - DNA, 791 bp, Homo sapiens
  misc_feature: GYAE6OF01DYZIZ.42.74.G08.1.454.CMB.1.raw
tcagtgacgtatgtcacgaccggtgctcgatttagtagctctatcaggggacccaacaaccacatccctcctcagaacgcccccagagcacaactcctaaccatggactggacctggagatccttctttttggtggcagcagccacaggtggccactcccaggtcctactttgtgcagtcgtggggctggaggtgacgagacggcccgggctcagtgacgtatttcctgacgaaggtcttcgtagatacagtcttcagttagttatgtacttatacgtaggtcgggtacgcccggtaccgaccgggaccccggaagaaacggtccgttggaggtcggacggttggggattagggtacgtcgggtcggtcgacctaccgtacctaaacgtaagttaagtacttactacgacgtaagttacgttacgtagtagacgtaacgttctaacgttacgactacgaccgtactacgtacgtcccgacgaaccgtaactacgttacgtaacgtagtacggtagttaggtacgtacggtaccgttaaagtactaggtaacgaacggtaaccgtacccggttagtttacctttacgtttacgttacgttgtacggtaacggtacgaaaggtttccctacgggttaaaccccttaaacggggtacccgggaaaaccggggttccccggggttaaaccctttacggtttaaaccgggttaacgggttaaccccggggtccggggaaaccccgggtttaaacccggggttaccccggtaccgggtttacccccgttaaccccgg

SEQ ID NO: 237780 - DNA, 774 bp, Homo sapiens
  misc_feature: GYAE6OF01A4UPT.42.74.G08.1.454.CMB.1.raw
  modified_base (149)..(149): a, c, t, g, unknown or other
  misc_feature (149)..(149): n is a, c, g, or t
  modified_base (234)..(234): a, c, t, g, unknown or other
  misc_feature (234)..(234): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
  modified_base (453)..(453): a, c, t, g, unknown or other
  misc_feature (453)..(453): n is a, c, g, or t
tcagtgacgtatgtcacgaccggtgctcgatttagtagctctatcaggggacccaacaaccacatccctcctcagaagcccccagagcacaacctcctaaccatggactcggacctggaggtatcctcgttttggtggcagcagcccanaggtgaccactcccgaggtccactttcgtgctacgtcgtggggtctgaggtgcagacggcccgggcctcgagtgacgtatttccngactaggtccttcgtaggattacgagtccttcgaagttagttagtcgacttagtacgtaggttggggtcgccgcccgtaccggccccccggaacgaagggtccttggacggtggtccgnggggtatagggtntcggtcgggtcgcgtacctactaaacagtaagtacgtattactacgtagtacgtttcagttacgaagtacggtacctacccgtttanacgacgtacgaaccctacgtacgtcccggacgaccgaccgtacgttctaaccgtagtaggttaagttacgggtagggttccggtaacgtaagtactaccgtaaggtacggaaccgtaccgtacgttccgttaccgttaacgttaccgttaggttaccggtacgaggtaacgtacgtaaccggttaccgttaacccggtaccggtaacccggtacccggggggtaccccttacccggtttaggttaacccggtttaccgggttaccggggtacccgggttaaacccggggtacccgttacccgggtacccggttacccccgg

SEQ ID NO: 237781 - DNA, 522 bp, Homo sapiens
  misc_feature: GYAE6OF02GQG66.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcactcctaacataagatattcacagaagtttcagttcagagtcacctttagcagcgacacatccgcgacgacagtctacatggagttgagtggcctaagatctgaagacacggctgtctattactgtgcgagagatgccttacgacggacggacggggcccacgtttcgagttacgtggggccaggggaccctggtctacccg

SEQ ID NO: 237782 - DNA, 516 bp, Homo sapiens
  misc_feature: GYAE6OF02IS85H.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctggggatgggatcgtcggtggcactcctaacataagatattcacagaagtttcagttcagagtcactttagcagcgacacatccgcgacgacagtctacatggagttgagtggcctaagatctgaagacaggctgtctattactgtgcgagagatgccttacacgacgaggggcccaactttgattacgtgggccagggaaccctggtctacccgg

SEQ ID NO: 237783 - DNA, 520 bp, Homo sapiens
  misc_feature: GYAE6OF02I8Q8J.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaggcttgagtggctgggatggatcgtcggtggcactcctaacataagatattcacagaagtttcagttcagtagtcacctttagctagcgacacatccgcgacgacagtctacatggagttgagtggcctaagatctagaagacacggctagtctattactgtgcgagagatcgcttacacggacggacggggccacgtttgagttacgtcgggaccagggtacctggtctaccg

SEQ ID NO: 237784 - DNA, 513 bp, Homo sapiens
  misc_feature: GYAE6OF02GK5P2.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcactcctaacataagatattcacagaagtttcagttcagagtcacctttagcagcgacacatccgcgacgacagtctacatgagttgagtggctaagatctgaagacacggctgtctattactgtgcgagagatgccttacacgacggaggggcccacgtttgattacgtgggccagggaccctggtctacccgg

SEQ ID NO: 237785 - DNA, 519 bp, Homo sapiens
  misc_feature: GYAE6OF02IE05X.42.74.G08.1.454.CMB.1.raw
  modified_base (285)..(285): a, c, t, g, unknown or other
  misc_feature (285)..(285): n is a, c, g, or t
  modified_base (369)..(369): a, c, t, g, unknown or other
  misc_feature (369)..(369): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctgggatggatcgtcggtggcactcaacataagatattcacagaagttttcagttcagagtcacctttancagcgacacatccgcgacgacagtctacatggagttgagtggcctaagatctgaagacacggctgtctattactgtgcgagagatgcttacacggacgacggggcccacgtttgagttacgtcggggccagggaaccctggtctacccgg

SEQ ID NO: 237786 - DNA, 532 bp, Homo sapiens
  misc_feature: GYAE6OF02GBBDR.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtcttggggctgaggtgcagaagcccggggcctcagtgacgatttcctgcaaggcttctggatacagcttcagtagttatgctatacagtgggtgcgccaggcccccggacaaaggcttgagtggctgggatggatcggtcggtggcactcctaacataagatattcacagaagtttcagttcagagtcacctttagcagcgacacatccgcgacgacagtctacatggagttgagtggacctaagatctagaagacgacggctagtctattactgtgcgagagatgtccttacgacggacggacggggccctacgtttgagttacgtcgggaccacgggtaccctggtcctacccgg

SEQ ID NO: 237787 - DNA, 538 bp, Homo sapiens
  misc_feature: GYAE6OF02J1GQP.42.74.G08.1.454.CMB.1.raw
  modified_base (283)..(283): a, c, t, g, unknown or other
  misc_feature (283)..(283): n is a, c, g, or t
  modified_base (380)..(380): a, c, t, g, unknown or other
  misc_feature (380)..(380): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggctcagtgacgatttcctgcaaggcttctggatacagcttcagtagttatgctatacagtgggtgcgccaggcccccgganaaaggcttgagtggctggatggatcgtcggtgcactcctaacataagatattcacagaagtttcagttcagagtcactttagcagcgacacatccgngacgacagtctacatggagttgagtggactaagatctgaagcacggctgtctagttactgtgacgagagatgacccttacgacggaacggacgggggccctacgtttagacgtttacgtcgggggaccctaggggaaccccttggtacccgtacccgg

SEQ ID NO: 237788 - DNA, 518 bp, Homo sapiens
  misc_feature: GYAE6OF02I62RW.42.74.G08.1.454.CMB.1.raw
  modified_base (219)..(219): a, c, t, g, unknown or other
  misc_feature (219)..(219): n is a, c, g, or t
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (419)..(419): a, c, t, g, unknown or other
  misc_feature (419)..(419): n is a, c, g, or t
  modified_base (462)..(462): a, c, t, g, unknown or other
  misc_feature (462)..(462): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagagcccgggctcagtgacgatttccngcaagacttctggatacagcttcagtagttangctatacagtggtgnccgcaggcccccganaagcttgagtggctgggatggatcggtcgtggcactcctaacataagatatcacagtaagttcagttcagtagtctacctttagctagcgtacacatccgacgacgacagtactacatagagtagagtgactaagatntagaagacacgctgtactatactgtgcgagagatgacttacgncacggacggaccgtacgttacgtacgttacgtacggtacggtacggtaccgtacgg

SEQ ID NO: 237789 - DNA, 531 bp, Homo sapiens
  misc_feature: GYAE6OF02GG2CF.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacgggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcactcctaacataagatattcacagaagtttcagttcagagtcacctttagctagcgacacatccgcgacgacagtctacatggagttgagtggcctaagatctgaagacacggctgtctattactgtgcgagagagtgccttacacgacgacgggggccctacgttgacttacgtggggccaagggtaaccctgggtaccgaccggttaccg

SEQ ID NO: 237790 - DNA, 544 bp, Homo sapiens
  misc_feature: GYAE6OF02JC0ER.42.74.G08.1.454.CMB.1.raw
  modified_base (285)..(285): a, c, t, g, unknown or other
  misc_feature (285)..(285): n is a, c, g, or t
  modified_base (439)..(439): a, c, t, g, unknown or other
  misc_feature (439)..(439): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggcctcagtgacgatttcctgcaaggcttctggatacagcttcagtagttatgctatacagtgggtgcgccacggcccccgganaaaggcttgagtggcgtgggatggagtcggtcggtggcactcctaacataagattattcacagtaagtttcagttcagagtcactttagcagcgacacatccgcacgacagtctacatggagttgagtggtacctaagattcagaagcaacggntagtctattacgtgtgcgagagatcgccttacgacggacggacggggtaccctagtttcgaagttacggtcggggaccacgggaaccccgttggtacctacccgg

SEQ ID NO: 237791 - DNA, 529 bp, Homo sapiens
  misc_feature: GYAE6OF02GRNMY.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcactcctaacataagatatcacagaagtttcagttcagagtcactttagcagcgacacatccgcgacgacagtctacatggagttgagtggcctaagatctgaagacacggctgtctattactgtgcgagagatgaccttacacggacggacggggcccacgtttcgagttacgtggggtaccgaggggtaaccctgggtacctacccgg

SEQ ID NO: 237792 - DNA, 528 bp, Homo sapiens
  misc_feature: GYAE6OF02HCP0C.42.74.G08.1.454.CMB.1.raw
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctgggatggatcggtcggtggcacgtcctaacataaagatattcacagaatttcagttcagagtcacctttagcagcgacacatccgcgacgacagtctacatggagttgagtggacctaagatctgaagacaacggctgtctattactgtgcgagagatgccttacacggacggacggggccctacgtttcgattacgtggggccagggaacccttgggtctacccgg

SEQ ID NO: 237793 - DNA, 564 bp, Homo sapiens
  misc_feature: GYAE6OF02IYMBL.42.74.G08.1.454.CMB.1.raw
  modified_base (291)..(291): a, c, t, g, unknown or other
  misc_feature (291)..(291): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctgtggctgaggtgcagacgcccggggcctcagtgacgtatttcctgcaaggcttcgtggactacagtcttcagttagttatgctatacagtgggtgcgccacggcccccgganaacggcttgagtggcgtgggatggatcggtcggtggcactcctaacataagatattcactaagtaagtttcagttcagagtacctactttagcagccgaacacactccgacgacgactagtctacagtggtagtgaggtgtacctaagatcgtagaagacgacggcttgtacttattactgtgacgagagagtgaccttagaccggaacggacgggggccctacgttttagacgtttacgggtacgggaccgtacgggtacccgtggtacccg

SEQ ID NO: 237794 - DNA, 607 bp, Homo sapiens
  misc_feature: GYAE6OF02GTHX1.42.74.G08.1.454.CMB.1.raw
tcagtgacgtatgtcacgaccggtgctcgatttagtagctctatcgaaggggacccaacaaccacatccctcctccacgaacgcccccagagcacaactcctaaccagtggactggaccgtggaggatcctcttttggtggcagcagccacaggtggccactcccaggtccactttgtgcagtctggggctgaggtgcagaagcccggggctcagtgacgatttcctgcaaggcttctggatacagcttcagtagttatgctatacaggtgggtgcgccacggcccccggacaaaggcttagagtggctgggatggatcgtcggtggcactcctaacataaagactattcaacagtaagtttcagttcagtagtcctaacctttagcagtcgacacgactccgacgacgacagtctacgagtaggtagttggagttcgggaccttaaggattcgtaggaagacgacggacttcggtacttagttactgttgcggtagagtatcggtaccttacgacggaccggtaacgggggacccctaacgtttacggtagttaccggttacgggggacccgtaacggggtaaccccgttcgggtacctaccccgg

SEQ ID NO: 237795 - DNA, 518 bp, Homo sapiens
  misc_feature: GYAE6OF02I6YDD.42.74.G08.1.454.CMB.1.raw
  modified_base (285)..(285): a, c, t, g, unknown or other
  misc_feature (285)..(285): n is a, c, g, or t
  modified_base (493)..(493): a, c, t, g, unknown or other
  misc_feature (493)..(493): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctgggatggatcgtcggtggcactcctaacataagatattcacagaagttttcagttcagagtcacctttagcagcgacacatccgcgacgacagtctacatggagttgagtggcctaagatctgaagacacggctgtctattactgtgcgagagatgccttacacgacggaggggccctagtttgagttacgngggaccagggaccctggtcctaccg

SEQ ID NO: 237796 - DNA, 515 bp, Homo sapiens
  misc_feature: GYAE6OF02G0IOI.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcacctctaacataagatattcacagaagtttcagttcagagtcacctttagcagcgacacatccgcgacgacagtctacatgagttgagtggcctaagatctgaagacacgctgtactattactgtgcgagagatgccttacacgacggacgggccctacgtttgattacgtgggccacgggaccctggtctacccg

SEQ ID NO: 237797 - DNA, 520 bp, Homo sapiens
  misc_feature: GYAE6OF02GNWKQ.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcacgtcctaacataagatattcacagaagtttcagttcagagtcacctttagcagcgacacatccgcgacgacagtctacatggattgagtggctaagatcgtgaagacacggctgtctattactgtgcgagagatgcttacgacgacggaggggcccacgtttgagttacgtgggtccagggaaccctggtcctacccgg

SEQ ID NO: 237798 - DNA, 714 bp, Homo sapiens
  misc_feature: GYAE6OF02J01GN.42.74.G08.1.454.CMB.1.raw
  modified_base (223)..(223): a, c, t, g, unknown or other
  misc_feature (223)..(223): n is a, c, g, or t
  modified_base (291)..(291): a, c, t, g, unknown or other
  misc_feature (291)..(291): n is a, c, g, or t
tcagtgacgtatgtcacgaccggtgctcgatttagtagctctatcagggacccgaacaaccacatccctcctcagaagcccccagacgcacaactcctaaccatggactggacctggaggatcctcttttggtggtcagcagccacaggtggccacgtcccaggtccactttgtgcagtctggggctgaggtgcagagcccggggctcgagtgacgatttccngcaaggcttctggatacagcttcgagttagttatgcttatactaggtggtgcgccacgggcccccganaaaggcttgacggtgggctggggatgggactcggtcgggtggctaccgttaccgtaaacgtagttaaaggattagtttccgaaacgtaggtaaacgttttcaacgtttcgaacgtacggttctaacccgttttagcggtaagtccgtaacgacgtaacgtaccgtacgtaccgtaaccgtaacgtacgtaacgtaacgttacggtacggttacggtaggtacggtacgttaacgtaacgtacgttacgtaacggtaacgtacggtacgtacgttacgtacgttacgttacgttacgtactacgggggggggtaatagtacgttaccgttaaccgtaccggtaaccggtacggggtaccggtaccggttacgttacgttacgttacgggtaccggtacggtaccggtaccggtaccgtacccgg

SEQ ID NO: 237799 - DNA, 536 bp, Homo sapiens
  misc_feature: GYAE6OF02JC69H.42.74.G08.1.454.CMB.1.raw
  modified_base (286)..(286): a, c, t, g, unknown or other
  misc_feature (286)..(286): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (399)..(399): a, c, t, g, unknown or other
  misc_feature (399)..(399): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactccccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctgggatggatcgtcggtggcactcctaacntaagntatcacagaagtttcagttcagagtcacctttagcagcgacacatccgcgacgacagtctacntggagttgagtgactaagatctgaagacacggctgtctattactgtgcgagagatgccttacgacggacggacggggaccctacgtttagactttacggtcggggaccgacggggtaacccgtgggtacctacccgg

SEQ ID NO: 237800 - DNA, 542 bp, Homo sapiens
  misc_feature: GYAE6OF02IC2O4.42.74.G08.1.454.CMB.1.raw
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggccccgganaaggcttgagtggctgggatggatcgtcggtggcactcctaacataagatattcacagaagtttcagttcagagtcactttagcagcgacacatcgcgacgacagtctacatgagttgagtggctaagatctagagacaggctgtctattactgtgcgagagatcgaccttacaccggaacggtacgggggcccaacgttttcggacgtttacggtcggggtacccgtacggggaacccgttcgggtaccgtacccgg

SEQ ID NO: 237801 - DNA, 535 bp, Homo sapiens
  misc_feature: GYAE6OF02IDG1Q.42.74.G08.1.454.CMB.1.raw
  modified_base (222)..(222): a, c, t, g, unknown or other
  misc_feature (222)..(222): n is a, c, g, or t
  modified_base (285)..(285): a, c, t, g, unknown or other
  misc_feature (285)..(285): n is a, c, g, or t
  modified_base (329)..(329): a, c, t, g, unknown or other
  misc_feature (329)..(329): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttccngcaaggcttctggatacagcttcagtagttatgctatacagtgggtgcgccaggcccccgganaaagcttgagtggctgggatggatcggtcggtggcactcctaanataagatatcacagaatttcagttcagtagtctacctttagcagcgacacatccgcgacgacagtcacagtggtagttgagtggactaagatctgaagacacgctgtctattacgtgtagacgagagatcgaccgttacacggaacggtacggggaccctagttgtacgtacgtcgggtacccgacgggtaccctcggtctacccg

SEQ ID NO: 237802 - DNA, 519 bp, Homo sapiens
  misc_feature: GYAE6OF02FVLMD.42.74.G08.1.454.CMB.1.raw
  modified_base (428)..(428): a, c, t, g, unknown or other
  misc_feature (428)..(428): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactccccaggtccactttgtgcagtctggggctgaggtgcagaagcccggggcctcagtgacgatttcctgcaaggcttctggatacagcttcagtagttatgctatacagtgggtgcgccaggccccccggacaaaggcttgagtggctgggatggatcgtcggtggcactcctaacataagatattcacagaagtttcagttcagagtcacctttagctagcgacacatccgcgacgacagtctacatgagttgagtggcctaagatctgaanacacggctgtctattactgtgcgagagatgccttacacggacgacggggcccacgtttgattacgcgggccagggaccctggcctacccgg

SEQ ID NO: 237803 - DNA, 534 bp, Homo sapiens
  misc_feature: GYAE6OF02GWS0V.42.74.G08.1.454.CMB.1.raw
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctgggatggatcgtcggtggcactcctaacataagatatcacagaagtttcagttcagagtctacctttagcagcgacacatccgcgacgacagtctacatggagttgagtggctaagatcgtagaagacacggctgtctattactgtgcgagagtatgtccttacgacggacggacggggccctacgtttcgagtttacgtcggggccgtacgggaacccttggtcctacccgg

SEQ ID NO: 237804 - DNA, 532 bp, Homo sapiens
  misc_feature: GYAE6OF02IPT8O.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgcaggcccccggacaaaggcttgagtggctgggatggatcggtcggtgggcactcctaacataagatattcacagaagtttcagtttcagagtcactttagcagcgacacatccgcgaacgacagtctacatggagtgagtggccgtaaagatcgtgaagacacggctgttactattactagtgcgagagagtgaccttacgacggacggacggggcctacgttgtagttacgtcggggccagggacccgtggtctacccgg

SEQ ID NO: 237805 - DNA, 530 bp, Homo sapiens
  misc_feature: GYAE6OF02JGL8A.42.74.G08.1.454.CMB.1.raw
  modified_base (221)..(221): a, c, t, g, unknown or other
  misc_feature (221)..(221): n is a, c, g, or t
  modified_base (284)..(284): a, c, t, g, unknown or other
  misc_feature (284)..(284): n is a, c, g, or t
  modified_base (348)..(348): a, c, t, g, unknown or other
  misc_feature (348)..(348): n is a, c, g, or t
  modified_base (415)..(415): a, c, t, g, unknown or other
  misc_feature (415)..(415): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttccngcaaggcttctggatacagcttcagtagttatgctatacagtgggtgcgccaggcccccgganaaaggcttgagtggctgggatggatcgtcggtggcactcctaacataagatatcacagaatttnagttcagagtcacctttagcagcgacacatccgacgacacagtctacatggagttgagtggctaagnttctagaagacacggctgtctattactgtgcgagagatgtccttacgacggaacggacggggccctacgtttcgattacggtcgggtaccgacgggaaccctggtaccctaccgg

SEQ ID NO: 237806 - DNA, 521 bp, Homo sapiens
  misc_feature: GYAE6OF02F9ET4.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcggtcggtggcactcctaacataagatattcgcagaagtttcagttcagagtcacctttagcagcgacacatccgcgacgacagtctacatggagttgagtggcctaagatctgaagacacggctgtctattactgtgcgagagatgccttacgacggacggaggggcccacgtttgagttacgtggggaccagggaccctggtctacccgg

SEQ ID NO: 237807 - DNA, 597 bp, Homo sapiens
  misc_feature: GYAE6OF02H2IAS.42.74.G08.1.454.CMB.1.raw
  modified_base (285)..(285): a, c, t, g, unknown or other
  misc_feature (285)..(285): n is a, c, g, or t
  modified_base (387)..(387): a, c, t, g, unknown or other
  misc_feature (387)..(387): n is a, c, g, or t
  modified_base (426)..(426): a, c, t, g, unknown or other
  misc_feature (426)..(426): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtgggctgggatggatcgtcggtggcactcctaacataagatattcaacagaagtttcagttcagagtacacctttagcagcgacacatccncgacgacagtctacatggagttgagtggacctaagactntagaagacacggcttacgtctagttaactggttacgcgtagagtagtcgtaccgttaacgaccggaaccgggaacgggggtccccctaacgttttacgtaacgttttaccggtacggggggtacccctaacgggggtaaacccccttcgggggttacccttaacccccggg

SEQ ID NO: 237808 - DNA, 658 bp, Homo sapiens
  misc_feature: GYAE6OF02J3NSS.42.74.G08.1.454.CMB.1.raw
  modified_base (219)..(219): a, c, t, g, unknown or other
  misc_feature (219)..(219): n is a, c, g, or t
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccgggctcagtgacgatttccngcaaggcttctggatacagtcttcagtagttatgctatacaggtgggtgcgccaggcccccggaanaaggcttgagtggctgggatggatcggtcggtggcacgtacctaacataagatacttcaactagtaacgtttcagtttcagtacgtcctaacctttagcctagccgaacactacgtccgacgacgtacacgtactacgagttgggtagttagagtcggacctaaggtactcgtaggtaacgaccgtaacggtcttagttaccgtttaacgtttacgtgtacggacgaaggtacgtacgtaccggtacccgtttaacggaacccgggtaacgggtaccggggtaccccttaaggtttacggtaaccgtttaccgggtaccggggtaccccggttaaccgggtaacccccgttcgggtaccccgttaacccccgg

SEQ ID NO: 237809 - DNA, 548 bp, Homo sapiens
  misc_feature: GYAE6OF02HDO2P.42.74.G08.1.454.CMB.1.raw
  modified_base (331)..(331): a, c, t, g, unknown or other
  misc_feature (331)..(331): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttggagtgggctgggatgggatcgtcggtggcactcctaantaagatattcacagaagtttcagtttcagtagtctacctttagcaagcgtacacatccgcgacgacagtctacatcggtagttcgagtggcctaagatcgtagtaagacacggctagtctattacgtgtcgacgagagatcgactttacgacggaacggacgggggacccacgtttcgagttacgtcgggccgtacgggaccctcggtactacccgg

SEQ ID NO: 237810 - DNA, 526 bp, Homo sapiens
  misc_feature: GYAE6OF02GMIQG.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcactcctaacataagatattcacagaagtttcagttcagagtcacctttagcagcgacacatccgcgacgacagtctacatggagttgagtggcctaagatctgaagacacggctgtctattactgtgcgagagatgccttacgacgacggacggggccctagtttcgagttacgtggggaccaggggaccctcgggtactacccgg

SEQ ID NO: 237811 - DNA, 524 bp, Homo sapiens
  misc_feature: GYAE6OF02HWD06.42.74.G08.1.454.CMB.1.raw
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtggtgcgccaggcccccgganaaaggcttggagtggctgggatggatcgtcggtggcactcctaacataagatattcacagaagtttcagttcagagtcactttagcagcgacacatccgcgacgacagtctacatggagttgagtgaccgtaagatctagaagacacgcgtgtctattactgtgcgagagatgcctacgacgacggacggggccctacgttagagttacgtcgggaccgacgggaacctcggtctacccg

SEQ ID NO: 237812 - DNA, 526 bp, Homo sapiens
  misc_feature: GYAE6OF02HGO7O.42.74.G08.1.454.CMB.1.raw
  modified_base (221)..(221): a, c, t, g, unknown or other
  misc_feature (221)..(221): n is a, c, g, or t
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttccngcaaggcttctggatacagcttcagtagttatgctatacagtgggtgcgccaggcccccgganaaaggcttgagtggctgggatggatcggtcggtggcactcctaacataagatattcaacagaagtttcagtttcagagtcacctttagcagcgacacatccgcgacgacagtctacatggagttgagtggcctaagatctagaagacacggctgtctagttactgtgcgagagatgccttagaccgacggacggggccctagtttcgattacgtcggggaccacgggacctcggctacccgg

SEQ ID NO: 237813 - DNA, 521 bp, Homo sapiens
  misc_feature: GYAE6OF02GJ2TN.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcactcctaacataagatattcacagaagtttcagttcagagtcacctttagctagcgacacatccgcgacgacagtctacatggagttgaggtggcctaagatcgtgaagacacggctgtctattactgtgcgagagatgccttacacgcggaggggcccacgtttgattacgtggggcctagggaacccttggtcacccgg

SEQ ID NO: 237814 - DNA, 539 bp, Homo sapiens
  misc_feature: GYAE6OF02IG3X6.42.74.G08.1.454.CMB.1.raw
  modified_base (395)..(395): a, c, t, g, unknown or other
  misc_feature (395)..(395): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggccccgacaaaggcttgagtggctgggatggatcgtcggtgcactcctaacataagatattcacagaagtttcagttcagatcacctttagcagcgacacatccgcgacgacagtactanatggagttgagtggacctaagatctagaagacacggctagtctattactgtgacgagagatcgaccttacgacgaacggacggggaccctacgtttacgtagttacggtcgggaccgaacgggtaaccctcggtacctacccgg

SEQ ID NO: 237815 - DNA, 597 bp, Homo sapiens
  misc_feature: GYAE6OF02JGKJJ.42.74.G08.1.454.CMB.1.raw
  modified_base (280)..(280): a, c, t, g, unknown or other
  misc_feature (280)..(280): n is a, c, g, or t
  modified_base (396)..(396): a, c, t, g, unknown or other
  misc_feature (396)..(396): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagagcccgggctcagtgacgatttcctgcaaggcttctggatacagcttcagtagttatgctatacagtgggtgcgccaggccccgganaaaggcttgagtggctgggatggatcgtcggtggcacgtcctaacataagatagtcacagaagtttcagttcagagtctactttagcagtcgacacatccgcgacgacagtcctanactaggtagttgaagtggacctaaggatacgtagaagacgtacggcttgtacttattacgtgtcgacgtacgaagtacttacgaccgttaacgacggtaaccgggtaaccgggggtacccctaagttttaccggtaagttttaccggtacgggggtacccgtaaacggggtaaccccgttcgggttacccgtaaccccggg

SEQ ID NO: 237816 - DNA, 540 bp, Homo sapiens
  misc_feature: GYAE6OF02GPKM2.42.74.G08.1.454.CMB.1.raw
  modified_base (285)..(285): a, c, t, g, unknown or other
  misc_feature (285)..(285): n is a, c, g, or t
  modified_base (442)..(442): a, c, t, g, unknown or other
  misc_feature (442)..(442): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctggggatggatcggtcggtggcactcctaacataagatattcaacagtaagtttcagttcagagtcacctttagcagcgacacagtccgacgacgacagtctacatggagttgagtggcctaagatactagaagacgacggntgtactattactgtgcgagagatcgacttacgacggacggacggggacctacgtttgacgttacggtcgggaccgacgggtaccgtcggccgtacccg

SEQ ID NO: 237817 - DNA, 528 bp, Homo sapiens
  misc_feature: GYAE6OF02JFZGF.42.74.G08.1.454.CMB.1.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttctggatacagcttcagtagttatgctatacagtgggtncgccaggcccccgganaaaggcttgagtgggctgggatggatcggtcggtggcactcctaacataagatattcacagaagtttcagttcagagtcactttagcagcgacacatccgcgacgacagtctacagtcggagttgagtggcctaagatctgaagacacggctagtctattactgtgcgagagatcgccttacgacgaacggagggccctagtttgattacggtcgggaccagggaacccttggtacctacccgg

SEQ ID NO: 237818 - DNA, 666 bp, Homo sapiens
  misc_feature: GYAE6OF02HWZ2C.42.74.G08.1.454.CMB.1.raw
  modified_base (254)..(254): a, c, t, g, unknown or other
  misc_feature (254)..(254): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctgggctgaggtgcagagcccgggctcagtgacgtatttcctgcaaggtcttctggatacagtcttacagtagttangctaatacaggtggtgcgccgacggccccggaagaacggtcttggacgtggacgtgggatggattcggtcggtggcctacgtacctaaacagttaaacgtatacgtttcaacgtagttaagttttccgaagtttcgaagtacgttacctacctttagcctaacggcgaccaactacgtcgaccgacgactacgtactacgtagtacgggtagttcggtagtcggtaccgttaaagcttacgtaggaaacgaccgtacggtacgttacgttacttagttaccgtgttgaccggtagaagtacgtcgtacccttacggaccggtacgggtaaccggggtccctaacggtttacgtacgtttaccgggtacggggtaccgtaacccggggtaccgttacgggtacccgtacccgg

SEQ ID NO: 237819 - DNA, 664 bp, Homo sapiens
  misc_feature: GYAE6OF02G55LX.42.74.G08.1.454.CMB.1.raw
  modified_base (289)..(289): a, c, t, g, unknown or other
  misc_feature (289)..(289): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaacgcccggggcctcagtgacgtatttcctgcaaggcttcgtggatacagtcttcagtagttatgctatacagtgggtgcgccaggcccccgganaaaggcttgagtggctgggatggatcggtcggtggctacgtcctaacataagatattcatagtaagtttcagttcagagtctactttagcagcgacacactccgacgacgacacgtctaacagtggtagttgagtcggtacctaagtactacgtagaaagtaccgaacgggtcttaggttacctttaacgtttaccgtcggttacgaccgggtaaaggtaacggtacgttacggtaccccgttttaacggaacccggggtaaccggggtaaccggggggtcccccttaaggttttaccggtaacgttttaccgggtacggggggtaccccgtaacgggggtaaccccccgttcggggtacccgttaacccccggg

SEQ ID NO: 237820 - DNA, 533 bp, Homo sapiens
  misc_feature: GYAE6OF02FG65Z.42.74.G08.1.454.CMB.1.raw
  modified_base (328)..(328): a, c, t, g, unknown or other
  misc_feature (328)..(328): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcactcctaanataagatattcacagagtttcagttcagagtcacctttagcagcgacacatccgcgacgacagtctacatggagtgagtggcctaagatctagaagacacggctgtctattactgttgcgagagtatgtccttacgacggaacggacggggacccctacgtttgacgttacgtcggggaccacggggtaccctggtcctacccgg

SEQ ID NO: 237821 - DNA, 558 bp, Homo sapiens
  misc_feature: GYAE6OF02IMODL.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgaagaagcccggggcctcagtgacgatttcctgcaaggcttctggatacagcttcagtagttatgctatacagtggtgcgccaggcccccggacaaaggcttgagtggctggggatggatcggtcggtggcactcctaacataaagatattcacagaagtttcagttcagtagtcacctttagcagcgacacatccgcgacgacagtctacatggagttgagtggacctaagattcgtgaagacgacgctgtcttattactgtgcgagagatgccttacgaccggacggacgggggcccctacggttttcgacgtttaacggtcggggacccgtaacggggtaacccgtggttccgtacccggtcccg

SEQ ID NO: 237822 - DNA, 680 bp, Homo sapiens
  misc_feature: GYAE6OF02IU1Y4.42.74.G08.1.454.CMB.1.raw
  modified_base (257)..(257): a, c, t, g, unknown or other
  misc_feature (257)..(257): n is a, c, g, or t
  modified_base (289)..(289): a, c, t, g, unknown or other
  misc_feature (289)..(289): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagctttcgagttagttangcgtatacagtgggtgcgccaggcccccgganaaaggcttgacgtggctggatggatcggtggtcggcactcctaacgataagatattcacgagtaagtttcagttcagagtcactttagcagcacacactccgtacgacgacagtactacgactgggtagttcgaggtaggttacctaaagtagttaccgttagaaacgtaaccgaacgggtctacgttacgttaacgtttacgttacggttacggacccgggtaaaggtaaggtaacgttacggtaccccgtttaacggaacccgggaacccggggtaacccggggggtaccccttaaccggtttaacggtaaccgttttaacccgggtacggggggttaccccgtaaaccggggggtaaccccgtttacggggaccccggttaaccccgg

SEQ ID NO: 237823 - DNA, 534 bp, Homo sapiens
  misc_feature: GYAE6OF02IMA95.42.74.G08.1.454.CMB.1.raw
  modified_base (284)..(284): a, c, t, g, unknown or other
  misc_feature (284)..(284): n is a, c, g, or t
  modified_base (420)..(420): a, c, t, g, unknown or other
  misc_feature (420)..(420): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggcctcagtgacgatttcctgcaaggcttctggatacagcttcagtagttatgctatacagtgggtgcgccaggcccccgganaaaggcttgagtggctgggatggatcggtcggtggcactcctaacataagattatcacagaagtttcagttcagagtctacctttagcagcgacacatccgcgacgacagtcacagtggagttgagtgacctaagntctagaagacacggctgtcttattactgtcgcgagagatcgacttacgacggacggacgggccctacgtttcgacgtttacgcgggaccgagggtacccgtggtacctacccgg

SEQ ID NO: 237824 - DNA, 544 bp, Homo sapiens
  misc_feature: GYAE6OF02G90HS.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggctcagtgacgatttcctgcaaggcttctggatacagcttcagtagttatgctatacagtggtgcgccacggcccccggacaaaggcttgagtggcgtgggatggatcggtcggtggcactcctaacataagatattcactagtaagtttcagttcagagtactactttagcagcgacacactccgcgacgacagtctacataggagttgagtggacctaagatctagaacgaccgaggctcgtactattactgtcgcggagagatcggaccttacgacggacgggacgggtccctagttcgacgttacgtgggccgaacgggtaccctcggacctacccg

SEQ ID NO: 237825 - DNA, 520 bp, Homo sapiens
  misc_feature: GYAE6OF02GCLD2.42.74.G08.1.454.CMB.1.raw
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctgggatggatcgtcggtggcactcctaacataagatattcacagaagtttcagttcagagtcactttagcagcgacacatccgcgacgacagtctacatggagttgagtggcctaagatctgaagacaggctgtctattactgtgcgagagatgccttacacggacgaggggcccacgtttgatttacgcggggaccacgggaaccctggtacctaccgg

SEQ ID NO: 237826 - DNA, 594 bp, Homo sapiens
  misc_feature: GYAE6OF02JTIEE.42.74.G08.1.454.CMB.1.raw
  modified_base (186)..(186): a, c, t, g, unknown or other
  misc_feature (186)..(186): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (500)..(500): a, c, t, g, unknown or other
  misc_feature (500)..(500): n is a, c, g, or t
tcagtgacgtatgtcacgaccggtgctcgatttagtagctctatcagggacccaacaaccacatccctcctcagaagccccagagcacaactcctaaccatggactggacctggaggatcctctttttggtggcagcagccacaggtggccactcccaggtcccactttgtgcagtctgggctagnggtgcagaagcccgggctcgagtgacgtattcctagcaggcttcnggatacngcttcagtatatgctatacagtggtncgcacgccccganaacggctgngtggctgganggatcggcggtgctacgcctaagtntaagnttatcaacaggttaaactttcgagtccgagttacgtacctacgtttaggcaaggtccaacgactacgaccgtacgaaccgtacgaagttctaactatcgggtagtttacgaggtcgtacgtaagactcgagtacgcggtaacgtcgtagttacgttacgttaagttcggtacgnggtaacgtgacggtctaccgttacacggaacggtaccgggtccgtacgttaggtaccttggacgggtccgacgggttacctaccggtctaccgg

SEQ ID NO: 237827 - DNA, 570 bp, Homo sapiens
  misc_feature: GYAE6OF02HL8JJ.42.74.G08.1.454.CMB.1.raw
  modified_base (289)..(289): a, c, t, g, unknown or other
  misc_feature (289)..(289): n is a, c, g, or t
  modified_base (323)..(323): a, c, t, g, unknown or other
  misc_feature (323)..(323): n is a, c, g, or t
  modified_base (391)..(391): a, c, t, g, unknown or other
  misc_feature (391)..(391): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggctcagtgacgatttcctgcaaggtcttctggatacagcttcagttagttatgctatactagtgggtgcgccacggcccccggaanaaaggcttgagtggcgtgggatggatcggtcggnggcactccaacataagattatacacagtaagtttcagtttcagtagtactactttagcagcgacacanccgcgacgacagtctacagtaggtagttgagtcggtactaagactcgtagaagacgacgccgtgttactattacgtgtgagagagtatcgaccttacgaccggaacgggaccggggtaccctagtttacgagtttaccggtcggggacccgaacgggtaaccctcgggtacctacccgg

SEQ ID NO: 237828 - DNA, 620 bp, Homo sapiens
  misc_feature: GYAE6OF02HN45Z.42.74.G08.1.454.CMB.1.raw
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggcctcagtgacgatttcctgcaaggcttctggatacagcttcagtagttatgctatacagtgggtgcgccacggcccccgganaaaggcttgagtggctgggatggatcggtcggtggcactcctaacataagatattcaacagtaagtttcagttcagtagtctacctttagctagcgacacatccgcgacgacagtctaacatggaggttgaggttcggacccttaaagattaccgtaggaaacgacgaacgggccttagttactaagtttacctggttcgacggagtaagaacgttcggtaccctttaacgaaccggtaaccgggacgggggtacccctaacgtttacggaacgtttaccgggttacgggggacccgtaaccgggggtaaccccttcgggtacccgtaaccccgg

SEQ ID NO: 237829 - DNA, 559 bp, Homo sapiens
  misc_feature: GYAE6OF02HWEV5.42.74.G08.1.454.CMB.1.raw
  modified_base (288)..(288): a, c, t, g, unknown or other
  misc_feature (288)..(288): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgtatttcctgcaaggcttctggatacagcttcagttagttatgctatacagtgggtgcgccacggcccccgganaaacggcttgagtggctgggatgggatcggtcggtggcactcctaacataagatattcacagtaagtttcagttcagtacgtctacctttagctagcgacacatccgcgacgacagtcatatggagttaggagtggtacctaagatctagaagacgacgctagtctattacgtgtgcgagagtatgtccttacgacggtacggacggggtccctacgtttagtacgttacggtcggggtaccgtacggggtacccgtggtaccgtacccgg

SEQ ID NO: 237830 - DNA, 568 bp, Homo sapiens
  misc_feature: GYAE6OF02I4G8Y.42.74.G08.1.454.CMB.1.raw
  modified_base (223)..(223): a, c, t, g, unknown or other
  misc_feature (223)..(223): n is a, c, g, or t
  modified_base (284)..(284): a, c, t, g, unknown or other
  misc_feature (284)..(284): n is a, c, g, or t
  modified_base (328)..(328): a, c, t, g, unknown or other
  misc_feature (328)..(328): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactccccaggtccactttgtgcagtctggggctgaggtgcagaagcccggggcctcagtgacgatttccngcaaggcttctggatacagcttcagtagttatgctatacagtgggtgcgcaggcccccganaaaggctgagtggctgggatggatcggtcggtggcactcctaanataagatattcactagaagtttcagttcagtagtcacctttagctagcgacacatccgcgacgacagtctacatacggagttgaggtaggcctaagatactgaacgacacggctcggtactagttactgtcgtcgagtagattcgacctttaacgacggaaccggacgggggtaccctacgtttagaacgtttacggtcggggtaccgaacggggtaacccgtcgggtaccgtaccccgg

SEQ ID NO: 237831 - DNA, 531 bp, Homo sapiens
  misc_feature: GYAE6OF02FUO07.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcactcctaacataagatattcacagaagtttcagttcagagtcactttagctagcgacacatccgcgacgacagtctacatggagttgagtggacctaagatctagaacgacacggctgtctattactgtgcgagagatgccttacgacgacggacggggccctacgtttgacgttacgtcggggtaccgacgggaccctcggtctacccgg

SEQ ID NO: 237832 - DNA, 536 bp, Homo sapiens
  misc_feature: GYAE6OF02FQ3N3.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcggtcggtggcactcctaacataagatattcacagtaagtttcagttcagagtcactttagcagcgacacatccgcgacgacagtctacatggagtgagtggactaagatctagaagacacgctagtactattactgtgcgagagatcgacctacgacggaacggacggggccctacgtttcgagttacgtacggggacccgtagggtaccctcggtcgtacccgg

SEQ ID NO: 237833 - DNA, 664 bp, Homo sapiens
  misc_feature: GYAE6OF02JALZZ.42.74.G08.1.454.CMB.1.raw
  modified_base (221)..(221): a, c, t, g, unknown or other
  misc_feature (221)..(221): n is a, c, g, or t
  modified_base (293)..(293): a, c, t, g, unknown or other
  misc_feature (293)..(293): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagacgcccgggcctcagtgacgatttccngacaaggtcttcgtggatacagtcttcgagttagttatgactatacaggtggtgcgccgacggcccccgganaaaggtcttgagtggcgtgggagtggacgtcggtcggtgcctactacctaactataagacttattcaactagtaagttttcagtttacgagtacgttacctacctttagacacgaccgacacacgtccgacgtacgactacgtcctacgtagtagggtagttaggacgtcggaaccttaagtcttacgaagaacgtaccgacggtacttacgttacttacgtttacgtcggtacgtacggagtagtacgttacctacccgttaacggaaccgggtaccggggtaaccgggtaccctttacgtttacggaaccgtttccgggtacgggtaccccgtaaccgggttacccgtaccggttccgttaacccccgg

SEQ ID NO: 237834 - DNA, 541 bp, Homo sapiens
  misc_feature: GYAE6OF02HH2X8.42.74.G08.1.454.CMB.1.raw
  modified_base (330)..(330): a, c, t, g, unknown or other
  misc_feature (330)..(330): n is a, c, g, or t
  modified_base (401)..(401): a, c, t, g, unknown or other
  misc_feature (401)..(401): n is a, c, g, or t
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
  modified_base (462)..(462): a, c, t, g, unknown or other
  misc_feature (462)..(462): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacaggtggtgcgccgaggcccccggacaaaggcttgagtggctgggatggatcgtcggtggcactcctaanataagatattcacagtaatttcagttcagagtctactttagcagcgacacatccgacgacgacagtcctanagtcggtagttgagtcggactaagntactgaagacncgtctgtacttatatgtgcgagagntcgaccttacgacgacggacgggacctacgttacgtacgttacgtcggggaccgacgggtacccgttggaccgtacccg

SEQ ID NO: 237835 - DNA, 578 bp, Homo sapiens
  misc_feature: GYAE6OF02FR1QQ.42.74.G08.1.454.CMB.1.raw
  modified_base (294)..(294): a, c, t, g, unknown or other
  misc_feature (294)..(294): n is a, c, g, or t
  modified_base (411)..(411): a, c, t, g, unknown or other
  misc_feature (411)..(411): n is a, c, g, or t
tcagtgacgtatgtcacgaccggtgctcgatttagtagctctatcaggggacccaacaaccacatccctcctcagaagcccccagagcacaactcctaaccatggactggacctggaggatccttcttttggtggcagcagccacaggtggccactcccaggtccactttgtgcagtcgtggggctggaggtgcagaacggcccggggcctcgagtgacgtattttcctgcaaggcttctggatacagcttcagttagttatgctatacagtgggtgcgccacggcccccgganaaaggcttgagtggcgtgggatggatcggtcggtggcactcctaacataagatattcacagtagtttcagttcagagtctactttagcagcgacacactccgacgacgacagtctanagtggagttgagtggacctaagactcgtagaacgacgacggtctgtacgtatttacgtgtgcggagagtagtcgtaccttacgacggtacgggacggggtacccttacgtttcgtaagtttaccggcggggtacccgaacggggtaccccgtgggtaccctacccgg

SEQ ID NO: 237836 - DNA, 537 bp, Homo sapiens
  misc_feature: GYAE6OF02HA27B.42.74.G08.1.454.CMB.1.raw
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctgggatggatcgtcggtggcactcctaacataagatattcacagaatttcagttcagagtcactttagcagcgacacactccgcgacgacagtctacatggagttgagtggacctaagactctagaagacgacggctagtctattactgtgcgagagtatgtaccttagacggtacggacggggtccctaacgtttcgattacggtcgggaccacgggaaccctggtacctacccgg

SEQ ID NO: 237837 - DNA, 549 bp, Homo sapiens
  misc_feature: GYAE6OF02GWEGW.42.74.G08.1.454.CMB.1.raw
  modified_base (284)..(284): a, c, t, g, unknown or other
  misc_feature (284)..(284): n is a, c, g, or t
  modified_base (430)..(430): a, c, t, g, unknown or other
  misc_feature (430)..(430): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctgggatggatcggtcggtggcactccgtaacactaagatattcacagaagtttcagttcagagtcactttagctagcgacacatccgacgacgacagtctacatggagttgagtggacctaagatctgaanacacggctagtctattacctgtgcgagagtatgccttacacggaacggaggggcccctaacgtttacgacgtttaccgtcggggacccgtaacggggtaacccctggtacctaacccgg

SEQ ID NO: 237838 - DNA, 537 bp, Homo sapiens
  misc_feature: GYAE6OF02GKLLV.42.74.G08.1.454.CMB.1.raw
  modified_base (284)..(284): a, c, t, g, unknown or other
  misc_feature (284)..(284): n is a, c, g, or t
  modified_base (402)..(402): a, c, t, g, unknown or other
  misc_feature (402)..(402): n is a, c, g, or t
  modified_base (439)..(439): a, c, t, g, unknown or other
  misc_feature (439)..(439): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggcctcagtgacgatttcctgcaaggcttctggatacagcttcagtagttatgctatacagtgggtgcgccaggcccccgganaaaggcttgaggtggcgtgggatggagtcggtcggtggcactcctaacataagatattcacagtaagtttcagttcagagtcactttagcagcgacacactccgcgacgacagtctanatggagttgagtggacctaagatctgaagacgacggntgttctatttactgtgcgagagagtcgccttacgacggacgggacgggccctacgtttgagttacgtcggggccaacgggtaccctcggtccgtaccg

SEQ ID NO: 237839 - DNA, 522 bp, Homo sapiens
  misc_feature: GYAE6OF02FSAOE.42.74.G08.1.454.CMB.1.raw
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctgggatggatcggtcggtggcactcctaacataagatattcacagaagtttcagttcagagtcacctttagcagcgacacatccgcgacgacagtctacatggagttgagtggctaagatctgaagacgacgctgtctattactgtgcgagagatgcttacacggtacggacggggccctacgtttgagttacgtcggggccagggtaccctggtcctaccg

SEQ ID NO: 237840 - DNA, 544 bp, Homo sapiens
  misc_feature: GYAE6OF02FTYV9.42.74.G08.1.454.CMB.1.raw
  modified_base (286)..(286): a, c, t, g, unknown or other
  misc_feature (286)..(286): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccacggcccccgganaaaggcttgagtggctgggatggatcgtcggtggcactcctaacataagatattcacagaagtttcagttcagagtcacctttagctagcgacacatccgcgacgacgacgtctacagtggagttgagtggactaagatctagaagacacggctagtctattacgtgtgtacgagacagttcgacgttacacggtacggacggggccctacgttacgtagttacgtcgggtaccgacgggtacccgtggtctacccgg

SEQ ID NO: 237841 - DNA, 588 bp, Homo sapiens
  misc_feature: GYAE6OF02GGIO2.42.74.G08.1.454.CMB.1.raw
  modified_base (285)..(285): a, c, t, g, unknown or other
  misc_feature (285)..(285): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggctcagtgacgtatttcctgcaaggtcttctggatacagcttcagttagttatgctatacagtggtgcgccacggccccganaaggcttgacgtggcgtgggatggatcggtggtggcactacctaacataagattatacacaagtaagtttcagtttcagtagtactactttagcagcgacacatccgacgacgacatcactagtggagttgagtggacctaagatctaganaccgacgngtagttacttagttcgtgtggacgtagaagtgtacgtcccgttaacgaccggtacggggaaccggggtccctaagttttacggtaacgtttaccggacggggtacccgtaacggggtaaccccgtttaggacccgttaacccgg

SEQ ID NO: 237842 - DNA, 565 bp, Homo sapiens
  misc_feature: GYAE6OF02IZOSK.42.74.G08.1.454.CMB.1.raw
tcagtgacgtatgtcacgaccggtgctcgatttagtagctctatcaggggacccaacaaccacatcccttcctcagaagcccccagacgcacaaactcctaaccgatggactggacctggaggatcctctttttggtggcagcagccacaggtggccactccccaggtccactttgtgcagtctggggctgagtgcagagcccgggctcagtgacgatttcctgcaaggcttctggatacagcttcagtagttatgcgtatacagtgggtgcgccacggcccccggacaaaggcttgagtggctgggatggatcgtcggtggcacgtcctaacataagatattcacagtaagtttcagttcagagtcacctttagcagcgacaacatccgacgacgacagtctacatggagttgagtggctaagactctagaagacacggctcgtctattactgtcgacggagagtactcgtaccttacgacggtacggtaacggggcccctaacgtttcgacgtttaccggtcggggtacccgacggggtaacccgttcgggtacctaccccgg

SEQ ID NO: 237843 - DNA, 685 bp, Homo sapiens
  misc_feature: GYAE6OF02GYQ4W.42.74.G08.1.454.CMB.1.raw
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
  modified_base (330)..(330): a, c, t, g, unknown or other
  misc_feature (330)..(330): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagagcccgggctcagtgacgatttccngcaaggcttctggatacagtcttcagtagttangctatacagtggtgcgccgacggccccggagaaaggcttggagtggcgtgggatggatcggtcggtggcacgtcctaanactaagataattcacagtaagtttcagttcagtagtactacctttagctaaggcgtaacacacgtcccgacgtacgacgtaacgtactaactagtacgggtagttcggaacgttcggacctaaaggtacgtaccgttaggaaacgccgtaaacggtccttagttaccgtttaaacgtttaccgtggttacgaaccgtaggtaaaccggtattaccggtaccctttaaaccggacggtaacccgggggtaaccggggttaccccttaacgttttacggtaaccggtttaaccgggtaccggggggttacccgtaacccgggggtaacccgtttaccgggaccctttaacccccggg

SEQ ID NO: 237844 - DNA, 594 bp, Homo sapiens
  misc_feature: GYAE6OF02JGLVP.42.74.G08.1.454.CMB.1.raw
  modified_base (285)..(285): a, c, t, g, unknown or other
  misc_feature (285)..(285): n is a, c, g, or t
  modified_base (299)..(299): a, c, t, g, unknown or other
  misc_feature (299)..(299): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccgggcctcagtgacgatttcctgcaaggcttctggatacagcttcagttgttatgctatactaggtggtgcgccacggcccccgganaaggctgagtggcngggatggatcggtcggtggcactctaacataagatagtcacagtaagtttctagttcgagagtcaacctttagacagcgacacgactccgacgactacagtctacatgggtagttgacgttggcctaagactgtacgaagaccgaggtctaggttacctaacgttagtgtacgacgtagtagattccggtaccttacggaacggtaccgggaaccggggtaccctacgtttacggaccggtttacggtcggggaacccgtaacggggtaccccggtacggttacccgtaccccgg

SEQ ID NO: 237845 - DNA, 546 bp, Homo sapiens
  misc_feature: GYAE6OF02JCK5Y.42.74.G08.1.454.CMB.1.raw
  modified_base (285)..(285): a, c, t, g, unknown or other
  misc_feature (285)..(285): n is a, c, g, or t
  modified_base (328)..(328): a, c, t, g, unknown or other
  misc_feature (328)..(328): n is a, c, g, or t
  modified_base (511)..(511): a, c, t, g, unknown or other
  misc_feature (511)..(511): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctgggatggatcgtcggtgcactcctaanataagatattcacagaagtttcagttcagagtcacctttagctagcgacacatcccgcgacgacagtcctacatggagttgagtggcctaagatcgtgaaagccacggctagttctattactgtagcgagagatcggccttaacgacgaccgggacgggccccttaagttcgtaattaccggnggggaccctacgggaacccgttggtacctacccgg

SEQ ID NO: 237846 - DNA, 522 bp, Homo sapiens
  misc_feature: GYAE6OF02FKRT7.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctggatggatcgtcggtggcactctaacataagatattcacagaagtttcagttcagagtcactttagcagcgacacatccgcgacgacagtctacatggagttgagtggcctaagatctgaagacacggctgtctattactgtgcgagagatgtacctacgacgacggacggggaccctagtttcgagttacgtggggccacgggtacccgtggtctacccgg

SEQ ID NO: 237847 - DNA, 556 bp, Homo sapiens
  misc_feature: GYAE6OF02FXZ5B.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccacggcccccggacaaaggcttgagtggctgggatggatcggtcggtggcactcctaacataagatatcacagaagtttcagttcagtagtcactttagcagcgacacatccgcgacgacagtctacatggagttgagtggacctaagatctagaagacacggtctagtctagttactgtgcgaggagagtcgtaccttacgacggtcggaacggggtcccctacgtttacggtacgttacggtcggggacccgaacggggtacccgttgggtccctaccccgg

SEQ ID NO: 237848 - DNA, 547 bp, Homo sapiens
  misc_feature: GYAE6OF02HHB1P.42.74.G08.1.454.CMB.1.raw
  modified_base (286)..(286): a, c, t, g, unknown or other
  misc_feature (286)..(286): n is a, c, g, or t
  modified_base (332)..(332): a, c, t, g, unknown or other
  misc_feature (332)..(332): n is a, c, g, or t
  modified_base (388)..(388): a, c, t, g, unknown or other
  misc_feature (388)..(388): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccacggcccccgganaaaggcttgagtggctgggatggatcggtcggtggcactcctaacntaagatattcaacagtaagtttcagttcagacgtctacctttagcagcgacactanccgcgacgacagtctacatggagttgagtggacctaagatcgtagaagacgacggcttgtctattactgtagcgagagtatcgcttacgacggacggacgggccctacgttcgtagttaccggtcggggaccgtacgggtaccctcggtacctacccgg

SEQ ID NO: 237849 - DNA, 777 bp, Homo sapiens
  misc_feature: GYAE6OF02HHZM9.42.74.G08.1.454.CMB.1.raw
  modified_base (232)..(232): a, c, t, g, unknown or other
  misc_feature (232)..(232): n is a, c, g, or t
  modified_base (285)..(285): a, c, t, g, unknown or other
  misc_feature (285)..(285): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggctcagtgacgatttcctgcaaggcttcnggatacagcttcagtagttatgctatacagtgggtgcgccacggcccccgganaaaggctgagtggctgggatggatcgtggtgcactcctaanataagatattcanagtaagtttcagttcagngtctactttagcagcgactacactccgacgtaccgaacgtacgtactaccgtagtacgggtaggttaggtaggttacgggtacccgttaaaggtacgttaccgtaaggtaaacggaaccggtaaccgggtaccgttacgggtttaccgttttaaacgtttaaccggtttacggttacgggtaaccgggtaaacggtaaacgggttaacgttaccgggttacccccggttttaaaccggaaccccgggggttaaacccgggggtaacccgggggggggttaacccccttaaacccgggttttttaccgggttaaaccggttttaacccggggttaccgggggggttaacccccgggtaaacccgggggggtttaaacccccccggttaccgggggtttaacccccggttaaccccccgggg

SEQ ID NO: 237850 - DNA, 565 bp, Homo sapiens
  misc_feature: GYAE6OF02IJ42S.42.74.G08.1.454.CMB.1.raw
  modified_base (288)..(288): a, c, t, g, unknown or other
  misc_feature (288)..(288): n is a, c, g, or t
  modified_base (432)..(432): a, c, t, g, unknown or other
  misc_feature (432)..(432): n is a, c, g, or t
  modified_base (450)..(450): a, c, t, g, unknown or other
  misc_feature (450)..(450): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgtatttcctgcaaggtcttctggatacagtcttcagtagttatgctatacagtgggtgcgccaggcccccgganaaaggcttgagtggctggggatggatcggtggtggcactcctaacataagatattcacagaagttttcagttcagtagtctactttagcagcacactatccgacgacgacagtctaacatacgggagtttgagtggcctaaagntccgtagaagaacacggnttacgtcttaagttactgtgcgtaagatatcgccttaacgacggacggaccggggccctagtttagaacgttacgtcggggaccgtaacggggaacccttcgggtactaccccgg

SEQ ID NO: 237851 - DNA, 650 bp, Homo sapiens
  misc_feature: GYAE6OF02HZC6S.42.74.G08.1.454.CMB.1.raw
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (286)..(286): a, c, t, g, unknown or other
  misc_feature (286)..(286): n is a, c, g, or t
tcagtgacgtatgtcacgaccggtgctcgatttagtagctctatcaggggacccaacaaccacatccctcctcagaacgcccccagagcacaactcctaaccatggactggacctggaggatcctcttttggtggcagcagccacaggtggccactcccaggtccactttgtgcagtctggggctgagtgcagagcccgggctcagtgacgatttccngcaaggcttntggatacagcttcagttagttatgctatacgagtgggtgcgtccgacggcccccgganaaacgggccttaggaggtcggcgtgggacgtggattcggtcggtggctactccgtaacgtagtaagtagtacttacaacgtagttaagttctagtacagtacgtactaccgtttagcgacgcgaactacgtactccgacgtaccgacgtagtactacgacgtagggtaacgttgaacggtcggtaaccgtaaggtacttacgtacgaaacgaccgtacgggtactacggttacttaagttaccgtgtcgacggtaacgtacgtacgtacgtaccgtacgtaacggacggtaccggggtactaccggtttagacgtttacggacggggtacccgtaacgggtacccgttcggtacccgtacccgg

SEQ ID NO: 237852 - DNA, 539 bp, Homo sapiens
  misc_feature: GYAE6OF02IMAUK.42.74.G08.1.454.CMB.1.raw
  modified_base (284)..(284): a, c, t, g, unknown or other
  misc_feature (284)..(284): n is a, c, g, or t
  modified_base (398)..(398): a, c, t, g, unknown or other
  misc_feature (398)..(398): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggctcagtgacgatttcctgcaaggcttctggatacagcttcagtagttatgctatacagtgggtgcgccaggcccccgganaaaggcttgagtggctgggatggatcgtcggtggcactcctaacataagatattcactagaagtttcagttcagatcacctttagctagcgacacatccgcgacgacagtctanatggagttgagtggtactaagatactgaaagacacggctagtctattactgtagcgagagtatgaccttacgacggaacggacggggccctacgtttagaagtttacgtggggaccgacgggtacctcggtacctacccgg

SEQ ID NO: 237853 - DNA, 1146 bp, Homo sapiens
  misc_feature: GYAE6OF02H9SP5.42.74.G08.1.454.CMB.1.raw
  modified_base (237)..(237): a, c, t, g, unknown or other
  misc_feature (237)..(237): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacgaggtcggccactcccgaggtcctacttttgtgcagtcgtggggctggaggtgcaggaacggccccggggcctcgagtgacgtattttcccngacgaaggtcctttcgtaggaacttaaccgaggttccctttacgtaaggtttaaggttttaattcggtaccgtttaaacttaaaccgtaaagggttggggggtttacgggccccgggtacccccggtaaccccgggggaccccccccccggggaaaaccggaaaaaaccgggggttcccggttttacggggtaaaggggtttcgggggtacccggttacgggggggtaaacgggttagggggttaaccgggtttccccgggggttttaccgggggggtttccgggggtaccccggttaaaaaccccccgttttaaccccgtttaaaaaacccgtaaaaggtttaaaaaaccggttaaggttttaaaaccttttacccgtaaaaacccgtttaaagggttaaaaacgggttttttttaccgtaaacgggttttttaacccaaacgggttaacggtttacccctttaaaccccggttttttaacgaacccgtaacggacccggtaaaccctaaaccgttaaccgttaccccgggacccgtaaacccggaacccgttaaccggttaacccttaaaccggttaacgttaggggttaacgggttttacgggtaaagggttccgggtaaacccggtttaaaaggtaacgtttaccgttaacgggtaaacggtaaacccggaccgggttcgttaaccggtttccgtttaaagtttttaccgttagggtccggtaaggtaaacggtaaggtaacgttacggtacccccgtttaacggaaacccgggtaacccggggtaaccggggggttacccccgttaacggtttttacggtaaacggttttaccggggttaccgggggtaacccggttaacccgggggtaaccccggtttaccgggtacccgttaaccccccggg

SEQ ID NO: 237854 - DNA, 571 bp, Homo sapiens
  misc_feature: GYAE6OF02I94R4.42.74.G08.1.454.CMB.1.raw
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (394)..(394): a, c, t, g, unknown or other
  misc_feature (394)..(394): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaacggcttgngtggctgggatggatcggtcggtggcactcctaacataagatattcacagaagtttcagttcagtagtcactttagcagcacacatccgacgacgacngtcacatggtagtgngtcggactaagntactgaacgacacggntagtcttattactggttcgaggtacgagtagtcgtaccttagaccggtaacgggtacggggcccttaacgtttcgttaacgttaccggtcgggggtaccctaacgggggtaaccctacgggtacccgtacccgg

SEQ ID NO: 237855 - DNA, 708 bp, Homo sapiens
  misc_feature: GYAE6OF02H85G5.42.74.G08.1.454.CMB.1.raw
  modified_base (132)..(132): a, c, t, g, unknown or other
  misc_feature (132)..(132): n is a, c, g, or t
  modified_base (171)..(171): a, c, t, g, unknown or other
  misc_feature (171)..(171): n is a, c, g, or t
  modified_base (217)..(217): a, c, t, g, unknown or other
  misc_feature (217)..(217): n is a, c, g, or t
  modified_base (303)..(303): a, c, t, g, unknown or other
  misc_feature (303)..(303): n is a, c, g, or t
tcagtgacgtatgtcacgaccggtgctcgatttagtagctctatcaggggacccaacaaccacatccctcctcagaagcccccagagcacaactcctaaccatggactggacctggagatcctctttttggnggcagcagccacaggtggccactcccaggtccactttgngcagtctgggctgagtgcagagcccgggctcagtgacgattttccngacaaggtcttctggaactaccgaggtccttcgagttacgttatcggcttatactaggttgggtcgcgccgacgggcccccggaanaaaggccgttagaagtcggcgtgggatggacgttcggtacggtggctacctcctaaacgtataaggatacttacaacgtagtaacgttttcaggtttcaaggtacttacgtaccgttttagaccttaggccgtaacactacgtcccgacgtaaccgtacgtaacgtcttaacgtaggttcgggtagtttcggacggttacggtacccttaaaggcttaccgtacgtaacgtaacccgtacgggtacctttaacgtactttaaacgttcgtcgtacgtaaccggagttaaccgtacgttaccgttaccgtaccggtacggaccgggttaaccgggtccttaacggtttacgacgttacgggtacgggaccgttaaccgggtaaccttccggtaaccgttaccccgg

SEQ ID NO: 237856 - DNA, 562 bp, Homo sapiens
  misc_feature: GYAE6OF02IDHJX.42.74.G08.1.454.CMB.1.raw
  modified_base (287)..(287): a, c, t, g, unknown or other
  misc_feature (287)..(287): n is a, c, g, or t
  modified_base (479)..(479): a, c, t, g, unknown or other
  misc_feature (479)..(479): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctgggctgaggtgcagagcccgggcctcagtgacgatttcctgccaaggcttctggactacagcttcgagtagttatgctatacagtgggtgcgccacggccccccgganaaacggccttgaggttggcgtggggatgggatccggtcggtggcactcctaacataagatattcacagaagtttcagttcagactctacgtttagcagccgacacagtccgcgacgacagtctacagtggtagtgagtggacctaagactcgtagaacgacgacggctggttctagttaactgtgcgagagngtcgcctacacggacggtcggggaccctagtttacggtacttacggtggggaccgaccggggtaccgtccggtacgtccccgg

SEQ ID NO: 237857 - DNA, 524 bp, Homo sapiens
  misc_feature: GYAE6OF02HQZ3V.42.74.G08.1.454.CMB.1.raw
  modified_base (284)..(284): a, c, t, g, unknown or other
  misc_feature (284)..(284): n is a, c, g, or t
  modified_base (325)..(325): a, c, t, g, unknown or other
  misc_feature (325)..(325): n is a, c, g, or t
  modified_base (386)..(386): a, c, t, g, unknown or other
  misc_feature (386)..(386): n is a, c, g, or t
  modified_base (445)..(445): a, c, t, g, unknown or other
  misc_feature (445)..(445): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccganaaggcttgagtgctgggatggatcgtcggtggcactccaanataagatattcacagaagtttcagttcagagtcactttagcagcgacacatcgcgacgacngtctacatggagttgagtggacctagatctagaagacgacggctgtctattactgtcgngagagagtgcttacgacgacggacggggcctacgttagattacgtcgggaccgtacgggacccgttcggtcgtaacccg

SEQ ID NO: 237858 - DNA, 706 bp, Homo sapiens
  misc_feature: GYAE6OF02IOJIG.42.74.G08.1.454.CMB.1.raw
  modified_base (224)..(224): a, c, t, g, unknown or other
  misc_feature (224)..(224): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgtatttccgngcaaggtcttcgtggatacgagcttcagtagttatgctatacagtggtgcgaccgacggccccggacaaaggcgtgacgtggcgtgggatggacgtcggtggtcggactacgtacctaacagtaacgtatacttcaacgtaagtaacgtttcgaagttacgtagtacgtactaaccgtttacgacacgacgtaaccgacgtacgtcccgaccggtaaccgaccgtaacgtaccgtaacgtacgttacgggtacggtttagggaacggttcgggaaccgttaagtaccgttacgtacgaaacgtaccggtacggaccgttacgttacgttaatttaccgtaggtacgtacgaggtaacgtagttacgtacccgttaacgtacggaacgggtaaccggggtacccgttaacgttacggttaaccgttacggtaccggggtacccggtaacgggtacccggtttaccgggtaccgttaaccccgg

SEQ ID NO: 237859 - DNA, 526 bp, Homo sapiens
  misc_feature: GYAE6OF02HD3TJ.42.74.G08.1.454.CMB.1.raw
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctgggatggatcggtcggtggcactcctaacataagatattcacagaagtttcagttcagagtcactttagcagcgacacatccgcgacgacagtctacagtggagttggagtggacctaagatctgaagacacggctagtctagttactgtgcgagagatgcttacacggacggacggggccctacgttgtattacgtcgggacctacgggacctggtctacccgg

SEQ ID NO: 237860 - DNA, 690 bp, Homo sapiens
  misc_feature: GYAE6OF02F87D0.42.74.G08.1.454.CMB.1.raw
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggcctcagtgacgatttcctgcaaggcttcgtggaatacagcttcgagtagttatgctatacagtgggtncgccaggcccccgganaaaggcttaggagtggcgtgggatggatcggtcggtggcacttaccgtaacataaagattattccactaagtaacgttttcaggtttcaggtacgttcaacccgttttagacgacgacgaacacgtaactccgaccgtaaccgtaacacgtacgttactaacgtagggtaacgttagtacggttagggaccctaaaggacttaccgttaacggaacgtaaccgaaccgggtactacggttcgttaactttacgtaggttacggaccgtaaggtagaagttacgtacctttaacgaaccggtaaccgggaaccgggggtaccccttaaccggtttacgtaacgtttaccggtacgggggtacccggtaacggggtaaccccgttaggggtaccccttaacccgg

SEQ ID NO: 237861 - DNA, 708 bp, Homo sapiens
  misc_feature: GYAE6OF02HQBPA.42.74.G08.1.454.CMB.1.raw
  modified_base (312)..(312): a, c, t, g, unknown or other
  misc_feature (312)..(312): n is a, c, g, or t
  modified_base (347)..(347): a, c, t, g, unknown or other
  misc_feature (347)..(347): n is a, c, g, or t
tcagtgacgtatgtcacgaccggtgctcgatttagtagctctatcaggggacccaacaaccacatccctcctcagaacgcccccagagcacaactcctaaccatggactggacctggaggatccttctttttggtggcagcagccacgaggtggccacctcccaggtccactttgtgcagtcgtggggctggaggtgcagaacggccccggggcctcaggtggacgtatttccgtgcaaggtctttcgtggatacagtcttcgagttagttatgtctaatacgaggtgggtgccgccgacggcccccggaanaaggtctaggagtggcgtgggatggatcggtcggnggacctactaccaactagtaagtatattcaacgtagtaacgttttacagtttcaaggtacgttaccttaaccgtttagcctaaggacccgactaacccgtacgtcccggtacgaaccgtaacgacgtacctaacgtaacggtaggtaacggttggaacggtcggtaaccgttaagacttcgtaaggaacggtaaccgtacggtacgttacgttactaccgtttaacgtcgtagacgtaagaagtacgtcgtaccgttaaccgaccggaacggggtacccggggtacccttaacggttacgtaacggttaccggtacggggaccccggtaaccggggtaccctaccggggtaccctacccgg

SEQ ID NO: 237862 - DNA, 575 bp, Homo sapiens
  misc_feature: GYAE6OF02HH1M6.42.74.G08.1.454.CMB.1.raw
  modified_base (430)..(430): a, c, t, g, unknown or other
  misc_feature (430)..(430): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacagatggccaatcccaggtccactttgtgcagtctggggctgaggtgcagaagcccggggctcagtgacgatttcctgcaaggcttctggatacagcttcagtagttatgctatacagtggtgcgccaggcccccggacaaaggcttgagtggctgggatggatcgtcggtggcactcctaacataagatattcacagtaagtttcagtttacagtagtacacctttagcaggtcacacacgtcccgacgaccgacacgtctacatggagttgagtcggacctaagntacgtagaacgacacggcgttacgtacttatttacgtgtagcggtagagagtcgaccgtttaacgaccggaacgggacgggggtccctaacgtttacggaactttaccggcggggtacccgaacggggtaccctggttaaccccg

SEQ ID NO: 237863 - DNA, 544 bp, Homo sapiens
  misc_feature: GYAE6OF02FW86G.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagttagttatgctatacagtgggtgcgccaggcccccggacaaaggcttgagtggctgggatggatcggtcggtggcactcctaacataagatattcacagaagtttcagttcagtagtcacctttagcagcgacacatccgcgacgacagtctacatggagttgagtggacctaagatctagaagacacggctgtactattactgttgcgagagatgtcctacgacggacggacgggggacccctacgtttacgagttacgtcggggaccgtacgggaacccgtcggtacgtacccgg

SEQ ID NO: 237864 - DNA, 615 bp, Homo sapiens
  misc_feature: GYAE6OF02I3XGW.42.74.G08.1.454.CMB.1.raw
  modified_base (251)..(251): a, c, t, g, unknown or other
  misc_feature (251)..(251): n is a, c, g, or t
  modified_base (365)..(365): a, c, t, g, unknown or other
  misc_feature (365)..(365): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctgggctgaggtgcagaagcccgggctcgagtgacgatttcctgcaaggcttctggatacagcttcagtagttangctatacagtgggtgcgcacggcccccggacaaaggcttgagtggctgggatggagtcggtcggtggctaccgtcctaacataagtatattcaacgtagtaagtttcagtttanaagtacgtactaccgtttagctagacgtacaacactccgacgacgaacagtactacagtggtagttgagtcggactaagatcgtagaacacgacggtcttacgttactattacgttagtacggacgaggagtacgtcgtacctttaacggaccggtaacgggaccggggtaccctaacgtttacggtaagtttacccgggtacggggacccggtaaccggggtaacccggttccggtaccgttaccccgg

SEQ ID NO: 237865 - DNA, 715 bp, Homo sapiens
  misc_feature: GYAE6OF02GFSEA.42.74.G08.1.454.CMB.1.raw
  modified_base (260)..(260): a, c, t, g, unknown or other
  misc_feature (260)..(260): n is a, c, g, or t
  modified_base (294)..(294): a, c, t, g, unknown or other
  misc_feature (294)..(294): n is a, c, g, or t
  modified_base (391)..(391): a, c, t, g, unknown or other
  misc_feature (391)..(391): n is a, c, g, or t
tcagtgacgtatgtcacgaccggtgctcgatttagtagctctatcagggacccaacaaccacatccctcctcagaagcccccacgagcacaactcctaaccatggactggacctggaggatcctcttttggtggcagcagccacaggtggccactcccaggtccactttgtcgcagtctggggctggaggtgcagaacgcccggggcctcgagtgacgtatttcctgccaaggcttctggatacagcttcagttagttangtctatacaggtgggtgcgccgaggcccccgganaacgggcttggacgtggcgtgggagtggatcggtcggtggccacgtactaacgataaggtatacgttcacgtaagaacgttttcagtttacaaggtnttaccgtaaccttttacgacgtaacggtccgtaaccaagccgttaccggacgtaccggacaacggtttctaacgaattgggtaacggtttggacggttagggtacccttaaaggacgttcgtacggaaacgtaccggaacgggtcttacgggttacttaacgttttaaccgtgggttacgaccgaaagggtcgtaaggttcctacccgtttaacggacccgggttaacgggaacccgggggtcccccttaaggtttacgtaagttacccgggttaccggggaaccggacccggggttacccgttacgggtcccgttaaccccgg

SEQ ID NO: 237866 - DNA, 538 bp, Homo sapiens
  misc_feature: GYAE6OF02IGF0P.42.74.G08.1.454.CMB.1.raw
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccacggccccgacaaaggcttgagtggctggggatgggatcgtcggtggcactcctaacataagatatcanagaagtttnagttcagagtcactttagcagcacacactccgcgacgacagtctacatggagttgagtgacctaagatctagaagacacggctgtactattactgttgcgagagatcgacttacgacggacggacggggccctaacgtttcgaacgtttacgcggggtacccgagggaacccctgggtcctacccgg

SEQ ID NO: 237867 - DNA, 597 bp, Homo sapiens
  misc_feature: GYAE6OF02JJIWO.42.74.G08.1.454.CMB.1.raw
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (284)..(284): a, c, t, g, unknown or other
  misc_feature (284)..(284): n is a, c, g, or t
  modified_base (480)..(480): a, c, t, g, unknown or other
  misc_feature (480)..(480): n is a, c, g, or t
tcagtgacgtatgtcacgaccggtgctcgatttagtagctctatcagggacccaacaaccacatccctcctcagaagcccccacgagcacaactcctaaccatggactggacctggaggatcctctttttggtggcagcagccacaggtggccactcccaggtccactttgtgcagtctggggctgaggtgcagagcccggggcctcagtgacgatttccgcaaggcttctggatacngcttcagtgttangctatacagtgggtgcgtccaggcccccggtanaaacgggccttagaggtggacgtgggatggagtcggtcggtggcacgttcctaacataaaggattagttcaactaggtaacttttcgagtttcaaggtacttcgtaaccttttagactagcgtaacacgactccgacgacgacagtactacagtcggagttagagtggacgtaagactcgtagtaagacgacggtntacgtctattacgtgttcgagagagactagtccttacgaccggtacgggtacggggaccctacgtttagtaacgttcggtacgggaccgtacgggaacccgttgggtccctaaccgg

SEQ ID NO: 237868 - DNA, 571 bp, Homo sapiens
  misc_feature: GYAE6OF02I13HU.42.74.G08.1.454.CMB.1.raw
  modified_base (286)..(286): a, c, t, g, unknown or other
  misc_feature (286)..(286): n is a, c, g, or t
  modified_base (441)..(441): a, c, t, g, unknown or other
  misc_feature (441)..(441): n is a, c, g, or t
tcagtgacgtatgtcacgaccggtgctcgatttagtagctctatcaggggacccaacaaccacatccctccctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccacggcccccgganaaacggcttgagtggcgtgggatggatcggtcggtggctactcctaacataagatattcaacagtaagtttcagttcagtagtctactttagcagcacacactccgacgtacgacagtctacagtaggagttgagtggacctaagactctagaanacgacgtctacgtactattactgtgcgaagacgagtcgaccttacgacggtaacgggccggggtaccctacgtttacggacgtttacggcggggtacccgaacgggtaacccgtcggtacccgtacccgg

SEQ ID NO: 237869 - DNA, 558 bp, Homo sapiens
  misc_feature: GYAE6OF02GOJNX.42.74.G08.1.454.CMB.1.raw
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtggtgcgccaggcccccgganaaaggcttgagtggcgtgggatggatcggtcggtggcactcctaacataagatattcacgagtaagtttcagttcagagtctactttagcagcgacacatccgcgacgacagtctacagtggtagttgagtggacctaagacttcgtagaacgaccacggtctagtacttattacgtgtcgcgagagagtcgtccttacgacgacgggacggggtaccctacgtttacgtagttacggtggggacccgtacgggtaccctcggtacctacccgg

SEQ ID NO: 237870 - DNA, 607 bp, Homo sapiens
  misc_feature: GYAE6OF02GRJ2T.42.74.G08.1.454.CMB.1.raw
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagagcccggggctcagtgacgatttcctgcaaggcttctggatacagcttcagtagttatgctatacagtgggtgcgccacggcccccgganaaaggcttgagtggctgggatggatcggtcggtggcactcctaacagtaacgattattacacaagtaagtttcagttcagacgtcactttagcagtcgacactatccgacgacgacacgtctacagtaggtacgttggaggtcggtacctaagtactacgttagaacgtacgacgtcgttacgttacttagttacgtgttagacgtaaggtacgagtcgtacccgttacgacggaaccgggtacggggtacccctaagtttacggtaacgttaccggtggggtaccccgtacgggtaaccccggttggacccgttaaccccgg

SEQ ID NO: 237871 - DNA, 893 bp, Homo sapiens
  misc_feature: GYAE6OF02HTJRX.42.74.G08.1.454.CMB.1.raw
tcagtgacgtatgtcacgaccggtgctcgatttagtagctctatcagggacccaacaaccacatccctcctcagaagcccccagagcacaactcctaaccatggactggacctggaggatcctctttttggtggcagcagccacaggtggccactcccaggtccactttgtgcagtctggggctggaggtgcagaaggcccggggcctcagtgacgatttcctgcaaggcttcgtggatacagtcttcagttagttatgctaatacgagtgggtgtcgccgacgggcccccggaagaaacggtccgttacggacggttaggggccggttagggggtaacgtcggggtaacgtttccgggtttccggggttcgggtacccgtaacccgttaccccttaaaaccgtaacggtaaaacggtaaactttaccgtttaccgaaacgtaacgggttaaaagttttttacccgtaaggttttacgaaacggttaacggttacccgttaacccgttttttaacggacccgtaacggtaacccggtaaacgtaacccgtaacgttaccccgggaccggtaacccgggtaaacccttaaccggttacccgtttaaaccgagggtttaacgggttacgggtttacggtacgggttaccgggtaaccgtttaaaaggacgttttaccgtagggtaaaaccggtaaccccgaacgggtacccgtttaggtaccttttaacgtttactgggttaccgacgttaggaaacgttactacggttaccctttaaggacccgggaacggggtcccggggggtaaccccttaacgttttacggaacgttttaccgggacgggttacccccgggtaaacgggttacccccggttggtaccccggttaaccccgg

SEQ ID NO: 237872 - DNA, 810 bp, Homo sapiens
  misc_feature: GYAE6OF02I4V68.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccgaggtccactttgtgcagtcgtgggctgaggtgcagaacgcccgggcctcgagtgacgtatttccgtagacgtaaggtccttcgtaggtactacagtcttcgagttagttatcgacttatacgtaggtggtacgcgaccgaccggacccccggaagaaacggtcttaggacggtcggcgtaggggatacgggtacgtcggtacgggtggacctaaccgttacccgtaaaagtacgttaaaggtacttacgttaccgaaacgttaaaggttaaaccggttttacaagtttaaccgtacggttaacggttaccctttaaacccgtttagacccgtaacggaaccgtaccaacgtacgtacccggacgtaaccgaacgttacgtactacgtagtacggtaggttacgtaggtaccggtaacgttaaacgtacgttacggaaacggtaacggtaccggtacgggttacgttaacgttaccgtttaaaggtttacccgtagggttacgaacggtaaaggtacgtacgttccgtaccgtttaaccggaaccgggtaaccggggtaaccggtcccgtttaaacggtttcgttaaccggttaccgggaccggggtaaccgaacccggggtttaccttaccgggtcccgttaaccccgg

SEQ ID NO: 237873 - DNA, 551 bp, Homo sapiens
  misc_feature: GYAE6OF02FVY3M.42.74.G08.1.454.CMB.1.raw
  modified_base (343)..(343): a, c, t, g, unknown or other
  misc_feature (343)..(343): n is a, c, g, or t
  modified_base (445)..(445): a, c, t, g, unknown or other
  misc_feature (445)..(445): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccgggctcagtgacgatttcctgcaaggcttctggatacagcttcagttagttatgctatacagtgggtgcgccacggcccccggacaaaggcttgagtggcgtgggatggatcggtcggtggcactcctaacataagatattcanagtaagtttcagttcagtagtcacctttagcagacgacacactccgacgaccgactacgtactacagtacggtagttgagtggtaccgtaagtatctagaanacgacgctagtctattacgtgttgcgagagatcgaccttacgacgtacggacggggccctacgttgtacgttacggtcgggccgacgggacccgtggtcctacccg

SEQ ID NO: 237874 - DNA, 665 bp, Homo sapiens
  misc_feature: GYAE6OF02FV4RI.42.74.G08.1.454.CMB.1.raw
  modified_base (296)..(296): a, c, t, g, unknown or other
  misc_feature (296)..(296): n is a, c, g, or t
  modified_base (486)..(486): a, c, t, g, unknown or other
  misc_feature (486)..(486): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctggaggtgcagaagcccggggcctcagtgacgatttcctgcaaggcttctggactacagtcttcagtagttatgtctatacgtaggtgggtgcgccgaccggcccccggaanaaaggtcttggaggtcggcgtaggggctagggctcggtcggtggcctaccttaccctaaacgaattaaagattaagttaccaacgtaagtaacgtttcagtttacagtagttcctaacctttagccagcgaccaatactccgacgacacgacgtctaacagtcggttagtaggagtaggtacctaaaggntacgtagaacgaccgacggtacttcgttacgttattacgtggtagtccggaagtgtaacgttcgtacccttaacgacccgggtaacgggaccggggttacccctaacgttttacggacgtttaccgggtcggggtaccccggtaacgggtaccccgttcggggttaccccttacccggg

SEQ ID NO: 237875 - DNA, 573 bp, Homo sapiens
  misc_feature: GYAE6OF02INCY4.42.74.G08.1.454.CMB.1.raw
  modified_base (348)..(348): a, c, t, g, unknown or other
  misc_feature (348)..(348): n is a, c, g, or t
  modified_base (429)..(429): a, c, t, g, unknown or other
  misc_feature (429)..(429): n is a, c, g, or t
  modified_base (453)..(453): a, c, t, g, unknown or other
  misc_feature (453)..(453): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagagcccggggcctcagtgacgatttcctgcaaggcttcgtggatacagcttcagttagttatgctatacgaggtgggtgcgccgacggccccccggaacaaaggcttaggacggtggcgtggggatgggagtcggtcgggtgctacctacctaanaagtaagattatcacgtagtaagtttcagttcgagtagtctacgtttagacagcgacacactccgacgacgacacgtctanagtaggagttgagtcggactaagntactagaagacgagctagtactatcgtgtgcgagagtagtcgtacgtacgacggacggacgggtcctacgtttcgacgttacggacgggtaccgacgggtacccgtcggtaccgtacccg

SEQ ID NO: 237876 - DNA, 530 bp, Homo sapiens
  misc_feature: GYAE6OF02HAGW2.42.74.G08.1.454.CMB.1.raw
  modified_base (285)..(285): a, c, t, g, unknown or other
  misc_feature (285)..(285): n is a, c, g, or t
  modified_base (450)..(450): a, c, t, g, unknown or other
  misc_feature (450)..(450): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaggcttgagtggctgggatggatcgtcggtggcactcctaacataagatattcacagaagtttcagttcagtagtctactttagcagcgacacactccgcgacgacagtctacatggagttgagtggacctaagatctgaagacacgctagtctattactgtgngagagatgaccttagaccggacggaccggggcctacgtttgactttacggtcgggccgacgggacctcggtactacccgg

SEQ ID NO: 237877 - DNA, 584 bp, Homo sapiens
  misc_feature: GYAE6OF02IWXFD.42.74.G08.1.454.CMB.1.raw
  modified_base (295)..(295): a, c, t, g, unknown or other
  misc_feature (295)..(295): n is a, c, g, or t
  modified_base (353)..(353): a, c, t, g, unknown or other
  misc_feature (353)..(353): n is a, c, g, or t
  modified_base (457)..(457): a, c, t, g, unknown or other
  misc_feature (457)..(457): n is a, c, g, or t
  modified_base (470)..(470): a, c, t, g, unknown or other
  misc_feature (470)..(470): n is a, c, g, or t
  modified_base (498)..(498): a, c, t, g, unknown or other
  misc_feature (498)..(498): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtctggggctgaggtgcagaaggcccggggcctcagtgacgatttcctgcaaggtcttctggatacagtcttacgagttagttatgctatacagtgggtgcgccgacggcccccggaanaaacggctgagtggcgtgggagtggatcggtcggtggctactcctaacataagatatnaacgagtaagtttcagtttcagtagtacctacgtttagcagacgacacactccgacgacgacacgtcacgagtaggtagttgaggtcggtaccgtaagtacgtntagaagacgacgnttagtcttaattacgtgttagcggaagngagtcgacttacgaaccgggacggacgggtccctaagtttcgaggttacgtcgggaccgacggtacccggtacggtccgtacccgg

SEQ ID NO: 237878 - DNA, 541 bp, Homo sapiens
  misc_feature: GYAE6OF02FO0KB.42.74.G08.1.454.CMB.1.raw
  modified_base (221)..(221): a, c, t, g, unknown or other
  misc_feature (221)..(221): n is a, c, g, or t
  modified_base (466)..(466): a, c, t, g, unknown or other
  misc_feature (466)..(466): n is a, c, g, or t
  modified_base (474)..(474): a, c, t, g, unknown or other
  misc_feature (474)..(474): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggcctcagtgacgatttccngcaaggcttctggatacagcttcagtagttatgctatacagtggtgcgccaggcccccggacaaaggcttggagtggctgggatggatcgtcggtggcacgtcctaacataagatattcacagaagtttcagttcagagtcacctttagctagcgacacatccgcgacgacacgtctaacgatcggagttcgagtggacctaagatcgtagaagacgacggctgtactattactgtagcgagagntgtcctanacgacggtacggggccctacgtttacgagttacgtcgggtaccgagggacccctggtccctacccgg

SEQ ID NO: 237879 - DNA, 606 bp, Homo sapiens
  misc_feature: GYAE6OF02JTM4Y.42.74.G08.1.454.CMB.1.raw
  modified_base (218)..(218): a, c, t, g, unknown or other
  misc_feature (218)..(218): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctgggctgaggtgcagagcccgggctcagtgacgatttccngcaaggcttctggatacagtcttcagttagttatgctatacagtggtgcgccaggcccccggacaaaggcttagagtggcgtgggatggagtcggtcggtggcacgtcctaacataagatattcacagtaatttcagttacagtatacactttagctagcacacatccgacgacgactagtactacatggtattggagtcggactaagacttcgtagaagtacgacgtcgtacgtacgtaagttaccgtagtcgtacggagtagtaacgtcgtaccctttaacgaaccgggtaccgggtaacgggggtaccccttaacgttttacggacgtttaccggtcggggtacccggtaacgggtaaccccgtacgggttacccgtaccccggg

SEQ ID NO: 237880 - DNA, 662 bp, Homo sapiens
  misc_feature: GYAE6OF02H1JVZ.42.74.G08.1.454.CMB.1.raw
  modified_base (222)..(222): a, c, t, g, unknown or other
  misc_feature (222)..(222): n is a, c, g, or t
  modified_base (289)..(289): a, c, t, g, unknown or other
  misc_feature (289)..(289): n is a, c, g, or t
tcagtgacgtatgtcacgaccggtgctcgatttagtagctctatcagggacccaacaaccacatccctcctcagaagcccccagagcacaactccctaaccatggactggacctggaggatcctctttttggtggcagcagccacaggtggccacctcccaggtccactttgtgcagtctggggctgaggtgcagaagcccgggcctcagtgacgatttccngcaaggcttctggatacagctttcaagtagttatgctatacgagtggtgcgccacggcccccggaanaaacggtcttgaggtggctgggagtggatcggtcggtggccactaccgtaacagtaaagattaacttaccaacgtaaggtaagttttccgaagtttaccgaagtaaggttaccctaaccgttttacgacgtacggaccgaacgacctaacgtcccgacgaccggaacctaacggtctaacgtagtacgggtagttagtacgtcggtaccttaaagagtaccttaggaacgtaacgaccggtacttggttacttacgttacgtacgttgaccggtagagtagtcgtaccttaacgaccggaacggtaccggggacccttagtttacgagttaccggtcgggaccgtaaccgggtacctccggtacctaacccgg

SEQ ID NO: 237881 - DNA, 588 bp, Homo sapiens
  misc_feature: GYAE6OF02G35KB.42.74.G08.1.454.CMB.1.raw
  modified_base (283)..(283): a, c, t, g, unknown or other
  misc_feature (283)..(283): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagagcccgggcctcagtgacgatttcctgcaaggcttctggatacagcttcagtagttatgctatacagtggtgcgccacggcccccgganaaacggcttgagtggcgtgggatggagtcggtcggtggcactcctaacataagtatattcaactagtaagtttcagttcagagtctactttagcagcgacacatccgacgacgacagtctacagtggtagttgacgtggaccttaagacttcgtaacgaacgacgacggtctacggttacttactttacgtgttgacgagagtatcggtaccttacgacggaccgggtaaccggggtccctaacggtttacgtacgtttaccggtacggggaccgtaccggggaacccgttggtaccctacccgg

SEQ ID NO: 237882 - DNA, 567 bp, Homo sapiens
  misc_feature: GYAE6OF02HU3HG.42.74.G08.1.454.CMB.1.raw
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggcctcagtgacgatttcctgcaaggcttctggatacagcttcagtagttatgctatacagtgggtgcgccacggcccccgganaaaggcttgagtggcgtgggatggagtcgtcggtggcactcctaacagtaaagatattcaactagtaagtttcagttcagtatctacctttagcagccacacacgtccgcgaccgacaagtctactagtaggagttgtaggtacggtactaagactcgtagaacgacgacggctgtcttattactgtgagagagagtcgccttacgacggacgggaccggggccctaacgttgtagttacggtaccgggtccgtacggggaacccgttcggacccgtacccg

SEQ ID NO: 237883 - DNA, 554 bp, Homo sapiens
  misc_feature: GYAE6OF02GUFMQ.42.74.G08.1.454.CMB.1.raw
  modified_base (285)..(285): a, c, t, g, unknown or other
  misc_feature (285)..(285): n is a, c, g, or t
  modified_base (424)..(424): a, c, t, g, unknown or other
  misc_feature (424)..(424): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaggcttgagtggctgggatggatcggtcggtggcactcctaacataagatattcaacagtaatttcagttcagtagtctactttagcagcgacacatccgcgacgacagtctacataggtagttgagtcggactaagntacgtgaagacaggtctgtctattactgtgacgagagtatgtaccttacggacggacgggtacggggtccctacgtttacgacgtttacggtcggggaccgtaacgggaacccgttcgggacctacccgg

SEQ ID NO: 237884 - DNA, 638 bp, Homo sapiens
  misc_feature: GYAE6OF02H5R25.42.74.G08.1.454.CMB.1.raw
  modified_base (286)..(286): a, c, t, g, unknown or other
  misc_feature (286)..(286): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccacttgtgcagtctggggctgaggtgcagaagcccggggctcagtgacgatttcctgcaaggcttctggatacagcttcagtagttatgctatacagtgggtgcgccgacggcccccggaanaaacggcttaggagtcggcgtagggagtggagtcggtcggtggacctactaccctaaacaattaagactatttacaactaaggtaaacgtttcagtttacaaggtacgtacgtaccctttagacacgacgactaccacgttccgacgacgaactacgtactacagtcgggtaagttgaggtcggtaccgttagatacgtagaaagacgacggtactaggttctacgttacgtcggttagcggtaagagtactcggacccttaacggacggaccggtaccgggtaccctacggttttacgaggtttacggcggggtaccctaaccggggtaacccgttcggtaccgtacccgg

SEQ ID NO: 237885 - DNA, 594 bp, Homo sapiens
  misc_feature: GYAE6OF02GDKVC.42.74.G08.1.454.CMB.1.raw
  modified_base (232)..(232): a, c, t, g, unknown or other
  misc_feature (232)..(232): n is a, c, g, or t
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
  modified_base (511)..(511): a, c, t, g, unknown or other
  misc_feature (511)..(511): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttcnggatacagcttcagtagttatgctatactagtgggtgcgccacggcccccgganaaaggcttgagtggctgggatggatcgtcggnggctacgtcgtaacataagatagttcactagaagtttcagtttcagtacgtactaccgtttacgctacgacgtaccactacgtacccggacgaccgaaccaggttaccctaacagtggtaggttagacggtggacctaagagtactagaaacgacgacgtcgttggtacttacttacgtagtcgacgagaagngtcgaccttacgacgacggacggggtaccctacgttacgagttacggcgggtaccgtaacgggacccgtcggtccgtacccgg

SEQ ID NO: 237886 - DNA, 601 bp, Homo sapiens
  misc_feature: GYAE6OF02J2WIK.42.74.G08.1.454.CMB.1.raw
  modified_base (221)..(221): a, c, t, g, unknown or other
  misc_feature (221)..(221): n is a, c, g, or t
  modified_base (271)..(271): a, c, t, g, unknown or other
  misc_feature (271)..(271): n is a, c, g, or t
  modified_base (392)..(392): a, c, t, g, unknown or other
  misc_feature (392)..(392): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctggaggtgcagagcccggggctcagtgaccgatttccngcaaggcttctggataccagcttcagtattatgctatcagtggtgcgccnggccccgacaaggcttgagtggcgtggagtggatcgtacggtgggctacgtcctaactagtaagatacgttcaacagtaaacgtttcagttacagtagtactacgtttagactacgcgacncatcccggcgacgactacgtactacgatcggtaaggttgacgtaggtcctaaagactcgtgaacgtacgacgtgtagtacctagtttacctggttcgcggtaaagcgtagtacgtaccttagaccgggacgggtaacgggcccttacgtttacggacgtttaccggcgggtaacccggtaaccgggtccgtacgggttccctaacccgg

SEQ ID NO: 237887 - DNA, 618 bp, Homo sapiens
  misc_feature: GYAE6OF02IZILV.42.74.G08.1.454.CMB.1.raw
  modified_base (424)..(424): a, c, t, g, unknown or other
  misc_feature (424)..(424): n is a, c, g, or t
tcagtgacgtatgtcacgaccggtgctcgatttagtagctctatcagggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgccaaggctttctggatacgagcttcagtagttatgactatacagtgggtgcgccaggcccccggacaaaggctgagtggctgggatggatcgtcggtgcgactcctaacataagtatattcaacagaagttttcaagttcagtacgttctaaccgtttagctacgacgacctacactccggcgtaacgactaagtctaanactgggtagttcgagttcgggactttaaacgagttccgtaagaacgtaccgaacggtcttacggtacttaatttacctgggtagtcgaaagagtacttacgtccttaacgacggtaaccggacgggggtcccctaagttcggtaagttacggtcgggaccggtaccgggtaacccgttcggtaccgtaccccgg

SEQ ID NO: 237888 - DNA, 544 bp, Homo sapiens
  misc_feature: GYAE6OF02F6MOI.42.74.G08.1.454.CMB.1.raw
  modified_base (283)..(283): a, c, t, g, unknown or other
  misc_feature (283)..(283): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtattatgctatacagtgggtgcgcaggcccccgganaaaggcttgagtggctgggatggatcggtcggtggcactcctaacataagatattcacagaagtttcagttcagagtcactttagctagcgacacatccgcgacgacagtctacatggagttgagtggactaagatcagaagacgacgctgtctattactgtgacgagagtatgccttacgacgtacggacgggggtaccctacgtttcgtaagttacggtcggggtaccgacggggtacccgtcgggtacctaaccccgg

SEQ ID NO: 237889 - DNA, 639 bp, Homo sapiens
  misc_feature: GYAE6OF02JASZW.42.74.G08.1.454.CMB.1.raw
  modified_base (260)..(260): a, c, t, g, unknown or other
  misc_feature (260)..(260): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtctggggctgaggtgcagaggcccgggctcgagtgacgtatttcctgacaaggtcttcgtggactacagtcttcagtagttangctatacagtggtgccgccacggccccggacaaggcttggagtggcgtcgggtagtggagtcggtcgggtggcacctactaacataacgtaattacttaccaagtaagtaagtttacagttacagtagtactaacttagcgacgacgacacactaccggcgaacgacacgtctaacgtacgttggtaacgtggaacgtcggtaactaagtactcgtagaaacggtaccgaggtaccgttaggtacctttaattcgtggttcgacgaagagtacttacgtccgtaacgacgggtaaccggggaacgggtcccctaaaggtttcgtaacggtttaccggacggggaccgtaaccgggtaacccgttccgtaccgtaccccg

SEQ ID NO: 237890 - DNA, 927 bp, Homo sapiens
  misc_feature: GYAE6OF02G7EJV.42.74.G08.1.454.CMB.1.raw
  modified_base (133)..(133): a, c, t, g, unknown or other
  misc_feature (133)..(133): n is a, c, g, or t
  modified_base (317)..(317): a, c, t, g, unknown or other
  misc_feature (317)..(317): n is a, c, g, or t
  modified_base (745)..(745): a, c, t, g, unknown or other
  misc_feature (745)..(745): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggnggcgagcacgccacgtagggtcgaccctaccctcccgtacggtacccttacgttttggtcgacgtacggttcgggtcggggtctagggtagggtcgacgaaggacccggggtccccgggtcctacgaggtacgacgtttaccttttccgcgaacgtaacgggttccttcgtaggtaactaccgngttccttacgtaggtttagttacgtcgtactttaagtacggtagggtttcggggtcgaccccggacccgggtaacccccgggaccccccgggaaaaggtaaaccgggtttcgttacggggacggttcggggtacgggttaggggagttacggggtaccggttccggggtcgggttaccggtacctaaaccccgttaacccgtaaaacttaaacgggtaaattacgttttaacctaacgaaaccggtttaaagtttaacgttttacggtaaccgttaacggtaacggttaacgtttaccccgtttaaagttacgaccgacggtaacccaactaccgtaccgacccgaaccggaaccgtacgtacttacgacgttagtaggtacggttaggacggtacgttaaccgtaagtacttagaagtacggtaacncggtgttaccgttatttaccgtgttacgggtgtaacgggtaagtacgttccgttacgtaacccgacgggaacccggttaccgggggtacccgggttacctttaagggtttaccgtaacgggtttccggggtaccggtacccggaacccgggtttacccggtacggttacccccttaacccgg

SEQ ID NO: 237891 - DNA, 624 bp, Homo sapiens
  misc_feature: GYAE6OF02JQRG4.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctggaggtgcagaacggcccggggcctcgagtgacgtatttcctgcaaggccttcgtggatacagtcttcagtagttatgctatacaggtgggtgcgccgacggcccccggaacgaacggcttagagtggacgtgggagtggagtcggtcggtggtactctaatataagatattcacagtaattcagtcgagtacgtctacttagactagacgtacactacgtccgacgtaacgaaccagtaactacagtacggtagttacggtagtcggtactaagtatacgtagaagtaccgaggtctaggttactacgttactggtagacgtaagagtaagtccgtaccttacggaacgaccggggtacggggtacccttaggttacgtacgttaacggtcggggaccgtaacgggaacccggtttcggtaccgtacccggttacccg

SEQ ID NO: 237892 - DNA, 704 bp, Homo sapiens
  misc_feature: GYAE6OF02I1ZY9.42.74.G08.1.454.CMB.1.raw
  modified_base (255)..(255): a, c, t, g, unknown or other
  misc_feature (255)..(255): n is a, c, g, or t
  modified_base (352)..(352): a, c, t, g, unknown or other
  misc_feature (352)..(352): n is a, c, g, or t
tcagtgacgtatgtcacgaccggtgctcgatttagtagctctatcaggggacccgaacaaccacatccctcctcagaagcccccagagcacaactcctaaccatggactggacctggaggatccttcttttggtggcaggcagccacaggtggccactcccgaggtccacgtttgtcgcctagtcgtgggggctggacggtgcgagacggccccggggctcgaggtcgacgtattttccggaccaaggtcttcgnggactacgagtcttacgagttatatgactatacgtaggtgggtcgcgaccgaccggacccccggagaaagggtcctggacgtgggtctgggataggngtcggacggttcggcctaaccgttccaacgtagtaacgatacttcgacagtacgttcagttacagtacgtactactttagcctagacgaccacgtacgtccgaccgacgtaacgtcgtaccgtacgtagtcggtagttacggagtcggaccgttaaacgcgttaccgtaacgacgaaccgaccgggtcttacgttccgttaaagttccgttcgggttacggaacgtaggtaacggacttacggtacccgttacggtaaccgggaccgggttaaccgggacccgttaaccgttacgttaccgtacggtcggggtaccccggtaacgggacccgtttacggaccgttaccccgg

SEQ ID NO: 237893 - DNA, 688 bp, Homo sapiens
  misc_feature: GYAE6OF02JQK2W.42.74.G08.1.454.CMB.1.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagacgcccgggctcagtgacgtattccngcaaggcttcnggatacgagtcttacgagtagttangactatacgagtgggtgcgtccgagggtaccccccggaanaaacgggtccttggaacggtcgggcgtggggtacgtcgggtagttccggtcgggttcggaccgtaccgttacccgttaaactaagtaaacgtagttaacttaccgaaactaggttaaacgtttacgtagtttacgaagtacgtacttaccgtttaagcgtacgacgaactaacacgtccgacgacgaactagtactaccgtagtacggagttagtagtcggtacgttaagacttcgtaggaacgtagacggtcgttagtactagtttaacgtcggtagtacggagagtcgtcgtaccttaccggacggtaaccgggtacgggaccgttacgttacgtaagtttaccgggtacgggtaccgtaaccggggtaaccttcgggtaccctacccgg

SEQ ID NO: 237894 - DNA, 538 bp, Homo sapiens
  misc_feature: GYAE6OF02FWYJY.42.74.G08.1.454.CMB.1.raw
  modified_base (254)..(254): a, c, t, g, unknown or other
  misc_feature (254)..(254): n is a, c, g, or t
  modified_base (285)..(285): a, c, t, g, unknown or other
  misc_feature (285)..(285): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttangctatacagtgggtgcgccaggcccccgganaaaggccttagagtggctgggatggatcggtcggtggcactcctaacataagatattcacagagtttcagttcagagtcactttagcagcacacatccgcgacgacagtcacagtggagttgagtggacctaagactcgagagacacggctagtctagttctgttgcgagagatgccttacgacggaacggacggggtccctagtttgaacgttacggtcgggaccgtaacgggtacccgtggtcctacccgg

SEQ ID NO: 237895 - DNA, 575 bp, Homo sapiens
  misc_feature: GYAE6OF02GP77N.42.74.G08.1.454.CMB.1.raw
  modified_base (284)..(284): a, c, t, g, unknown or other
  misc_feature (284)..(284): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctgggatggatcgtcggtggcacgtcctaacataagatattacacagaacgtttcagttcaagtagtcaactttagcagacgacacatccgcgacgaacagtctaacagtggacttgagtggactaagatcgtagaagacacggctgtaccttagttactggtgacgtaggagatcgtaccttaaccgacggaacgggtaccgggggtcccctaagtttcggaactttacggtcgggggtaaccctacggggaaccccgtttggtacccgtacccgg

SEQ ID NO: 237896 - DNA, 681 bp, Homo sapiens
  misc_feature: GYAE6OF02FOA8K.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctggaggtgcaggaacgcccggggcctcgagtgacgtatttcctgacaaggcttctggatacagcttcagtagttatgtactatacgagtgggtgcgccgacggacccccggaacgaaacggcttggaggtcggtcggtgggagtaggacgtcggtacggtggactacgtacctaaacaacgtaagtaacgttattacaacgtagtaagtttactagttacgtacgtacgttacgtacctttaacgactacgacgtaaccacgtacgtccggaccgaaccggtaacgtacgttactaacgacgttaggggtagttacggaaggttcggtaacctaaggtacttcgaacggtaacgtaaccgtacggtcttagttaccgtttagtttacgtggttcgacggtagaagtactcgtaccgtaacgacggtacgggtaaccgggccttaagttacgtacgttcggacgggtaccggtaaccggtacccgtaggtccctacccg

SEQ ID NO: 237897 - DNA, 578 bp, Homo sapiens
  misc_feature: GYAE6OF02IUOJR.42.74.G08.1.454.CMB.1.raw
  modified_base (310)..(310): a, c, t, g, unknown or other
  misc_feature (310)..(310): n is a, c, g, or t
  modified_base (337)..(337): a, c, t, g, unknown or other
  misc_feature (337)..(337): n is a, c, g, or t
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
  modified_base (422)..(422): a, c, t, g, unknown or other
  misc_feature (422)..(422): n is a, c, g, or t
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggataccagtcttcagttagttatgctatacagtgggtgcgcacggacccccggagaaaggcttgagtggcgtgggngtggagtcggtcggtggcactcctaanataagatattcacagaagtttcagttnagtagtcctacgtttanccgagacgaacacacgtccgaccgaacgacacgttctaacntacgggtagttagaggtcggtactaaggatcgtagaaacggacgacgcttagtcttattcgngtgcgagagntacgccttacgaccggacgggacgggtaccctagttcggtaattcggacggggtccgaacggggacccgttcggtactacccgg

SEQ ID NO: 237898 - DNA, 623 bp, Homo sapiens
  misc_feature: GYAE6OF02H1QCG.42.74.G08.1.454.CMB.1.raw
  modified_base (222)..(222): a, c, t, g, unknown or other
  misc_feature (222)..(222): n is a, c, g, or t
  modified_base (260)..(260): a, c, t, g, unknown or other
  misc_feature (260)..(260): n is a, c, g, or t
  modified_base (294)..(294): a, c, t, g, unknown or other
  misc_feature (294)..(294): n is a, c, g, or t
  modified_base (340)..(340): a, c, t, g, unknown or other
  misc_feature (340)..(340): n is a, c, g, or t
  modified_base (428)..(428): a, c, t, g, unknown or other
  misc_feature (428)..(428): n is a, c, g, or t
  modified_base (465)..(465): a, c, t, g, unknown or other
  misc_feature (465)..(465): n is a, c, g, or t
  modified_base (492)..(492): a, c, t, g, unknown or other
  misc_feature (492)..(492): n is a, c, g, or t
tcagtgacgtatgtcacgaccggtgctcgatttagtagctctatcaggggacccaacaaccacatccctcctcagaacgccccagagcacaactcctaaccatggactggacctggaggatcctctttttggtggcagcagccacaggtggccactcccaggtccacttgtgcagtctggggctggaggtgcagaagcccggggcctcagtgacgatttccngacaagggcttcgtggatacacgtcttcgagtagttangtctaatacaggtggtgcgccacggcccccgganaacggcttgagtggctggactggatcgtacggtggcactcctaaanacgttaagagtattacatacgtaagttttacagttccgaagtatacctaccgtttagcaacggtcgaactacgatccgcgaccgaacngtctagtatcgggtaagttggagttggacctaaagtntaccgttagaaacgacgtacggccgtntacgttattaagtcgttagccgtaaggattagacgtaccgttacgaacgggtcggtaaccggggaccctacggttttagacgttttaccggacggggtccgaaccgggtaccgttacggtcttaaccccgg

SEQ ID NO: 237899 - DNA, 768 bp, Homo sapiens
  misc_feature: GYAE6OF02IOU3N.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggctcgagtgacgatttcctgcaaggtcttcgtggatacgagtcttacgagtagttatgacttatacgtagtgggtgccgccgacgggcccccgaagaaacggtccgttagaggtcggtacgtggggagtgggacgttccggttacgggtcggaccctaccgttacccttaaacgtagtaaagtacgttaattacgaacgtaagtaaacgttttcgtaagttacgtaagtacgttacctaaccgttttacgactacggtaccgacgtaacgtacgtaccgacgaaacccgacgtaacgtccgtaactaagtagggtacgttagggaacggttacggtaccgtaaggtaacgttcgtaagaacgaccgtacgggtaccttagttaccttaacgtttacgttggacgttaacgggtaagaaggtacttaccggtacccgtttaacggtaaccgggtacccgggtaacgggggtacccctttaaggttttaccggaaccgttttaaccggggtcgggggtaaccccgtaaccggggttaacccccgggttacggttacccggtaccccgg

SEQ ID NO: 237900 - DNA, 756 bp, Homo sapiens
  misc_feature: GYAE6OF02JP9G6.42.74.G08.1.454.CMB.1.raw
  modified_base (220)..(220): a, c, t, g, unknown or other
  misc_feature (220)..(220): n is a, c, g, or t
tcagtgacgtatgtcacgaccggtgctcgatttagtagctctatcaggggacccaaccaaccacatccctcctcagaagccccagagcacaactcctaaccatggactggacctggaggagtcctcttttggtggcagcagccacaggtggccactcccaggtccacctttgtgcagtctgggctgagtgcagaagcccgggctcgagtgacgactttcngctaggcttacgtggactacagtcttcaagtacgttatgacgtataccgagtgggtagtcgaccgacggcccccgacgaacggcgttagacggtagggtcgtagggacgttacggcgttcggtccgggtacggtccgtaccgtcccgttaaactacgtaaacggtacttaagtttaccgaacgtaacggtaacgttttacgtacgtttacgaaggtacgtacgttacccgtttaaccgtagtacccgggtacgaaacgtacgtaacccgttaccgaccgtaacggaaaccgtaccgttacctaacgggttacgttaccgggtaagggtttacgtaacggtttccgggaacctttaagggtaccttacgggttacgaacgtaacggtacgacgtttaccgttacgttacgttaacgttagcgtacgaacggtataagtcctaccgttaacggcgggtaaacggtccgggaccttaagtttaccggaacgttcggtaccggggtccctaacggggtaccgttaccggtcccgtacccg

SEQ ID NO: 237901 - DNA, 605 bp, Homo sapiens
  misc_feature: GYAE6OF02HB1DQ.42.74.G08.1.454.CMB.1.raw
  modified_base (342)..(342): a, c, t, g, unknown or other
  misc_feature (342)..(342): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggataccagtcttcagtagttatgctatacagtgggtgcgccgaggcccccggaacaaaacgggcttggagtggcctgggatggatcggtcggtggccacgtccctaanataagatacgttcagagtaagtttcagttcagagtctacctttagcagtcgaacacgactccgacgacgacagtctacagtggtagttgaagtcggacctaaagtattccgtagaacgactacggcttagtacttaagttaccgtgtgtacggagtaagtacgtagtaccttacgaaccggacgggaaccggggtccctaacggtttacgtacgttacggtaccggggaccgtaacgggtacccctagggtaccctaacccgg

SEQ ID NO: 237902 - DNA, 554 bp, Homo sapiens
  misc_feature: GYAE6OF02FMF7W.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggccccggacaaaggcttgagtggctgggatggatcgtcggtggcactcctaacataagatattcacagtaagtttcagttcagagtcactttagcagcgacacatccgacgacgacagtactacagtaggagttgacgtggcctaagatacgtagaacgacgacggtctgttactaattacgtgttgacgagtagatcgccttacgacgaacggacggggccctaacgtttcggtagtttacggtcggggtccgacgggtacccgtaggtactacccgg

SEQ ID NO: 237903 - DNA, 675 bp, Homo sapiens
  misc_feature: GYAE6OF02G193H.42.74.G08.1.454.CMB.1.raw
  modified_base (344)..(344): a, c, t, g, unknown or other
  misc_feature (344)..(344): n is a, c, g, or t
  modified_base (532)..(532): a, c, t, g, unknown or other
  misc_feature (532)..(532): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtcgtggggctggaggtgcagaagcccggggcctcagtgacgatttcctgcaaggcttcgtggactacagcttcgagtagttatgctatacaggttggtgcgccacggcccccggacaaaggcttggagtggctgggatggatcggtcggtggcacgtcctaacagtaanagttatcaactagtaagtttacagttacgagtagtactaccgtttagccgagtcgacaacgtacgtcccgacgtaaccggacaggtcctaacagtagggtaagttaacgtcggtaacgtaagtatacgttaagaacgtaacgaacgggtcttaggttaccctttagttacgttgggtacgtaaccggnggtaaaggtacttcgtaccgttaccgaaccgggtacccgggtaacggggacccctttaacggtttacgtaacggtttaccggttacccgggggacccggtaacgggttaaccccggtgggttaccccgtaccccggttacccg

SEQ ID NO: 237904 - DNA, 584 bp, Homo sapiens
  misc_feature: GYAE6OF02JJUG3.42.74.G08.1.454.CMB.1.raw
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
  modified_base (329)..(329): a, c, t, g, unknown or other
  misc_feature (329)..(329): n is a, c, g, or t
  modified_base (434)..(434): a, c, t, g, unknown or other
  misc_feature (434)..(434): n is a, c, g, or t
  modified_base (461)..(461): a, c, t, g, unknown or other
  misc_feature (461)..(461): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaaggcccgggcctcagtgacgatttcctgcaaggcttcnggatacagcttcagtagttangctatacagtggtgcgccaggcccccggacaaaggcttgagtggctgggatggatcggtcggtggcactcctaanataagatagttcacagagtttacagttcagagtctactttagcagacgacacactccgcgacgacacgtctactagtgagttgagtggtctaagatccgtagaanacgagcgttagtcttagttacttggtncggaagagatcgtaccgttaaccgacggtaaccgggacggggtaccccgtacggtttagttaacgttaccggtttcgggggtaccgacccggggtaacccgttacgggtccggtaacccccgg

SEQ ID NO: 237905 - DNA, 536 bp, Homo sapiens
  misc_feature: GYAE6OF02GGAWO.42.74.G08.1.454.CMB.1.raw
  modified_base (285)..(285): a, c, t, g, unknown or other
  misc_feature (285)..(285): n is a, c, g, or t
  modified_base (401)..(401): a, c, t, g, unknown or other
  misc_feature (401)..(401): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccgganaaaggcttgagtggctgggatggatcggtcggtggcactcctaacataagatatcacagaagtttcagttcagagtctacctttagcagcgacacatccgacgacgacagtctacntaggagttgagtggactaagatcagaagacacggtctgtctattactgtgcgagagatgtacctagacggacggacggggtccctacgtttgtacgttacgtcggggtaccgacgggacccgtggtcctacccgg

SEQ ID NO: 237906 - DNA, 718 bp, Homo sapiens
  misc_feature: GYAE6OF02JT5L6.42.74.G08.1.454.CMB.1.raw
  modified_base (287)..(287): a, c, t, g, unknown or other
  misc_feature (287)..(287): n is a, c, g, or t
tcagtgacgtatgtcacgaccggtgctcgatttagtagctctatcaggggacccgaacaaccacatccctcctcagaagccccagagcacaactcctaaccatggactggacctggaggatcctcttttggtggcagcagccacaggtggccactcccaggtccacttgtagcagtctggggctgaggtgcagagtcccgggctcagtgacgatttcctgccaaggcttctggactacagcttcagttatatgatatacacgtgggtgcgccacgggcccccggtanaaacgggtccttagaggtcggcgtcggtatggagttcgtcgggtgggcactccaacgataaggatattacacgtagtaaacggtttcaggtttcaagacgttacacctttagcacggtacgacactactccgacgaccgactacggtactaccgagttacggtacgtttggaacggttcgggtacccttaaagtacgtttaacgacggttaaacggaccgtaaaccgggtcgttaacgttaccgtttaacgttaaacggttcggtaacgggtaccgtaaaggtacggaacgttacgggtacccttaaggttaacccggaaccggggtaccgggggtaaccccttacggttttaacgtacgtttaacccggtaccggggggtaaccgttaaccgggggtaaaccccgtttcgggtaccccgttaaccccggg

SEQ ID NO: 237907 - DNA, 647 bp, Homo sapiens
  misc_feature: GYAE6OF02HOUOO.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgagtgcagagcccgggctcagtgacgatttcctgcaaggtcttcgtggatacagcttcagtagttatgcttatacgagtgggtgcgccgacggccccccggaagaaacggcttaggagtggcgtgggatgggagtcggtcggtggcaccgtacctaagagtaagtatattcatagtatttcgagttacaggtaacgtctaccgtttagctacgcgaactacacgtccgacgacgaactagtacctactagttaggacgttagacggtacggtaccgtaagtacttcgtagaacgaccggtacggtcgttagtacctttaagttacgttaggttcgaccggtagaacggtactccgtacccgtttaacgaccgggtaaccgggaccgggggtacccttacggtttacgaacgtttaccgggacgggtacccgtaaccgggtacccgttggacccgttacccgg

SEQ ID NO: 237908 - DNA, 712 bp, Homo sapiens
  misc_feature: GYAE6OF02IP14A.42.74.G08.1.454.CMB.1.raw
  modified_base (189)..(189): a, c, t, g, unknown or other
  misc_feature (189)..(189): n is a, c, g, or t
  modified_base (234)..(234): a, c, t, g, unknown or other
  misc_feature (234)..(234): n is a, c, g, or t
  modified_base (250)..(250): a, c, t, g, unknown or other
  misc_feature (250)..(250): n is a, c, g, or t
  modified_base (301)..(301): a, c, t, g, unknown or other
  misc_feature (301)..(301): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
tcagtgacgtatgtcacgaccggtgctcgatttagtagctctatcaggggacccaacaaccacatccctcctcagaagccccagagcacaactcctaaccatggactggacctggaggatcctcttttggtggcagcagccactaggtggccactccaggtccacttgtgcagtcgtggggctgaggtncgagaggcccgggcctcgagtgacgtatttcctgcaacggcttcnggactacgagcttcgngtagttagtgctagttacgaggttggtcggcgcgaccgggacccccggtanaaacggcgttcggtagtggctggggattggacgttcggtacggtggcctactaccgtaatacgtaagtnttacttnaaccgagtaagtttcgaagtttccaaggtagtacctaacgtttacggcacgtacgtacgaccgtacgtccgtccgaacgtacgtacggtacttaccaggtaacggtagttggaggttacgggtaccttaagggtactaccgttacgaacgaccggtaacgggtactacgttacgttacgttaccgtaggtacgtacgtaacggaaggttatcccggtacttaaccggtaccggaaccgggtaccgggggtccctttaaacggttccgtaacgttaccgggtaacggggtccccgtaacgggggtaaccccttacggggtaccccgtttaacccgg

SEQ ID NO: 237909 - DNA, 848 bp, Homo sapiens
  misc_feature: GYAE6OF02HFMPW.42.74.G08.1.454.CMB.1.raw
  modified_base (133)..(133): a, c, t, g, unknown or other
  misc_feature (133)..(133): n is a, c, g, or t
  modified_base (180)..(180): a, c, t, g, unknown or other
  misc_feature (180)..(180): n is a, c, g, or t
  modified_base (241)..(241): a, c, t, g, unknown or other
  misc_feature (241)..(241): n is a, c, g, or t
tcagtgacgtatgtcacgaccggtgctcgatttagtagctctatcaggggacccaacaaccacatccctcctcagaagccccagagcacaactcctaaccatggactggacctggagattccttctttttggnggcagcagccacgagggtcggccacctcccgaggttcctacttttgngctagtcgtggggctggaggtgacgaggacggccccgggctcgagtcgacgttactttccngacgaaggtcttcgtaggaactacaggtccttacgagttagttatcgtacttagtacgaggtgggtacgccgaccgaccgggccccccggaaagaaacgggtctttaggacggtcgggtacggtaggggtacgtgggtacgttccgggtcgggtcggaccttacgtaaccccgtaaagtaacgttaaaaggtaactttaacgttaccgaaacgttaacgtttaaacggtttttacgaacgtttacgtaaacggtacgttaccttaacccgtttaacgcgtaacgtacccgaaacctaccgtaacgtcccggaaccgtaaccggtaaccgttacgtttaccgtaacgttaaggtagggtacgtttacgggacggttaccggtaaacctttaaggtaccgttacgtaaaggaaccggtaccggtaccggttacgtttaccgtaacttttacgttacgtcgggacgttagggaaacgtagtaacgttccttaacccggttacggaacccgggtaccggggtaacccgggttacccttaaggttttaccggaaggtttaccgggacccgggtaccggttaaaccccgggtcgttaccggtaccctccccgg

SEQ ID NO: 237910 - DNA, 552 bp, Homo sapiens
  misc_feature: GYAE6OF02GKXE3.42.74.G08.1.454.CMB.1.raw
  modified_base (433)..(433): a, c, t, g, unknown or other
  misc_feature (433)..(433): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggctcagtgacgatttcctgcaaggcttctggatacagcttcagtagttatgctatacagtgggtgcgccaggcccccgacaaggcttgagtggctgggatggatcggtggtggcacgtcctaacataagatattcaacgtagtaagtttcagttcagagtcaacctttagcagccgacacactccgcgacgacagtctactagtggtagttgagtggactaagatctaganacgacggtctgtactattacgtgttggacgacggagtactcgcttacgacggaccggtacggggccctagtttcgagttacggtcggggaccgtacgggacccgttcggtcctacccgg

SEQ ID NO: 237911 - DNA, 614 bp, Homo sapiens
  misc_feature: GYAE6OF02G1KVM.42.74.G08.1.454.CMB.1.raw
  modified_base (224)..(224): a, c, t, g, unknown or other
  misc_feature (224)..(224): n is a, c, g, or t
  modified_base (293)..(293): a, c, t, g, unknown or other
  misc_feature (293)..(293): n is a, c, g, or t
  modified_base (328)..(328): a, c, t, g, unknown or other
  misc_feature (328)..(328): n is a, c, g, or t
  modified_base (359)..(359): a, c, t, g, unknown or other
  misc_feature (359)..(359): n is a, c, g, or t
tcagtgacgtatgtcacgaccggtgctcgatttagtagctctatcaggggacccaacaaccacatccctcctcagaacgcccccagagcacaactcctaaccatggactgggacctggaggatccttctttttggtggcagcagccacaggtggccactcccaggtccactttgtgcagtctggggctgaggtgcagaagcccgggctcagtgacgtatttccngcaggtcttctggatacagtcttcgagttagttatgcttatacaggtgggtgcgccacggcccccgaanaacgcgttgagtggcgtgggactggatcggtcggnggaccactacaacatagatctcacagtattnagtcagtacgtctacgtttgctacgacgaaccactcgtaccgacgaccgaacgacgtcgtacagtacggtagttcgaggtacgactaagtactcgtacgaaacgtacgacggtcgtagttacgtatttacgtggtactcgggtaagacgtacgtcgtacttaccgaacgggtccggaccggggttacctacggtttacgtacgtttacgggtccgggtacccgtaacgggttaaccccgtggtacccgtacccgg

SEQ ID NO: 237912 - DNA, 738 bp, Homo sapiens
  misc_feature: GYAE6OF02GP8KK.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtcgtggggctggaggtgcaggaaggcccggggcctcgaggtgacgtactttcctggacaaggtcttcgtaggactacagtcttcgagttagttatgtactagtacaggtgggtagcgccgacgggaccccgagaaggtcttggaggtcggcgtgggagtggagtcggtcggtcggcgaccgttaccgtaaacgtagtaaggtataacgttacaacgtaaggttaacgtttctaaggtttcgaaggtacgttacctaaccgtttagaccgaggacgtaccaacgacgtacccggtacgaaccgtacgtaacggtcttaaccgagttacgggtacgttaggacgggttacggacctaaggtattccgtaaggaacgaaccggtaccggtacgtacggttactttaacgttacgttacgggttcgacggtaaggtacgtagttaccggttacccgttaacggaccggaaccggggtaccggggtaccctacgttttacggaaccgtttcgggtaccggggtaacccgtaaccggggtaccccgttacggttcccgttaaccccgg

SEQ ID NO: 237913 - DNA, 600 bp, Homo sapiens
  misc_feature: GYAE6OF02GJ793.42.74.G08.1.454.CMB.1.raw
  modified_base (285)..(285): a, c, t, g, unknown or other
  misc_feature (285)..(285): n is a, c, g, or t
  modified_base (330)..(330): a, c, t, g, unknown or other
  misc_feature (330)..(330): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggcctcagtgacgatttcctgcaaggcttctggatacagcttcagtagttatgctatacagtgggtgcgccacggcccccgganaaacggcttgagtggctgggatggagtcgtcggtgcactcctaanataagatatcactagaagtttcagttacagagtctactttagcagcgacacactccgacgacgacagtcctaacatggtagttgagtggacctaagactcgtagaagacgacggctacgttacttacgttacgtgtcgacgtaggaagtatacggtccgttaaccgaccgggaacgggtaccgggggtaccccttaaggtttacggtaacgtttaccggtacggggtacccggtaacgggggtaacccccttgggtacccttaaccccgg

SEQ ID NO: 237914 - DNA, 594 bp, Homo sapiens
  misc_feature: GYAE6OF02H5YN9.42.74.G08.1.454.CMB.1.raw
  modified_base (290)..(290): a, c, t, g, unknown or other
  misc_feature (290)..(290): n is a, c, g, or t
  modified_base (321)..(321): a, c, t, g, unknown or other
  misc_feature (321)..(321): n is a, c, g, or t
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggtcttcgtggatacagtcttcagtagttatgctatacagtgggtgcgccacggcccccggaanaaggcttagagtggcgtggatggatcgtggnggctactcaacataagntattnaacagtatttcagttcagagtctacctttagctagcgacatctccgcgacgacacgtactactagtggtagtgtagtcggtacctagtactgtagaacgacgacggcgtacgtcttattacgtcgttagcggtagagtagtacgtacccttaacggtaccggacgggtaccggggtaccctaacggttttacgacgtttacggtcggggtacccggtaacgggtacccgttaccgggtaccgttaccccgg

SEQ ID NO: 237915 - DNA, 558 bp, Homo sapiens
  misc_feature: GYAE6OF02GNM2K.42.74.G08.1.454.CMB.1.raw
  modified_base (286)..(286): a, c, t, g, unknown or other
  misc_feature (286)..(286): n is a, c, g, or t
  modified_base (332)..(332): a, c, t, g, unknown or other
  misc_feature (332)..(332): n is a, c, g, or t
  modified_base (444)..(444): a, c, t, g, unknown or other
  misc_feature (444)..(444): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtcccactttgtgcagtctggggctggaggtgcagaagcccggggcctcagtgacgatttcctgcaaggcttctggatacagcttcagtagttatgctatacagtgggtgcgccaggcccccganaaaggcttgagtggcgtgggatggatcggtcggtggcactcctaanataagattattcacagaagtttcagttcagagtctaactttagcagcgacacactccgcgacacagtctacagtaggagttgagtggactaagatacgtagaagacgacggntcgtacttattactgtgcgagagagtgaccttaacgacggaacgggacggggtaccctagtttacgtacgttacggtcggggaccgaacgggacccgtcggtaccgtaccccgg

SEQ ID NO: 237916 - DNA, 567 bp, Homo sapiens
  misc_feature: GYAE6OF02JDSRI.42.74.G08.1.454.CMB.1.raw
  modified_base (286)..(286): a, c, t, g, unknown or other
  misc_feature (286)..(286): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtctggggctgaggtgcagacggcccgggctcagtgacgtatttcctgcaaggcttctggatcagtcttcagtattatgctatacagtgggtgcgccacggcccccgganaaaggctgagtggctgggcgtggatcgtcgggtggcacgttcaacatagtatatcgacagtaagtttctagttcagacgtctacctttagctagcgacacactcgacgacgactagtctacngtgagtagngtggactaagntcgtgaacacgacgtntacgtataacgttcgtagtgcggagtagtgtacgccgtttacacggtacggtaccggggtacctacgtttcacggtttacggcggggtacccgacggggtaaccctcgggttacctaacccgg

SEQ ID NO: 237917 - DNA, 608 bp, Homo sapiens
  misc_feature: GYAE6OF02GQKM4.42.74.G08.1.454.CMB.1.raw
  modified_base (424)..(424): a, c, t, g, unknown or other
  misc_feature (424)..(424): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtctggggctggaggtgcagaacgcccggggcctcagtgacgtatttcctgcaaggcttctggatacagcttcagtagttatgctatacagtgggtgcgccacggcccccggacaaggcttgagtggcgtgggatggagtcgtcgggtgcgactcctaacataacgatacttacacaagtaacgtttacagttacagtacgtctaacctttagcagtacgacacacgtccgacgacgactacgtctanagtgggtagttgaggtcggtacctaagattacgtagaacgacgacgcttagtcttaatttacgtgtggacgaggagtacgtgtacccttacggaaccggacgggtaccggggtaccctacgtttaggtaacgttacgggtcggggacccgtaacggggtaccccgttacgggtccctaccccgg

SEQ ID NO: 237918 - DNA, 575 bp, Homo sapiens
  misc_feature: GYAE6OF02FFPF0.42.74.G08.1.454.CMB.1.raw
  modified_base (334)..(334): a, c, t, g, unknown or other
  misc_feature (334)..(334): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttcctggatacagtcttcagtagttatgctatacagtgggtgcgccacggcccccggacaaaggccttgacggtggctggatggatcggtcggtgcactcctaanataagatattacacagtagtttcagttcagtcgtacactttagcagcgacacactaccgcgacgacagtactacatggagtgagtggtactaagtatactagaacgtacgacggtcctgtaccttatttacgtgtcgacgtagacgtagtcgtacctaacgacggtaccggacggggccctaacgtttcgaacgtttacggtcggggtaccgaccgggtaacccgttggtacccgtccccg

SEQ ID NO: 237919 - DNA, 732 bp, Homo sapiens
  misc_feature: GYAE6OF02GDLR2.42.74.G08.1.454.CMB.1.raw
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacgaggtggccactcccaggtcctactttgtgcagtcgtggggctggaggtgcgaagaacggccccggggcctcgaggtagacgtatttcctgacaaggtcttcgtgggaactacgacgtccttacgaagtttaggttatcggtcttaagtacgaggttggggtagccgtccgacgggtcccccggaagaaaggtctggagtggcgtggagtggagtcggtcggtgctaccttacaacataagattatacataatagtttnagttanagtgtacctacgttgacaggacgaccacgtacgtcccgaacgacaacgtacggtacctaacgagtacgggtagttaggtacggtacggttaccctaaaggtacgttaccggtaaggtaaaccgacggtacgggttacctacggtttacttaacgttacgttcgggttacgacggtaaggtaacgtacgtaaccgtacccgtttaacggaccggggttaaccggggtaccggggtacccttaacgtttaggttaaccgttacggggttacccgggacccggttaaccggggtacccccggttagggtacccccgttacccgg

SEQ ID NO: 237920 - DNA, 715 bp, Homo sapiens
  misc_feature: GYAE6OF02HSXUJ.42.74.G08.1.454.CMB.1.raw
  modified_base (235)..(235): a, c, t, g, unknown or other
  misc_feature (235)..(235): n is a, c, g, or t
  modified_base (494)..(494): a, c, t, g, unknown or other
  misc_feature (494)..(494): n is a, c, g, or t
tcagtgacgtatgtcacgaccggtgctcgatttagtagctctatcagggacccaacaaccacatccctcctcagaagcccccagagcacaactcctaaccatggactggacctggagatccttcttttggtggcagcagccacaggtggccactcccaggtccactttgtgcagtctggggctggaggtgcagaacggcccggggcctcgagtgacgactttcctgcaaggcttntgggatacgagtcttcagttagttatgctatcgagtgggtgcgaccgacggccccgagaaggtctgaggtggcgtagggagtaggtacgtcggtcggtcggtaccaccttacctaagaagtaagtaatacttacaactaaggtaacgttttcagttcaagtacgtaccgtaactttagacgtaggcacctactacgtaccgaccgacgacctagtactaacgagtcggtagttacggtagttacgggacctttaaaggnttacgtaaggtaacgaaccgtaccgggttagtacggtttactttaatttaacggtcgtacgaacggtaagtaagttaccgggcgttaccgaccgggtaaaccgggtaccggggacccgggggtaaccccttaggttttaaccggtacggtttaaccggggttaccggggaacccggggtaaccgggttaccccgggttccgggtacccgtttaacccccgg

SEQ ID NO: 237921 - DNA, 802 bp, Homo sapiens
  misc_feature: GYAE6OF02FWKP4.42.74.G08.1.454.CMB.1.raw
  modified_base (228)..(228): a, c, t, g, unknown or other
  misc_feature (228)..(228): n is a, c, g, or t
tcagtgacgtatgtcacgaccggtgctcgatttagtagctctatcaggggacccaacaaccacatccctcctcagaagccccagagcacaactcctaaccatggactggacctggaggatcctctttttggtggcaggcagcccacgaggtggccactcccaggtcctactttgtgcagtcgtggggctggaggtgcagacggcccgggctcaggtgacgtatttccngcaggtcttcgtggtatacgagtccttagaggttatttagtgtacttaatacgtaggttgggtcgcgtacccggaccgggaccccccggaacggtaaacgggccgttggtaggtgggcggttaggggagtcggtacgttccgggtcggggtcggtacctaccgttacctaaagttagtaaagtattattaaccgaacgtaaggttaacgttttccgttaacggtttacgtacggtacttaccgttaaccgtttaacgcgtaacgtaccgtaacgactaccggtaccgaccggaacgtccgaacgttctaggtaacgttagggttacgtggtacgtccgggttaacgtagttaacgttcgtaaacggaacgttaaccggtaccggttacgttacgtttaacgtttacgtttaacggttcggttaacggtagaaaggttaaccgtcgttaacccggtttaccgtaaaccggaccggggtaaccggggtacccgggttaccctttaacgggttaagtaccgggtttacggacgggggtcccggaaccggttacccgttaccgggcctttacccccgg

SEQ ID NO: 237922 - DNA, 556 bp, Homo sapiens
  misc_feature: GYAE6OF02GSGSK.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcggtcggtggcactcctaacataagatattcacagaagtttcagttcagagtcacctttagcagcacacactccgcgacgacagtctacatggagttgagtggcctaagatctagaagacacggctcgtactattacgtgttgacgagagatgtaccttacgacggacggaaccgggggtaccctaacgtttagtacgttacggtcggggacccgacggggtaaccccgtcgggtcctaaccccgg

SEQ ID NO: 237923 - DNA, 560 bp, Homo sapiens
  misc_feature: GYAE6OF02GF7X8.42.74.G08.1.454.CMB.1.raw
  modified_base (221)..(221): a, c, t, g, unknown or other
  misc_feature (221)..(221): n is a, c, g, or t
  modified_base (287)..(287): a, c, t, g, unknown or other
  misc_feature (287)..(287): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggcctcagtgacgtattccngcaaggcttctggatacagtcttcagtagttatgctatacagtgggtgcgccgacggcccccgganaaacggcttgagtggcgtgggatggatcggtcgggtcggtccactaccgtaaacagtaaagatattcaactagtaagtttcagtttcagtagtctacgtttagcagcgacacactccganaccganacgtctacagtggtagttgagtgactaagntnagaacncgagctagtctaattngtnacgagagatcgccttaacgacggtaccggacgggtccctagtttcgaagttacggacgggccgtaacgggtacccgtaggtcctacccgg

SEQ ID NO: 237924 - DNA, 697 bp, Homo sapiens
  misc_feature: GYAE6OF02IXEPI.42.74.G08.1.454.CMB.1.raw
  modified_base (322)..(322): a, c, t, g, unknown or other
  misc_feature (322)..(322): n is a, c, g, or t
  modified_base (335)..(335): a, c, t, g, unknown or other
  misc_feature (335)..(335): n is a, c, g, or t
  modified_base (587)..(587): a, c, t, g, unknown or other
  misc_feature (587)..(587): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacgaggtggccactccccaggtccactttgtgcagtctgggctggaggtgcagaacggcccggggcctcgagtgacgtatttcctgactaaggtcttcgtaggtactacgagtccttacgagttagttatggtcttataacgtaggtgggtgcccgccgtacccgggaccccccggaanaacggtcgttagnggtcgggcgtagggatggtagtcggtcgggtcgactacgtacctaacgtagtaagtatacttacgacgtaacgtagtttactagtacagtacgttctaccgtttagctacggcgtaacactacgtcccggaccgaacgacgtacgtacgtatagacggttaagtcgggagtacggtacttaaggacttacgtaacggaaccgacgtaccggtacttacgttactaacgttacggtagtccgaagtaggtacngttaccgtacttaaccggaaccggggtcgggtaaccgggtacccttacggttaagtacgttaccgggtcgggaaccccggtacggtacccgtcggtaccccgttacccgg

SEQ ID NO: 237925 - DNA, 835 bp, Homo sapiens
  misc_feature: GYAE6OF02HFCPK.42.74.G08.1.454.CMB.1.raw
  modified_base (352)..(352): a, c, t, g, unknown or other
  misc_feature (352)..(352): n is a, c, g, or t
  modified_base (396)..(396): a, c, t, g, unknown or other
  misc_feature (396)..(396): n is a, c, g, or t
tcagtgacgtatgtcacgaccggtgctcgatttagtagctctatcagggacccaacaaccacatccctcctcagaagcccccagagcacaactcctaaccatggactggacctggaggatccttcttttggtggcagcagccacaggtggccactcccgaggtcctactttgtgctagtcgtggggctgaggtgcagaacggcccggggcctcgagtcggacgtacttttcccgtgccgtaagggtcctttcgtagggtacttacgacgtcctttacgagttagtttatgtactatacgtaggtggtggcgccgtacggcccccggaagaaacggtcttaggagtcggtcgngggtagtggtacgtcggttcgggtcggacctaacctacctaaanataacgtattacgttacacgtaagttaactttacgagttcaagtcgtaccttaacgttgacgtacgaccaaccgtacgtacgtcccgacgactaacgtacgtacctaacgtaggtacgggtacgttaggtaacggttacgggtaacccgttaagtacttacggtaacggaaacggaccgtaacgggtaccgttacggttaccgttaacgttttacgtacgggtacggtaaccgggtaaaggtaccggttaacgttaccggtacccggtttaaacccggtacccgggggtaaaacgggggttaacccccgggggttaaccccttttaacgggtttacccgggtttaaacgggtttaccccggggtaaccggggggttaaaccccggttaaacccggggggttaaccccggtttaccgggtaacccccggttacccccggg

SEQ ID NO: 237926 - DNA, 706 bp, Homo sapiens
  misc_feature: GYAE6OF02G53A7.42.74.G08.1.454.CMB.1.raw
  modified_base (227)..(227): a, c, t, g, unknown or other
  misc_feature (227)..(227): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtcgtggggctggaggtgcagaacggcccgggctcgagtgacgtatttccngacgaaggtcttcgtggactacagtcttacgagttagttatgtactatacgtagtggtgccgccgaccggaccccgagtaaacggtcgttagacgtggcgtgggtagtggacgtcggtcggtcgactacgtacctaacaagtaacgtatactacaacgtagttaacgtttactagttacgagtacgtacgtacgtttagacacgtacgacacgacgtccgacgaaccgactacgtactaacgtacgtaggtaggttacggacggttacggtaacccttaaaggtacgtacggtaacgaacggaaccgtacggtcttacggttacttacgtttacgtacggtacgtaccgtaagtacgtcgtacgtaccgttaacggaccgggtaaccgggtaccgggtacccttaacggtttacggttaaccggttacgggtccgggaacccggttaaccgggtacccgttacggttacccgtacccgg

SEQ ID NO: 237927 - DNA, 599 bp, Homo sapiens
  misc_feature: GYAE6OF02IWG1D.42.74.G08.1.454.CMB.1.raw
  modified_base (424)..(424): a, c, t, g, unknown or other
  misc_feature (424)..(424): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtcgtggggctggaggtgcagaaggcccggggcctcagtgacgtatttcctgcaaggcttcgtggatacagcttcagtagttatgctatacaggtggtgcgccgacggcccccggacaaaggcttaggagtggcgtgggagtggatcggtcggtggcactctaacagtaagattacttacaactagtaagtttcgagttcgagtagtactacctttagcagcgacacatccgtacgacgacacgtctanagtggtagttgacggtgtactaagtactacgtagaagacgacgtcttagtacgtatttacgtgtagcgtagagtacgtgtaccgttacgacggtaacgggaccgggtcctaacggtttacgtacgttacggtacggggacccgtaacgggtacccgtacgggtacccttacccgg

SEQ ID NO: 237928 - DNA, 674 bp, Homo sapiens
  misc_feature: GYAE6OF02I2WCG.42.74.G08.1.454.CMB.1.raw
  modified_base (133)..(133): a, c, t, g, unknown or other
  misc_feature (133)..(133): n is a, c, g, or t
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (240)..(240): a, c, t, g, unknown or other
  misc_feature (240)..(240): n is a, c, g, or t
  modified_base (255)..(255): a, c, t, g, unknown or other
  misc_feature (255)..(255): n is a, c, g, or t
  modified_base (287)..(287): a, c, t, g, unknown or other
  misc_feature (287)..(287): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggnggcagcagccacaggtggccactcccaggtccactttgtgcagtctggggctgaggtgcagacgcccgggctcagtgacgatttccngcaaggtcttcnggatacgngtcttcagtagttangtctatacagtgggtgcgcgacggccccgganaaacggcttaggagtggcgtaggggatggtacgtacggtcggtacggctacctacctaacagtaagattaacttcaacgtaagtaacgtttacagttacagtacgtacctaacctttagacagccgaacactacgtaccgacgacgaactacgtactacgagtacggtagttaggagtacggactaagagtacctagaacgacgtaacgtcgttagttaccttaacgttaccgttaggtacgtacggaagtaacgtacgtccgtacctttaaccggaacgggtaaccggggtaccggggtaccccttaacgtttacggtaaccgtttaacgggtaccggggtaacccgtaaccggggtaaccccgttcggtacccgttaacccccgg

SEQ ID NO: 237929 - DNA, 844 bp, Homo sapiens
  misc_feature: GYAE6OF02H4K87.42.74.G08.1.454.CMB.1.raw
  modified_base (135)..(135): a, c, t, g, unknown or other
  misc_feature (135)..(135): n is a, c, g, or t
  modified_base (176)..(176): a, c, t, g, unknown or other
  misc_feature (176)..(176): n is a, c, g, or t
tcagtgacgtatgtcacgaccggtgctcgatttagtagctctatcaggggacccaacaaccacatccctcctcagaagcccccagagcaacaactcctaaccatggactggacctggaggatccttctttttggnggcagcagccacaggtcggccactcccaggtccacttttgngcagtcgtggggctggaggtagcgaaggaacggccccggggccttacgagtcggaacgtactttcctgacaacggtcctttcgtaggactaccagtcttacgagttacgttatgtacttaatacgaggttgggtcgccggacccgaccgggacccccggaacgaaacgggtcgttagggacggtcggggtacgtaggggaggttaggtacggttccgggttcgggtcggtaccctaaccgttaacccgttaaaccgtaggttaaaacgtaacgtttaaactttaccgaaacgttaagggttaaacgtttttacgtaagggtttaccgtaaacggtaacggttacccttaacgtttttaacgacgttaaccggaccgtaaccaacccttaacggttaccccggaaccggaaccgtaaccgtaaacggttaccgtaacgttacgggttaggttagggttacgggtaggtaaccgggttaaaccgttaaggacttacgtaagaaaccggtagtacccggtagtcgttacttaacgttacgtaggtccggaacggtagacgtagttccgtacgtacggtaaccggacggggacccgggttaccctagtttaccgtaggtttaccggaccggggaccggtaaccgggttacccgtacggttacccgtacccgg

SEQ ID NO: 237930 - DNA, 711 bp, Homo sapiens
  misc_feature: GYAE6OF02IJD8P.42.74.G08.1.454.CMB.1.raw
  modified_base (230)..(230): a, c, t, g, unknown or other
  misc_feature (230)..(230): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtctggggctggaggtgcaaggaaggccccggggcctgagtgacgtatttccgngcaaggtcttctggatacagtcttcgagttagttatgctatacgaggtgggtgcgccacgggcccccggaacaaacggtcgttacggaggtcggacgttggggagtgggacgttcggtcgggtggcctaccgtacctaaacgaataaacggattaacttacactaagtaacgtttcagttacaaggtacgtacctaccgtttagaccaaggaccgtaacacacgtcccggacggtaaccgaccgtaacgtacctaaacgtagtacgggtaaggttggaaggtacggtaaccctaaaggtacttaccggtaagtaacggacgtaacggcgtttacgttaccttaacttaccggttagtcgacggtaaggacgttacgtacgtacccgttaaccgacggtaaccgggtaccggggtaccccttaggtttacgtacggttacggtacggggaccgtacgggtaaccctgggtaccctacccggg

SEQ ID NO: 237931 - DNA, 605 bp, Homo sapiens
  misc_feature: GYAE6OF02F6M9Z.42.74.G08.1.454.CMB.1.raw
  modified_base (220)..(220): a, c, t, g, unknown or other
  misc_feature (220)..(220): n is a, c, g, or t
  modified_base (356)..(356): a, c, t, g, unknown or other
  misc_feature (356)..(356): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagagcccgggcctcagtgacgatttccngcaaggcttctggatacagcttcagtagttatgctatacagtgggtgcgcacggcccccggacaaggcttgagtggctgggatggatcgtcggtggcactctaacataagatattcacagtaagtttcagttcagngtctaccgtttagcgtagcgacacgactccgcgacgacagtctacagtcggagttcgagtggacctaagtactacgagaacgacgtacggcttggtaccttattacgtagttagccgtaggacgtagttcgaccctttaacgaccggtaacgggacgggggtccccttaacggttttacgtaacggtttaccggtacgggggtacccgtaacgggggtaacccccgttcgggttacccgtaaccccggg

SEQ ID NO: 237932 - DNA, 746 bp, Homo sapiens
  misc_feature: GYAE6OF02GMH7R.42.74.G08.1.454.CMB.1.raw
tcagtgacgtatgtcacgaccggtgctcgatttagtagctctatcaggggacccaacaaccacatccctcctcagaacgcccccagagcacaactcctaaccatggactggacctggaggatccttctttttggtggcagcagccacaggtggccactcccaggtccactttgtgcagtctgggctgaggtgcagacgcccggggctcagtgacgtatttcctggcaaggcttcgtggatacagtcttcagttagttatgtctatactaggtgggtcgccgccacgggtacccccggaagaaaggccttaggagtgggcggtgggagtacgggtattcggtcgggtcggcctacgttacctaaacgtaataaaggtattacttaccaacgtaggtaaacgttttacaggtttacgaaggtaacgttaccgttaaccgtttaagcctaaggtcccgaaccgtaacgtaccgtacccggaccggtaaaccgtaaccgtaacgttaaccctaaacgtacggtttacggggtaaaggtttcggtaacggtcggttaaccggtaaggttactaccggttaagaaacggtaaccgaccgggtgttacgttactttaacgttacgttcggtagtacgtagtaagtacgtacgtaccgtaacggacggaacgggtaccggggtaccctacggtttacgaacggttcggtacggggtacccggtaaccgggtaacccgttcggtaccgtaacccg

SEQ ID NO: 237933 - DNA, 685 bp, Homo sapiens
  misc_feature: GYAE6OF02JR6EF.42.74.G08.1.454.CMB.1.raw
  modified_base (183)..(183): a, c, t, g, unknown or other
  misc_feature (183)..(183): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
  modified_base (390)..(390): a, c, t, g, unknown or other
  misc_feature (390)..(390): n is a, c, g, or t
  modified_base (411)..(411): a, c, t, g, unknown or other
  misc_feature (411)..(411): n is a, c, g, or t
tcagtgacgtatgtcacgaccggtgctcgatttagtagctctatcaggggacccaacaaccacatccctcctcagaacgcccccagagcaacaactcctaaccatggactggacctggaggatccttctttttcggtggcaggccagcccacgaggtggcccactcccaggtcccacttttgngcagtcgtggggctggaggtgcaggacgccgggctcagtgacgntttccngcaaggtcttcgnggatccgagccttnagtagttangctatacaggtggtgcgccacggccccgagaaggcgttagagtggcgtaggngtacggntcggtcggtggctaccgtcgtaacgataacgagtcttaccaagtagacgttttagacgttanagttagtacttaccggtttanacgtacgacgaacgtacctactccgggcaaacggccttaaacggtcctaagaacggtgggtaagtttacgcgggttacgaccgttaagacgttacgtacgaaacggaacccggcgttaaccgttcgttacgtttaacttacgggttaccgtagttacgggaaggtaactcgggtccacgtttaccggaacggggtaacggtaccggggcccttacgttagttacggttaacgggcgggtaaccggtaccggaacccgttggcccgttaacccgg

SEQ ID NO: 237934 - DNA, 657 bp, Homo sapiens
  misc_feature: GYAE6OF02JFTID.42.74.G08.1.454.CMB.1.raw
  modified_base (279)..(279): a, c, t, g, unknown or other
  misc_feature (279)..(279): n is a, c, g, or t
  modified_base (295)..(295): a, c, t, g, unknown or other
  misc_feature (295)..(295): n is a, c, g, or t
  modified_base (345)..(345): a, c, t, g, unknown or other
  misc_feature (345)..(345): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtcgtggggctggaggtgcaggaagcccggggcctcgagtgacgtatttcctgcaaggcttctggatacagtcttcgagttagttatgtctatacagtgggtncgcgacggccccgganaaggctagagtcggcgtggatggacgtcggtcggtcggctactacctaanaataacgtattacttacaacgtagtaacggttttacagtttacgagtacgtaccttaaccgtttacgacgacgacgtaccaactactcccggacgtaccgaacgtacgttactaacgtagtacgggtaggttgaggttcggacgtagtactctagaagtaccgaacgtctagtacttagttacgttagcgtagagtacgctacgtaccttacggaacgggaccggtaccggggtacccctagttttcggaagtttacccgggtcggggacccggtaacccggggacccggtttacggtaccccgttacccgg

SEQ ID NO: 237935 - DNA, 792 bp, Homo sapiens
  misc_feature: GYAE6OF02JGD7D.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcgagacgcccgggcctcagtgacattcctgacaaggcttctggatacagtcttcagtagttatacgctatacgtaggtggtgccgccgaaccggtccccccggaacgtaaacggtccttagggacggttcgggaccggtagggtacgttacgggtaacgtccgggttccgggtaggtccctaaccggtacccctaaagtaagttaaacggtacttacggttacaacgtaagttaacgttttacgaacgtttagaagttacgttacgtaaccgtttaagacgtaacgaccgtaacctaacgtacgtacccgacggtaacgtaacgtacgtacgtaactacggttggtacggtttacgtacggttaacggtaccgttaaagtaccttacggttaacggaaccgtacggtaaccggtacgttacgttaccgtttaataccgtttaggtacggtaccggtaaggaacggttacggtaacttaccgtttaaccgaaccgggttaaccgggaacccgggttcccgttaacgttaccggttaacgtaccggggttacccgggtaacgtaacccgggggtacccgtttaccgggtacccgttaccccggg

SEQ ID NO: 237936 - DNA, 684 bp, Homo sapiens
  misc_feature: GYAE6OF02JX6HI.42.74.G08.1.454.CMB.1.raw
  modified_base (196)..(196): a, c, t, g, unknown or other
  misc_feature (196)..(196): n is a, c, g, or t
  modified_base (340)..(340): a, c, t, g, unknown or other
  misc_feature (340)..(340): n is a, c, g, or t
  modified_base (487)..(487): a, c, t, g, unknown or other
  misc_feature (487)..(487): n is a, c, g, or t
tcagtgacgtatgtcacgaccggtgctcgatttagtagctctatcaggggacccaacaaccacatccctcctcagaagcccccagagcacaactcctaaccatggactggcctggaggatcctcttttggtggcagcagccacgaggtggccactccccaggtccacgttttgtgcagtctgggggctgacgggtncgagaacggcccgggcctcgagtgacgatttcctgccgtaaggtcttctgggactacggtccttgagtacgttatgactatacgaggtgggtcgcgccacgggccccgagaacggtctgagtggcgtggatggtatccggtggngtacgctacgtaacataacgtatacttcgaactagttaagttctacttacggaagtacgttacgtaccctttaaggacctaggtaccgaacgtacaacgtaccggacgacggtaacctacgtacgtaccgtagtagtaggttacggnggtaaccgtagtaacgtactcgtaacggtacgaaccggtacgtacggttagtaccgtttaagttacggttcgggttagaaccgttaaggagtacgtaccgtaccgtacggaacgggaccggtaggggtaccccttaagttacggtaccgttaacgggttcgggacccgtaacgggtcccggtacggtccctacccgg

SEQ ID NO: 237937 - DNA, 633 bp, Homo sapiens
  misc_feature: GYAE6OF02F87EU.42.74.G08.1.454.CMB.1.raw
  modified_base (218)..(218): a, c, t, g, unknown or other
  misc_feature (218)..(218): n is a, c, g, or t
  modified_base (282)..(282): a, c, t, g, unknown or other
  misc_feature (282)..(282): n is a, c, g, or t
  modified_base (331)..(331): a, c, t, g, unknown or other
  misc_feature (331)..(331): n is a, c, g, or t
  modified_base (388)..(388): a, c, t, g, unknown or other
  misc_feature (388)..(388): n is a, c, g, or t
  modified_base (502)..(502): a, c, t, g, unknown or other
  misc_feature (502)..(502): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctgggctgaggtgcagagcccgggctcagtgacgatttccngcaaggcttctggatacagtcttcagttagttatgctatacgaggtggtgcgcacggccccganaaaggcttagagtggcgtgggatggagtcggtcggtggcacgtcctaanataagtatattacactaagtagtttcagttcagtagtctaactttagcagcgacacncgtacccgacgacgacgaacgttctacgagtagggtacgttaggacgggttcggtaacctaagtacgttacgtagaacgtaccgacggtacctagttacctttaagtttaccgngttacgggacgtaaggtacgtacgtacgtaccgttaaccgacgggtaacgggtacggggtacccttagttacgtaacgttcgggtaccggggtaccgtaaccggggtaccgttaccgggtaccgtaccccg

SEQ ID NO: 237938 - DNA, 673 bp, Homo sapiens
  misc_feature: GYAE6OF02H56BS.42.74.G08.1.454.CMB.1.raw
  modified_base (134)..(134): a, c, t, g, unknown or other
  misc_feature (134)..(134): n is a, c, g, or t
  modified_base (223)..(223): a, c, t, g, unknown or other
  misc_feature (223)..(223): n is a, c, g, or t
  modified_base (310)..(310): a, c, t, g, unknown or other
  misc_feature (310)..(310): n is a, c, g, or t
  modified_base (395)..(395): a, c, t, g, unknown or other
  misc_feature (395)..(395): n is a, c, g, or t
tcagtgacgtatgtcacgaccggtgctcgatttagtagctctatcaggggacccaacaaccacatccctcctcagaacgcccccagagcacaactcctaaccatggactggacctggaggatcctctttttggnggcagcagccacaggtggccactcccaggtccactttgtgcagtctggggctggaggtgcagagcccgggctcagtgacgtattttccngctaagggctttcgaggtaattaccgagtcgtttcagttagttactgacttataccgagtgggtgtcgccgacgggcccccggtaanaaacggtcgttagaggtggtcgtaggagtggactcgggtcgtcggctacgtcaacataagatatcaactagtagtttcacgttanagtagtctacgtttagcacgtcgaactacgtcaccgaccggtaacaccgtagtcctaaacgtagtacggtaggttaggaggttacggacgttaaacgacgttaccgtagggaaacgtaaacgcgaccggttaacgttctttaacgttcgtacgttaaggaccggaaggtagtacttaccggtaccttaacgaacgggacgggtaaccggggtccttaagttcgtacttacgggtcggggacccgtaacgggtaccccggttgggtacccttaccccgg

SEQ ID NO: 237939 - DNA, 879 bp, Homo sapiens
  misc_feature: GYAE6OF02G7BAN.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtcgtgggctgaggtgcagacggcccgggcctcagtgacgtatttcctgcaaggtccttcgtggatacagtcttcagttagttatgcttatacgaggttgggtcgcggccgaccggacccccccggaagtaaacggtcgttaggaggttcgggcgtagggtagtggtaacgttcgggttaccggggtcggacccgtaaccgttaccctaaacgtaagttaaaggtaactttacgttaccaacgtaacggttaaacggtttttccaagtttaccgaaggtaacggtttaccgttaaacccgttttagaccgtagacccggtaaccaaccgtaccgtaccggaccgtaacgaacgtacgtactaaccgtagttagggttacggttacggtacgggttacggtaaccgttaaacgttaggttacccgtaaagtaaacccggaaccggtaacccgggttacgtttaaccgggtttaccgtttaaaccgtttaaccggtttagggtaccgacggggttaaacgtaaccggtagttttaacccggaacccgttttaaccgggaaccggggttaaccccggggtaaccggggggttaaccccttaacgggttttaccggtaaccggtttttacccggggaccgggggtaccccgggttaaacccggggttaacccccgggtttacggggtacccccgtttaacccccggg

SEQ ID NO: 237940 - DNA, 525 bp, Homo sapiens
  misc_feature: GYAE6OF02GEHNT.42.74.G08.1.454.CMB.1.raw
  modified_base (125)..(125): a, c, t, g, unknown or other
  misc_feature (125)..(125): n is a, c, g, or t
  modified_base (132)..(132): a, c, t, g, unknown or other
  misc_feature (132)..(132): n is a, c, g, or t
  modified_base (170)..(170): a, c, t, g, unknown or other
  misc_feature (170)..(170): n is a, c, g, or t
  modified_base (192)..(192): a, c, t, g, unknown or other
  misc_feature (192)..(192): n is a, c, g, or t
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (373)..(373): a, c, t, g, unknown or other
  misc_feature (373)..(373): n is a, c, g, or t
  modified_base (408)..(408): a, c, t, g, unknown or other
  misc_feature (408)..(408): n is a, c, g, or t
  modified_base (438)..(438): a, c, t, g, unknown or other
  misc_feature (438)..(438): n is a, c, g, or t
  modified_base (446)..(447): a, c, t, g, unknown or other
  misc_feature (446)..(447): n is a, c, g, or t
  modified_base (449)..(449): a, c, t, g, unknown or other
  misc_feature (449)..(449): n is a, c, g, or t
tcagtgacgtatgtcacgaccggtgctcgatttagtagctctatcaggggacccaacaaccacatccctcctcagaagcccccagagcaacaactcctaaccatggactggacctggagatcctnttttggngcagcagccacgaggtgccactcccaggtccactttgngctagtctggggctaggaggtnacagacgcccgggctcagtnacgtnttcngcaggtctctggatnagtcttacagtagttcngtctatangtggncgcncggacccganaacgctagngtgngtggagnggntcggcggtggctcgactagtagatactgtaccagtagttagtacgtgtaacctggtaatctacgttacgntacggactacactctacggcacgttcaagtccagngttacggctaggattcggacaggttcagtnaagcagtnntntgtgtgtgcgagacgcgtgtacgacgacgtacggtacgtacgtcgtacgtgtacgtcggtcgtcgtcgtcgcgtcg

SEQ ID NO: 237941 - DNA, 775 bp, Homo sapiens
  misc_feature: GYAE6OF02IUUTF.42.74.G08.1.454.CMB.1.raw
  modified_base (233)..(233): a, c, t, g, unknown or other
  misc_feature (233)..(233): n is a, c, g, or t
  modified_base (676)..(676): a, c, t, g, unknown or other
  misc_feature (676)..(676): n is a, c, g, or t
  modified_base (684)..(684): a, c, t, g, unknown or other
  misc_feature (684)..(684): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccgaggtcctactttgtgcagtcgtggggctggaggtgcagaacggcccgggcctcgagtgacgtacttttccgngccgtaaggtcctttactagggtattaccagtccttacgaagttaagttagtcgtacttaagtaacgtacggttggggtcgacccggtcccggaacccgggacccccccggtaaggtaaaacgggttccgtttaggaacgggttcgggtaccggttgggggtaacgtacgggtacggttccgggttcggggtaccggccttaaccgtaccctaaacggaattaaagtaacttaagttacctaacgaaaggttaaacgttttacgacgttacgtaaggtcgtacctttaacgtttagaccgtacgaccgtacaacgaccgtacccgacccgtaaccgtacgactactaagacgtgggttaggttcggaagggttacgtaaccgtaagtacgttactaacggtaacgacggtaacggtcgttacgttacttaagttaccgttagngtaacggngtaacctagtcgtactaccgacggaccggtaccggtaccttcgttacgtacggttaccggcggtaccggaggtaacccggctaccgtaccg

SEQ ID NO: 237942 - DNA, 841 bp, Homo sapiens
  misc_feature: GYAE6OF02FF9ZY.42.74.G08.1.454.CMB.1.raw
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagacgcccgggctcgagtgacgactttccngcaaggcttcnggactacgngtcttcagtagttangctatacagtcgggtgccgccgacggccccccggaagaaacggtccttgacggttggaccgttgggagttcggaatccgggtcgggttcgggacctaccgtaccgttaaaccgattaaacggtacttaactttcaacgtaaggttaaacgtttaccgtaaggtttacccaaggttaacgttaccgtaacccgtttttaagcccgtaacggtaccgaaccctaaccgaccgtttaccccgggaacccggaaacccggtaaccgtaaccggttacccgttaaacccgtaaggttacggggtaaacggtttacgggtaaacgggtttaccggggtaaacccgtaaacggttaacgttaccgtaaacggggtaaaaccgtaacccggtaaaccggggtcgttaccggtttaaccgtttaacgttttaaccgttacggggtttaccgaaggtaaaccggtagtaaccgtaccgttacccgttaaccgaccgggtaaaccggggccgggggtaacccttaacggtttacgtaaccggtttacggtaccggggaccgtaaccggggacccgtaccggttaccgtaaccccgg

SEQ ID NO: 237943 - DNA, 589 bp, Homo sapiens
  misc_feature: GYAE6OF02FIGTW.42.74.G08.1.454.CMB.1.raw
  modified_base (272)..(272): a, c, t, g, unknown or other
  misc_feature (272)..(272): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagagcccgggctcagtgacgatttcctgcaaggcttctggactacagcctttcaggttagttatgctatacaggtgggtnccggtccacggcccccggaacaaacgggcttacggagtcggctgggattggatcgtcggtggcacgtcctaacataagatattcactagtaagtttcaggttacagagtctacctttagcgagcgacacactcccgcgacgacacgtactacatcggtagtgaggtcggtctaagtatccgagaacgcgacggtctgtacttattcgtgtcgacggagtagctacgtacctaccgaacggccgggtaacgggtaccctacgtttagaacggtttacggacggggtacctaacgggaccccgttggtacccgtacccg

SEQ ID NO: 237944 - DNA, 873 bp, Homo sapiens
  misc_feature: GYAE6OF02IZMAN.42.74.G08.1.454.CMB.1.raw
  modified_base (127)..(127): a, c, t, g, unknown or other
  misc_feature (127)..(127): n is a, c, g, or t
  modified_base (248)..(248): a, c, t, g, unknown or other
  misc_feature (248)..(248): n is a, c, g, or t
tcagtgacgtatgtcacgaccggtgctcgatttagtagctctatcaggggacccaacaaccacatccctcctcagaacgcccccagagcacaactcctaaccatggactggacctggaggatccttnttttggtggcagcagccacgaggtcggcccacgtcccgaggtcctacgtttgtgactagtcgtggggtctggaggtgacgaaggacggccccggggtctcgtaggtcgacgtactttccgngactaaggtccttcgttaggacttaccgaggtccttacgtaaggttaacgtttatacgtaccttaagtacgtagggttgggtacgccgtaccggaccgggtaaccccccggaagtaaaaccgggtcgttacgggtacggtcggtacggtaggggtacgttacgggtaaggttccgggtcgggtacgggaccctacgttaacccggtaaactaacgtaaaggttaacgtaaccgttacgtaacgtaacgtacgtttacgttacgttacgagttacgttactacgtttagacgtacgtcgaacactacgtaccggacgaaccgtacgtacgttaccgtaactaggtaggtaaggtacggtacggtacggaaccgtttaaggtacgttcgaacgttaaacgggaccgtaacggtcgtttaacgtaccgtttaacggtttacgtaccggtacgggtaaggtacgtaaacggttacgtacccggttacccgtttaaccgggaacccggggttaaaccgggaacccggggtttacccttaaaccggtttacgttaccgggtaaaccggggttccgggtaaacccggtaaccgggggttaaccccttacccgggtacccctttaaccccggg

SEQ ID NO: 237945 - DNA, 749 bp, Homo sapiens
  misc_feature: GYAE6OF02GF0J3.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtcccactttgtgcagtcgtggggctggaggtgcaggacggcccgggcctcaggtgacgtatttccgtggacaggtcttctggatacagtcttcagttagttatcgtctatacgaggtgggtcgccgtccgaccggggccccccgggaacgaaacgggtcctttagggacgggttgggccggttagggggagttacggggtacgttcggggttcggggtcggaccgtaacccgtacccgtaaacaacgttaaaggtaattaacttaccgaaactaacgggttaaacgttttacgtaaggtttacacgggtaacgttcctaaccgtttaagacgaacggccgtaaccacgtacgtacccgacggaaccgtaaccgtaacgtacctaactaggtaggtacggttggtaaggtcggtaacccgtaagtacgttacgtaagaacggacgtacggtctacgttacttaacgttatcggtcgagaggaagtagtacgtccgttacgaccgggacgggtaccgggtacccttaagtttacgtacggttacggtaccgggtaccgaacccgggtaccgtccggtacccgtacccgg

SEQ ID NO: 237946 - DNA, 787 bp, Homo sapiens
  misc_feature: GYAE6OF02JPI9I.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctggaggtgcagacggcccgggcctcagtgacgtatttcctgccaaggccttcgtggatacagtccttacgtagttacgttatcgtacttacgtactaggttcgggtcgccggccccgtaccggtccccccgggaacgtaaacggtcgttaggacgtcggggtcgtacggggtacgtgggtacgttccggttcggggtacggtccgtaacccgttaccttaaaccggtataaaccggtattaacttacccgtaaggtaacgttaacgtttccgtaaggtttaccaggttaacgttccgttaacctttaacgccgaaggttacccgaacgtaaccctacgttcccggaacgtaaacccggtactaacgtacgttaacctagggtacgggttacgttgggtaaacgtttcggaacgttaacgtacgtttccgtaaggttaaaccgaccggttaccggtacgttcgtttacggttaacttacgtcggtacggtacgacggtatacgttctacccggtagaccggtacgggtacccggtcgtaaccgtttagaccggttttacggcgggttaacccggaacgggttaccccgttgggtaaccctcccgg

SEQ ID NO: 237947 - DNA, 549 bp, Homo sapiens
  misc_feature: GYAE6OF02FFP2O.42.74.G08.1.454.CMB.1.raw
  modified_base (461)..(461): a, c, t, g, unknown or other
  misc_feature (461)..(461): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaacgcccgggcctcagtgacgtatttcctgcaaggcttctggatacagtcttcagttagttatgctatacagtgggtgcgccacggcccccggacaaaggcttgagtggctggatggatcgtcggtggcactcctaacataagatattcacagtaagtttcagttcagagtcactttagctagcgacacatccgcgacgacagtactacatcggtagtgagtggctaagatctagaacgacgacgctgtctaattactgtgcgtaagngtatcgtaccttacgaccgtaacgggacggggaccctacgtttcgagttacgtggggacccgagggtaccccgtggtcctaaccccgg

SEQ ID NO: 237948 - DNA, 616 bp, Homo sapiens
  misc_feature: GYAE6OF02JYD24.42.74.G08.1.454.CMB.1.raw
  modified_base (144)..(144): a, c, t, g, unknown or other
  misc_feature (144)..(144): n is a, c, g, or t
  modified_base (207)..(207): a, c, t, g, unknown or other
  misc_feature (207)..(207): n is a, c, g, or t
  modified_base (289)..(289): a, c, t, g, unknown or other
  misc_feature (289)..(289): n is a, c, g, or t
  modified_base (357)..(357): a, c, t, g, unknown or other
  misc_feature (357)..(357): n is a, c, g, or t
  modified_base (425)..(425): a, c, t, g, unknown or other
  misc_feature (425)..(425): n is a, c, g, or t
tcagtgacgtatgtcacgaccggtgctcgatttagtagctctatcaggggacccgaacaaccacatccctcctcagaagcccccagagcacaactcctaaccatggactggacctggagatcctcttttggtggcagcagccanaggtggccactcccaggtccactttgtgcagtctgggctgaggtgcagagcccgggctcgagngacgatttcctgcaaggcttcgtggatacagtcttcgagtgttatgctatacaggttggtcacgccgtaccggcccccgganaaggtcttcggaagtgggcgtgggagtggtacgtcggtcggtcggcctaacgttccgtaaatagtaanacttagttaccacgtaagtaacgttttcagttacgtagtacgtccttaacgtttagaccagacctacnccgtaacgtccgacggacgacgtacgtacctacagtacgggtatacggaagttcgaaccttaagtacgtaccgtagacgtaccgagtcctagttactattacgtagtcgaccggaggtactacgtcgtacctacgacggtcggaccggtcgtacttagacgttcgacggcgaacggtccgtacgccgtacg

SEQ ID NO: 237949 - DNA, 595 bp, Homo sapiens
  misc_feature: GYAE6OF02F5XQ4.42.74.G08.1.454.CMB.1.raw
  modified_base (285)..(285): a, c, t, g, unknown or other
  misc_feature (285)..(285): n is a, c, g, or t
  modified_base (309)..(309): a, c, t, g, unknown or other
  misc_feature (309)..(309): n is a, c, g, or t
  modified_base (471)..(471): a, c, t, g, unknown or other
  misc_feature (471)..(471): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggcctcagtgacgatttcctgcaaggcttcgtggatacgagcttcagttagttatgctatacagtggtgcgccaggcccccganaaaggcttgagtggctggatggancgtcggtggcactctaacataagatattcaacagaagtttcagttcgagtacgtctaaccgtttagcagtacgaactacaactccgacgaaccgacaagtctaacagtgagttgaggtcgactaagatcgtagaacgacacgtctagtacctaagttaccgngtcgacgtaggaagtacttcggtaccttaaccgacggtaacgggaccggggtcccctaagttttcggaacgtttacggtacgggggaccctaacgggggtaaccccttaggtccctaaccccgg

SEQ ID NO: 237950 - DNA, 706 bp, Homo sapiens
  misc_feature: GYAE6OF02GUM7V.42.74.G08.1.454.CMB.1.raw
  modified_base (227)..(227): a, c, t, g, unknown or other
  misc_feature (227)..(227): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgtgcagtctggggctgaggtgcaggaacgcccggggcctcgagtgacgtatttccngcgaaggccttcgtggactacagtcttacagttagttatgtctatacaggtggggtgcggccgaccgggcccccggaacaaacgggtcttaggacgtgggcgtgggagtgggacgtcggtacgggtcggaccgtaccgtccctaaacaagtaaagtattacttaccgaacgtaagtaaacgttttacgacgtttacgaacggtacgttaccgtaacctttttaacgccgtaacggtacccgaactaaccgtaccgtcccggaaccggtaaccggacctaacggttacctaaactaaggttcgggtagttacgtacgggttacggaacccgttaaagtctaccgttaggaacacggacggtctacggttacttacttacgtgttcgaacggagacgtacgtcgtccgttacgacggtacgggaccgggtccctagttacgacgttacggcgggtaccgacgggtacctcggactacccgg

SEQ ID NO: 237951 - DNA, 653 bp, Homo sapiens
  misc_feature: GYAE6OF02JA1RA.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatccttcttttggtggcagcagccacaggtggccactcccaggtccactttgtgcagtctggggctgaggtgcagaagcccggggcctcagtgacgatttcctgcaaggcttcgtggatacagctttcagtagttatcgctatacaggtgggtagcgccgtacgggcccccggaacaaagggccttaggacgtgggcgtgggatggatcggtcggtggcctacgtcctaacagtaagatattcaactagtaactttcagttcagtacgtctacctttagactacgcgtacacgatcccggacgtaccgactagtactaacgtagtaggtagttacgagttggaccttaaaggacttcgtagacgaccgacgtcgtacgttctaacgttacgtggtgtaccggtaggacgtaacgttcggtaccctttaacgacccgggtaaacgggtaccggggtacccttaacggttacggtaacgttaccggggtacgggaccccggtaacgggaaccccgtttgggtaacccgttccccgg

SEQ ID NO: 237952 - DNA, 766 bp, Homo sapiens
  misc_feature: GYAE6OF02H1NM7.42.74.G08.1.454.CMB.1.raw
  modified_base (254)..(254): a, c, t, g, unknown or other
  misc_feature (254)..(254): n is a, c, g, or t
  modified_base (386)..(386): a, c, t, g, unknown or other
  misc_feature (386)..(386): n is a, c, g, or t
  modified_base (626)..(626): a, c, t, g, unknown or other
  misc_feature (626)..(626): n is a, c, g, or t
tcagtgacgtatgtcacgaccggtgctcgatttagtagctctatcaggggacccaacaaccacatccctcctcagaacgccccagagcacaacctcctaaccgatggacctggaccctggaggatccttctttttggtggcagcagccaacgaggtcggaccacctccccgaggttccctacgttttgtgactagttcgtggggactggaggtgacaggaaggccccggggctcgagtgacggtattttcccgngacgaacggtcgttctggaattacagtctttcgaaggtagtttagtgtcttaatacgtaggtgggtcgcgtccggaccgggacccccggagaaacgggtcgttacggacggtcgggcgttagggagtagggngttccggttacgggtggtaccgtaccttaaccgttaacaaattaaggtacttagttacgaacgtaagttagttttacaggtttacagtaccgtacttacgtttaacgcgtaacgccgaactacacgtaccgacgaagtacctaggtacctaagagttacggtagtaggtacgtacgtacgtaaagtcctagtacgaacgacggttaacgaccgttgttaccttcgttacttaggttacgnggtaacggtaagtaccgtttcgaaccgtaccggtacccggtaacgggtaacccggggtccttagtttaacgggtccggtttacggtaccggggtaacccggttaacccggggacgttttcccggggacccttaaccccgg

SEQ ID NO: 237953 - DNA, 661 bp, Homo sapiens
  misc_feature: GYAE6OF02FPY5Y.42.74.G08.1.454.CMB.1.raw
  modified_base (176)..(176): a, c, t, g, unknown or other
  misc_feature (176)..(176): n is a, c, g, or t
  modified_base (226)..(226): a, c, t, g, unknown or other
  misc_feature (226)..(226): n is a, c, g, or t
  modified_base (261)..(261): a, c, t, g, unknown or other
  misc_feature (261)..(261): n is a, c, g, or t
tcagtgacgtatgtcacgaccggtgctcgatttagtagctctatcaggggacccaacaaccacatccctcctcagaagcccccagagcacaactcctaaccatggactggacctggaggatccttcgtttttggtggcaggcagccacgaggtggccactcccaggtccactttgngcagtctggggctgaggtgcagacgcccgggcctcagtgacgtatttccngcaacggcttcgtggatacagtcttcagtagttangtactatactaggtgggtgcgccgacggcccccggaacaaaggtcgttggagtgggcgtgggagtggtacgtccggtcggtggctacgttacccttaacgacgtaagtatacttacgactaagtacgttcgtactttcgagtacgtctaccgttagctagacgacactcgtccgcggacgactacggtactacctaagtcggtaaggttcggagtcggaccgtaagtctcgttagaacgaccggtacggtcgtcgttactagtttacgttccgtgtacgtaaggtacgtacgtcgttacccgtaccgtacgggtaaccgggacgggtaaccccgtacgttttacggtagttacccggttgggacccgtacggggaccccgttcggggtaccctacccggg

SEQ ID NO: 237954 - DNA, 789 bp, Homo sapiens
  misc_feature: GYAE6OF02HDZ47.42.74.G08.1.454.CMB.1.raw
  modified_base (187)..(187): a, c, t, g, unknown or other
  misc_feature (187)..(187): n is a, c, g, or t
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtgcagcagccacaggtgccactcccaggtccacttgtgccagtctgggctgaggtncagacgcccgggctacagtgacgtattccngccaaggtctacgnggatacagtcttcaagtagttangtactatacgacgttgggtacgtcgaccgaccgggaccccccggtaacgaaaacggtccgtttagaacggttggaccgtggggtatcgggagttccggtacgggtcggccgtacctcccgtaaatacgtaaagtactagttaccactaaggtaagtttccaggttaccaggtacgtcctaacgttttacgactacggaacctactaaccgacgtacccgccgaacgtaccgacgttacctagtacttggggtaccttaggtaacggtgggtaaacccgttaaggaacgttcgtaacggtaaacgtcccgtaaacggtcgttaaccgttaccgtttaccgtttaaacgtttggtaaccggttacggtaacgtaacggtacgttaccggtacccttttaaacggaacccggggtaacgggttaaacccgggggtacccgttaaccgggtttttacgaacccggtttaaccggggtttacccggggtaaaccgttacccggggggtaaccccttccgggttaaccccgttaaccccgg

SEQ ID NO: 237955 - DNA, 764 bp, Homo sapiens
  misc_feature: GYAE6OF02H2XJ5.42.74.G08.1.454.CMB.1.raw
  modified_base (134)..(134): a, c, t, g, unknown or other
  misc_feature (134)..(134): n is a, c, g, or t
  modified_base (216)..(216): a, c, t, g, unknown or other
  misc_feature (216)..(216): n is a, c, g, or t
  modified_base (409)..(409): a, c, t, g, unknown or other
  misc_feature (409)..(409): n is a, c, g, or t
tcagtgacgtatgtcacgaccggtgctcgatttagtagctctatcaggggacccaacaaccacatccctcctcagaacgcccccagagcacaactcctaaccatggactggacctggaggatcctctttttggnggcagcagccacaggtggccactcccaggtccacttttgtgcagtcgtggggctgaggtgcaggaacgccccggggcctcgngtcgacgtactttcctgactaagggcctttacgtggtaacttacacggtcttaccgtaagttacgttatgcttaagtacgaggtcgggtcgaccgcccgaccgggtcccccggaagtaaacggtccttaggaggtggtccgtagggagtggagtccggtgggtcgtcgaccttccgtaaacgtagtaaacgtnttacgtcaacgtagttaacgtttcgtaagttccaaggtacctacctaaccgtttaagacctaacggactaacgaccgtaccgtcccgtaacggacctaaccgacgtttaacgaacgtggtttaacggtggttagggacgttccggtaaccgttaaagtaaccttggtaacgaacgtacccggtacgtcgtcggtttaaccttaaacgtttccgtggtaccggacgtaaaggagtccgtaacgttacccgtaacggaacgaaccgggggtttaaccccgggcctttaagggttaccgtaccggttaggggtcccgggtaccgtaaccggggtaacccctcgggtccctaaccccgg

SEQ ID NO: 237956 - DNA, 762 bp, Homo sapiens
  misc_feature: GYAE6OF02IWEPQ.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggactccttctttttggtggcagcagccacgaggtcggccacctcccacggtcctacgttttgtgctagttcgtggggcttggaaggtgcgaggaaggcccggggcctcgagtgacgtactttccagcgaacggtcctttcgtacggactacgagtctttcgagtttagttatgtctactacgtaggtgggtcgccgccgacgggcccccggaacgaaacggtcgttcggaggtcgggcgtagggtaggtagggtacgttcgggttcgggttcgggacctacccgtacgtaactaaacgtaagtaacttacgttacgaacgttagttaaacgtttcgtaagtttacgtacgtaacgttaccttaacccggtttagtaccgacgaacgtaccaccgtacgtcccggtaccgaaccgtaccgtaaccgttactaactggtacgggttaacgttggacggtcggttaacctaaggtctacgtaagaacgtacgtacggtacttcggttaacttagttacgttgtaacgacggacgtacgtacgtccgtaccgttacggtaaccgggtaaccgggtacgggttacccgtaacgtttcggaccggttacgggccgggaccggaacggtacccggttccgtacccgtcccg

SEQ ID NO: 237957 - DNA, 587 bp, Homo sapiens
  misc_feature: GYAE6OF02H23P9.42.74.G08.1.454.CMB.1.raw
  modified_base (301)..(301): a, c, t, g, unknown or other
  misc_feature (301)..(301): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggtggcagcagccacaggtggccactcccaggtccactttgtgcagtctgggctgaggtgcagagcccgggcctcgagtgacgatttccgtgacaaggctttcgtggaattaaccgaggcctttcgaagttagttatgctatacgagtgggtgcgccacggcccccggaanaaaggtcttaggagtgggctggggtagtggacgtcggtcggtggcacctcctaacataagattattcaactagtaagtttcagttcgagtacgtctacctttagcaggcgacacactccgacgacgactagtctacagtaggtgttgagtcggtactaagagtactagaagacgacggcttagtacttattacgtgtgcgagagtntntaccgtacgacgacggacggggtacctacttgtacgtttacggtcgggaccgtacgggacccgttcggtcctacccgg

SEQ ID NO: 237958 - DNA, 695 bp, Homo sapiens
  misc_feature: GYAE6OF02J0WVA.42.74.G08.1.454.CMB.1.raw
  modified_base (189)..(189): a, c, t, g, unknown or other
  misc_feature (189)..(189): n is a, c, g, or t
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
  modified_base (283)..(283): a, c, t, g, unknown or other
  misc_feature (283)..(283): n is a, c, g, or t
tcagtgacgtatgtcacgaccggtgctcgatttagtagctctatcaggggacccaacaaccacatccctcctcagaagccccagagcacaactcctaaccatggactggacctggaggatcctctttttggtggcagcagccacaggtggccactcccaggtccacttgtgcagtctggggctgaggtncagagcccgggctcagtgacgatttccngcaggtctttcgnggatcagtcttcagtagttactgctatacgagtggtgcgccacggccccgtanaaggtctgagtcggcgtggagtggtacgttcggtcgggttggaccctacgttaaccctaaactaagtaaacggtacttactttaaccgactaaggttaaacgtttcgtaacgttcgtaacgtacgtaccttaactttacggacgaagtacgacctactaaccgtcccgaccgacgtaaacgaccgttactaaccgtaggttaggtaacggtttcggaaggttccgaaccgtttaaggaccgtagtaacgagtaccgaccgttatccgttacgtacttacgtgtacgtcgaacgtagactaccgtactaacggtacccggaagggtaccgggtaccttaccgttaggtaacgtttaccccgggtgggaaacccgtacggggtttaaccccgttcgggtaccctttaaccccgg

SEQ ID NO: 237959 - DNA, 801 bp, Homo sapiens
  misc_feature: GYAE6OF02GPZKV.42.74.G08.1.454.CMB.1.raw
  modified_base (178)..(178): a, c, t, g, unknown or other
  misc_feature (178)..(178): n is a, c, g, or t
  modified_base (262)..(262): a, c, t, g, unknown or other
  misc_feature (262)..(262): n is a, c, g, or t
tcagtgacgtatgtcacgaccggtgctcgatttagtagctctatcaggggacccaacaaccacatccctcctcagaacgcccccagagcacaactcctaaccatggactggacctggaggattccttgtttttggtggcagcagccacagggtgccactcccgaggtcctacgtttgngcacgtcgtggggctggaggtgcaaggacggcccgggctcgagtcgacgtatttccgtgcgaacggtctttcgtaggaatacgngtccttacgagtttagttacgtgtacgttaataccgtaggtcgggttacggccggtaccgaccgggtacccccggaacgtaaacgggtccttaggacggtcgggcggttacgggacgttcgggtacttcgggttccgggtcggtcccgtaaccgttaaccctaaccttaaagtaaaggtacttttaacgttaccaaaccgttaaaggttaacgtttaccgtagtttaacgtaagtacgttaccgttaaccgtttacgaacgacggtaccgaaccgtactaccgtaccgacccggtaacaccgtaacgttaccagtaagtgggtacgttaggagtcgggaacctagtactacgtaggaactaaccgtacgttccgtaagtttaccctttagtaccgtttgtaccggagtaaacgagttacgaccgtttaccgtaacggaccggggtaacccgggacgggttaccctaacgggtttacgtaccgttagggtccggggtaaacccgtaccgggtacccggttacggtacccttaaccccggg

SEQ ID NO: 237960 - DNA, 807 bp, Homo sapiens
  misc_feature: GYAE6OF02IPL8L.42.74.G08.1.454.CMB.1.raw
  modified_base (138)..(138): a, c, t, g, unknown or other
  misc_feature (138)..(138): n is a, c, g, or t
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (715)..(715): a, c, t, g, unknown or other
  misc_feature (715)..(715): n is a, c, g, or t
tcagtgacgtatgtcacgaccggtgctcgatttagtagctctatcaggggacccaacaaccacatccctcctccgtagaacgcccccagacgcacaactcctaacatggactggacctggaggactccttcttttggngctagcagccacagtcgccactacccaggtccctacttcgtcgctagtccgtgggctggagtgacgagaacggcccgggctcgagngactattcgngacagtcttacgngatacncgtcttagagttagttagtgtaccttagtaaccggtaggttcgggcgccggtccgacccgggtacccccggaagaaaaggttcgttagggacggtcgggtacggtagggtacgtacggggacttcggggtcggtacgggtaccctaaccgtacccgttaaaaggtacggtaaagttaccgtttaaaaccgttcgaaacgttaaggttttaaacggttttccgtaagttaccgggtaaagtccggttacctaaaccgttagtacccgaaggtcccaaaacgtccgtaaccgtaccggacgtaaacccgtacggttaaccgtacgttaaccgtgggttaaacgtcggggttacggtaacggtttccggaaaacgtttccgtaagtccgtaaggaaaccgtccgtacgggttaccgtacgttacgtttaccgtaggtcccgttaggaaaccggtggtaaacccgnttccggaccgtaacggacgggtaccggtaccggtccttacggttacgtcggaccggtcgggtacccggtacggaaccgttcgacccttacgg

SEQ ID NO: 237961 - DNA, 833 bp, Homo sapiens
  misc_feature: GYAE6OF02HLOA0.42.74.G08.1.454.CMB.1.raw
  modified_base (141)..(141): a, c, t, g, unknown or other
  misc_feature (141)..(141): n is a, c, g, or t
  modified_base (262)..(262): a, c, t, g, unknown or other
  misc_feature (262)..(262): n is a, c, g, or t
tcagtgacgtatgtcacgaccggtgctcgatttagtagctctatcgaggggacccaacaaccacactccctcctcagaacgcccccagagcacaactcctaaccatggactggacctggagacttcctttcttttttgggnggcagcacgccacgagggtcgcccacctcccgaggttcctacgtttgtcgcgtagttcgtggggtctggtaggtgacgaaggacggccccgggtcctacgagtacgacgttacttttccgngacgtacggtccttcgtaggaacttaccgagttcgttacgtagttagttagtcgtacttaacgttacgtacggttgggtcgcgtacccgaaccgggcccccggaagtaacggtcgttggacggtcgggtacggtaggtacggttggacgttccgggtcggcgtaccctaacgttacctaaagaagttaacgtacttactacgaacgttacgttaacgtttctacgttagacgttacgttaccgttaacgtttacgcggaacctcggaaaccacgttaccgcccggacggaaacccgacgttaacgttaccgtaagtacgggttggttaacggttaaggcggttaccgtaacgttaagcccgttagaacgtaacggaccgtcgggtttaccgttcgttaacgttacgtttacgttcggaacgtaggttaaacgaggttaccttaaccggttaaccgttaaccggaccggggtaaccggggttaccggtacctttaccggtttaggaacccggttttcgggaaccgggtaaccgggttaacccggttaacggtcccggttaacccgtacccgg

SEQ ID NO: 237962 - DNA, 898 bp, Homo sapiens
  misc_feature: GYAE6OF02HGHRM.42.74.G08.1.454.CMB.1.raw
  modified_base (133)..(133): a, c, t, g, unknown or other
  misc_feature (133)..(133): n is a, c, g, or t
  modified_base (178)..(178): a, c, t, g, unknown or other
  misc_feature (178)..(178): n is a, c, g, or t
  modified_base (242)..(242): a, c, t, g, unknown or other
  misc_feature (242)..(242): n is a, c, g, or t
tcagtgacgtatgtcacgaccggtgctcgatttagtagctctatcagggacccaacaaccacatccctcctcagaacgcccccagagcacaactcctaaccatggactggacctggagatccttctttttggnggcagcagccacgaggtcggccacgtcccgaggtcctacgtttgngcagtcgtggggctaggaggtgacgaaggacggccccggggcctgaggtgacgtacttttccgngacgtaacggtccttcgtaggacttacgagtctttacgtaaggttagttagtcgtacttacgtacgtagggttgggtcgaccgacccggaaccgggtacccccggaaagaacgggttctttaggacggtcggtcgtaggggtagtcggtacgtccgggtggtcgactaccgtaacctaaacgtaagtaagtattacgttacaacgttaagtacgtttcgtaacgttcgaagtaccttacgttacgtttacgactacggaccgtaacaccgtacgtaccgaccggtaaccgtaacgttacggtaccttaacgaggttagggttagttacgggtacggttaccgggtaacccgttaaagtaccgttacgtaaacgggtaaaccgtaccgggtacggttaaccgtttaccgtttaacccgtttagtttaaccgggtttcggtacggaacccggttaaaggaccgttttaaccgttacccggttaacccgtttaaacccgggaacccggggttaacccggggtacccggggtttaacccctttaaccgggttttaaggttaaaccccgggtttttacccgggggaaacccgggggtaccccggttaaaacccggggggtttaacccccgttacggggtttaacccccttaccccccgggg

SEQ ID NO: 237963 - DNA, 745 bp, Homo sapiens
  misc_feature: GYAE6OF02JTLJR.42.74.G08.1.454.CMB.1.raw
  modified_base (125)..(125): a, c, t, g, unknown or other
  misc_feature (125)..(125): n is a, c, g, or t
  modified_base (132)..(132): a, c, t, g, unknown or other
  misc_feature (132)..(132): n is a, c, g, or t
  modified_base (170)..(170): a, c, t, g, unknown or other
  misc_feature (170)..(170): n is a, c, g, or t
  modified_base (526)..(526): a, c, t, g, unknown or other
  misc_feature (526)..(526): n is a, c, g, or t
tcagtgacgtatgtcacgaccggtgctcgatttagtagctctatcaggggacccaacaaccacatccctcctcagaagcccccagagcacaactcctaaccatggactggacctggagatccttnttttggngcagcagccacaggtggccactcccaggtccactttgngcagtcgtggggctggtaggtgacgaaggaacggcccgggtacctcgaggtgaaccgtgtttccctggaccgtaacggtccttcgtgggactaacgagtccgttacgaaggttattagtcgtctatacgaggttcgggtcgcggtcccgaacggcccccggaagtaaacggtcgttagacggttcggcggtagggtagtcggtagtccggtgggtcgccgttacctaccgtaaagtagtaagtactacgttaccgaattacggtaacttttacgacgttaacgtagtacgttaaccgttacgtttaacgcgtacgaccgactacctacggtcccgacgacgacgtacgtcgtaagngttaggaagttcggacggtcggtaactagtacgtacgtacggtaagaccgtacggtctacgttacgttagttaccgtggagttaccggtaagtacgttacgtcccgttaccggtaacgaaccggggtaccggtaaccgggttaccttaacggtttcggttaccggtaacggtttcggggaacccgtaacgggttaccgttacggtacccgttaacccgg

SEQ ID NO: 237964 - DNA, 776 bp, Homo sapiens
  misc_feature: GYAE6OF02H4TDH.42.74.G08.1.454.CMB.1.raw
  modified_base (655)..(655): a, c, t, g, unknown or other
  misc_feature (655)..(655): n is a, c, g, or t
tcagtgacgtatgtcacgaccggtgctcgatttagtagctctatcagggacccaacaaccacatccctcctcagacgccccagagcacaactcctaaccatggactggacctggaggatcctctttttggtggcagcagccacaggtggccacctcccaggtcctactttgtgcagtcgtgggcttgaggtgcaggaacggcccggggtcctcgagtgacgtatttccgtgacgaaggtcttcgtaggtatacacgtcttactagttacgttagttcgtacttagtaccgtaggttcgggtcgccggaccgaccgggtacccccgggaaagtaaacggtcgttgtacggtcggacgtggggtacgttaggtacgttccgggtcggtcggtaccgttaccgttaaccgtaaactaagtaacgtaacttaacgttcaacgtaacgggttaaacgttttcgaagttacgaacggttacttaccgtacccgttttaagacgtacgtaccgaactacgacgttaccgaccgtaaccgaaccttaacggtactacgtacgtacgggttacgttaggtacggtcggtaaccgtaagtattaccgtaggtaaccggaaccgtacggttcgtacggttttacgtagttaaccggtcggttaacnccggtaaggtacgtacgttacgtaccctaaccgttacgggacggtacccgggtacctacggtttacgtacggttaccggtccgggaccggtaaccgggtacttccggtacccgtaacccgg

SEQ ID NO: 237965 - DNA, 633 bp, Homo sapiens
  misc_feature: GYAE6OF02FOSOI.42.74.G08.1.454.CMB.1.raw
  modified_base (257)..(257): a, c, t, g, unknown or other
  misc_feature (257)..(257): n is a, c, g, or t
  modified_base (297)..(297): a, c, t, g, unknown or other
  misc_feature (297)..(297): n is a, c, g, or t
  modified_base (350)..(350): a, c, t, g, unknown or other
  misc_feature (350)..(350): n is a, c, g, or t
tcagtgacgtatgtcacgaccggtgctcgatttagtagctctatcaggggacccaaacaaccacatccctcctcagaagcccccagagcacaactcctaaccatggactggacctggaggatcctctttttggtggcagcagccacaggtggccactcccaggtccactttgtgcagtctggggctgaggtgcagaagcccgggctgagtgacgtatttcctgcaaggcttctggatacgagcttcaagttagttangcttatacagttgggtcgtcgcccgagggccccccggaanaaaacgggctttaggacggtggcgtgggatggatcggcggtggcactcaactntaagatattcactaagtagtttcagttcagtacgtcaactttgacagcgacacgactccgacgacacagtctacatggagttgagtcgtactaagactcgtagaacgaccgtacggctacgttacgtaacttacgttcgtggacgtaggtagtagttcgtaccgttaccggaacgggtaaccgggtaccggggggtaaccccttacggttttaccggtacgttttacgggtccggggtaacccggtaacggggtaaccccggttcgggtacccgttaccccgg

SEQ ID NO: 237966 - DNA, 803 bp, Homo sapiens
  misc_feature: GYAE6OF02GUBK3.42.74.G08.1.454.CMB.1.raw
  modified_base (242)..(242): a, c, t, g, unknown or other
  misc_feature (242)..(242): n is a, c, g, or t
tcagtgacgtatgtcacgaccggtgctcgatttagtagctctatcaggggacccaacaaccacatccctcctcagaacgcccccagagcacaactcctaaccatggactggacctggaggatccttctttttggtggcagcagccacgaggtggccacctcccgaggtccctactttggtgcagtcgtggggtctggaggtgcagaacggccccggggcctacgacgtgacgtactttccgngcgaaggtcgttcgtaggatacgagtccttacgtaagttagtttatcgtacttaactaacgtagggttcgggtcgccggacccggacccgggaccccccggaacgtaaacgggtccgttaggacggtgggtacgggtggggtagtgggtacggttcgggtcgggttcggaccgtaccgtaacccgtaacgtaataaggtacgttaacgttacgtaaacgtaagttaacgttttacgtaacgttacgtacgttaacggttaccttaaccgtttacgacgtacggaccaccgtaaccgtacgtaccccggacgtaacccgaaccgtcgttaacccgtaagacgttaggtaggttggtacgggttcggtaaaccgttaacgtacgttacgtaaggaaccgtaccggacggttacgttacgttacgttacttgtacggtagcggtaagtacgacgttaccgttaccgtacggaaccggggtaaccgggaccgggttacccttaggttacgtacgttaccgggtacgggacccggtacgggtacccggttcggtacccgtacccgg

SEQ ID NO: 237967 - DNA, 693 bp, Homo sapiens
  misc_feature: GYAE6OF02JNAHU.42.74.G08.1.454.CMB.1.raw
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
tcagtgacgtatgtcacgaccggtgctcgatttagtagctctatcagggggacccaacaaccacatccctcctcagaagcccccagagcacaactcctaaccatggactggacctggaggatcctctttttggtggcagcagccacaggtggccactccccaggtccactttgtgcagtctggggctgaggtgcagaagccccggggctcaggtgacgattttccngacaaggtctttctggatacgagtcttcagttagttangctatacaggtgggtgcgccacggcccccggagaagcgtgagtgggctggggtagtggtacgtcggtcggtggcctactccgtaactaataaggacttagtacgaactacggtaaacggtttactaacggttacgtaacgtacggttacctaccgtttacgactaacgggaccaacgtactaccgtccgaacggacgtacctacggttactacgtagttagggtaggttcggtacggttcgggtaacttagaacttcgtagaacgcgacggtctcgttacttacttacgtggtacggtgaacggtacgtacgttcgaccgtttaaccgacgggtaacccgggaacggggttacccgttaacgttccggttaggtttaccgggtacggggtaccggtaaccggggtacccgttacggtacccgtacccgg

SEQ ID NO: 237968 - DNA, 623 bp, Homo sapiens
  misc_feature: GYAE6OF02IJ1LJ.42.74.G08.1.454.CMB.1.raw
  modified_base (133)..(133): a, c, t, g, unknown or other
  misc_feature (133)..(133): n is a, c, g, or t
  modified_base (173)..(173): a, c, t, g, unknown or other
  misc_feature (173)..(173): n is a, c, g, or t
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
  modified_base (261)..(261): a, c, t, g, unknown or other
  misc_feature (261)..(261): n is a, c, g, or t
  modified_base (487)..(487): a, c, t, g, unknown or other
  misc_feature (487)..(487): n is a, c, g, or t
tcagtgacgtatgtcacgaccggtgctcgatttagtagctctatcaggggacccaacaaccacatccctcctcagaagcccccagagcacaactcctaaccatggactggacctggagatccttctttttggnggcagcagccacaggtggccactcccaggtccacttttgngcagtcgtggggctgaggtncaggacgcccgggctcagtgacgtatttccngacgaaggcttctaggataccagtcttcagtagttangactatacaggtggcgccgccgaccggccccgaagaacggtcgtgtacgtggacgtagggtagtggtacgttcggtcggtcgacctacctacctaagaagtaagtattacgtacacgtaagtaagtttcagttacaagtctactacgttagacgagacacacacgccgacgacactactactagtagtggtagtacgtagtacgtactagatacgtagacgaccgngtcttacgtacttagttcgttagacgacgtagacgtagtacgttacctacggtaccggacgggtaacccggtaccttacgttagtacgttacggaccgggtaccggtaacggtacccgttaccggtaccctacccg

SEQ ID NO: 237969 - DNA, 756 bp, Homo sapiens
  misc_feature: GYAE6OF02IGLV4.42.74.G08.1.454.CMB.1.raw
  modified_base (133)..(133): a, c, t, g, unknown or other
  misc_feature (133)..(133): n is a, c, g, or t
  modified_base (198)..(198): a, c, t, g, unknown or other
  misc_feature (198)..(198): n is a, c, g, or t
  modified_base (608)..(608): a, c, t, g, unknown or other
  misc_feature (608)..(608): n is a, c, g, or t
tcagtgacgtatgtcacgaccggtgctcgatttagtagctctatcaggggacccaacaaccacatccctcctcagaagccccagagcacaactcctaaccatggactggacctggaggatccttctttttggnggcagcagccacgaggtcggccacctccgaggtccacttttgtgctagtcgtggggctggaggtnacgagacggcccggggcctacgaggtcgacgtacttttccgagcgaacgggtcctttcgtacgggaataccgtacgtcttttacgagttacgttatcgtacttatacgtaggtgggtcgaccgccgaccgggacccccggaagaaacggtcttaggaggttcggcggtacgggtaagtgggacgttccgggtcgggttcggacctacgttaaccctaacgtacgttaaagtacgtttactaccgtaacgtaacggttaaagtttccgtacggtttacaacggttacgtaaccgtttacccgttttaacggacctaacgggacccaaacgtccgtacggtacccggacggtaaccgaacctacggtactaccgttaagtcgggtagttacggacgtacgtaacgtacggtnttaccggtagaacgaccggcgtcttaggtacgttacttacggtcgtacggacgtacgagttacgacgtaccgttacgacggacgggtacgggccctaggttacgacgttcgggaccgggacgtaccgggaccttcgggtaccctaccg

SEQ ID NO: 237970 - DNA, 838 bp, Homo sapiens
  misc_feature: GYAE6OF02G578R.42.74.G08.1.454.CMB.1.raw
  modified_base (173)..(173): a, c, t, g, unknown or other
  misc_feature (173)..(173): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtggccactcccaggtccactttgngcagtcgtggggctgaggtgcagacggcccgggctcagtgacgtatttcctgacgaaggtcttctggactacgagtcttacagttagttatgcttaatacgtaggttggggtgcgaccgaccgggcccccggaagtaaaggtcgttaggaggtgggcgtaggggacgtggtacgtcgggtcgggtcgaccgtacctaccgtaaactagtaaagtattactaccaaacgtaagttaaacgttttacgacgtttacgaaggtacgttaccgttaccgtttacgaccgtagaccgaactaaccgtacgtaccccggacggtaacccgtacgtaaccgttacctaacgtaaggttacgggtaaggtttacggaacgggtttccgggaaccctttaaaggtaccttacggtaaacggtaaaccggtaaccggtaccgggttcgtttaacggtttacgtttaacgttttaccggtaggttacggaaccgggtacggttaaacggttaccggttacccgttaccgtttaacccgggaaccggggtaacccggggtaaccgggggtacccctttaccggttttaacgggtaacggttttaccggggtaacccgggggtaccccggttaaaccgggggttaccccggttacggggttaccccgttacccccggg

SEQ ID NO: 237971 - DNA, 674 bp, Homo sapiens
  misc_feature: GYAE6OF02GT0NU.42.74.G08.1.454.CMB.1.raw
  modified_base (133)..(133): a, c, t, g, unknown or other
  misc_feature (133)..(133): n is a, c, g, or t
  modified_base (223)..(223): a, c, t, g, unknown or other
  misc_feature (223)..(223): n is a, c, g, or t
  modified_base (257)..(257): a, c, t, g, unknown or other
  misc_feature (257)..(257): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggnggcagcagccacaggtggccactcccaggtccactttgtgcagtctggggctggaggtgcagaagcccggggctcgagtgacgatttccngcaaggcttctggatacagtcttcagttagttangctatacagtgggtgcgaccgacggcccccggaacaaaggccttaggacgtggcgtgggatggagtcggtcggtggctactcctaaacagtaagtactatacaacgtaagtaacgttttcagtttccgaagtacgttctaaccgtttaagccgtaagtcgaactaacgacgtccgaccgacgacgtacggtactaaccgtagtacgggtagttaggacgtacgggtaccgtaaagtacttcgttaagaaagtaccggacggtctagtaccttagttacgttagtgcggtaagagtaagtccgtaccgttaacgaaccgggtaacgggaaccggggttacccctaacgttttacggaaccgtttacgggtacggggtaccgtaacccggggacccgtttacggggcccttaaccccgg

SEQ ID NO: 237972 - DNA, 708 bp, Homo sapiens
  misc_feature: GYAE6OF02GU6PO.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggactccttcttttggtggcagcagccacaggtggccacctcccgaggtccctactttgtgcagtcgtggggctggacggtgcaggaacggccccggggcctacgagtcgacgatttcctgacgaaggtcttcgtggtacgtactagtcttcaagttagttagtgtacttatacgtaggtcgggtagccggccgaccggcccccggaacgaacggtacgttggagtggaccggtaggggacgtgggacgtccgggtcgggtacggcctaaccgttacctaacgaagtaagtattaacgtacaacgtaagtaacgttttacgtagttacggtagtacgtacgttaccgttagcgtacgacgtaccaactcggccgaccgacgacgtacgtacaggtaggtggtagtaggacggtacgtaacggtaatcgttacgtaacgtacgacggtacggtcgttacttacgtagttacgtcggtacgtaggagtaagtccgtacgtaccgtaaccgcggggtaccgggtaaccggttacggtacgttacggtaagtcgggtaccggaccgtaccggggtacccgtccgtaccgtcccgg

SEQ ID NO: 237973 - DNA, 736 bp, Homo sapiens
  misc_feature: GYAE6OF02IF3UA.42.74.G08.1.454.CMB.1.raw
  modified_base (533)..(533): a, c, t, g, unknown or other
  misc_feature (533)..(533): n is a, c, g, or t
tcagtgacgtatgtcacgaccggtgctcgatttagtagctctatcagggacccaacaaccacatcccctcctcagaacgccccccagagcacaacctccctaaccagtggactggacctggaggacttccttcttttttcggtggacacgcagccctaacgagggtcggccaccttccccaggtccctactttttgtgctagtccgttggggctggaggtgcaggaacgccccggggctccaggtgacgtactttccgtgcgtaaggtccttcgtggataccacgtcttcgagttacgttagtcgctaatacgtaggttgggtgccgaccgtaccgggacccccgaagtaacggccttggacggtcggcgttgggatggacgtgggcggtgaccctactacccgtaactagtaaacgtgttacgtacacgtaagttcgtttacgaagtttcgaagtaccgtacttaccgtttaagcgtaacgtccgaactactacgtcccgacgtaaccgacgtcgtaccacgtagttagggngttggacgtacggtacgtaatacgtagtacgtaaacgccgacggtccttacggtttcgtaacgtttgtcggtacgaaggtacgtaagtcgttccgtacccgttaacgaccgggaacgggtaaccgggttcccttaacggtttcgaacggtttccgggaacgggttcccggaaccgggtcccggttacggtacccgtaccccgg

SEQ ID NO: 237974 - DNA, 903 bp, Homo sapiens
  misc_feature: GYAE6OF02F9BTJ.42.74.G08.1.454.CMB.1.raw
  modified_base (130)..(130): a, c, t, g, unknown or other
  misc_feature (130)..(130): n is a, c, g, or t
tcagtgacgtatgtcacgaccggtgctcgatttagtagctctatcagggacccaacaaccacatccctcctcagaagcccccagagcacaactcctaaccatggactggacctggagatcctcttttggnggcagcagccacaggtggccactcccgaggtccctacgtttgtcgcagtcgtggggctggaggtgcgagaacggcccgggtcctcgagtgacgtatttcctggacaaggtccttcgaggtactaacgaggtccttacgaacggttagtttacgtcgtactacttaacgaacggttggggttacgccggtacccgtaaccgggtaccccccccgggtaaacgtaaaaccggggtccgtttagggtaacggttcgggggaaccggttgggggtaacttacggggtaaacgtttccgggttaaccggggttcggggttaccctaacccgtttaaccccgtaaaaccgtaaaggttaaacgtaaaccgtttacgtttaaccgaacgttaaacgggttaacgttttaaccgtaacgttaccgtaaaggttaacggttacccgtaacccgttttaaggaaccctaagggtaccgtaacccgaacgtacctaccggacccgaacgacgtaaccgtacttaaccgacgttagggtacggtagtacggtacggtaacccgttaaggtaacgttccgtaaggaaacgtaccggacgttcgtacgttacgttaacgttacgtaagttcgtacggaaggtacggtactaccgtaccggttaaccgtacgggtaaaccgggtaccggggtaccccgtttaagtttaccggtaaccggtttacggggtaccgggtacccgggttaaaccgggtaccccggttaccgggttaccccgttaaccccggg

SEQ ID NO: 237975 - DNA, 867 bp, Homo sapiens
  misc_feature: GYAE6OF02GNZOK.42.74.G08.1.454.CMB.1.raw
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
tcagtgacgtatgtcacgaccggtgctcgatttagtagctctatcaggggacccaacaaccacatccctcctcagaagcccccagagcacaactcctaaccatggactggacctggagatcctcttttggtggcagcagccacgaggtcggccacgtcccaggtcccatttggtgctagtcgtggggctggaggtgcaggaggtcccggggctcaggtgactattttccgngcgaaggtcctttcgnggaacctagacggtctttaccaagttaggttaactcggtacttacgtaacgtagggttcggggtcgtcccggaccggaccggacccccggtaacgaacgggtccgttcggaacggtcggtacggtcggggtatacgggacgttcgggttccgggtacgacccgtacttaacccgtaactaaacggtaagtacgttaacgtacctagtaaacggttaacgtttacgttacttacggaacgggttaccttaccggttacgtttacgacgtaaccgtacgtaccgaacgtcccgtaaccgtaccggaccgtaaccgtaaccgtttccgtaaacggttagtcgggtaaacgggttcggtaacggttacggtaaccgtaacggttaacgttacgtaacgtaaacggtacgtaaccccggtttagtacgtttacccgtttaagtttaccggtacgggtttaacgggttaccgacgggtttaagcccggttaacggttaccccgttaaccggggtaccgggtaaaccgggtacccgggggttaccttaaccgggtccggtttaacggttacccgggtacgggaaaccccgggttaccgtaaccggggttccgtaccccgttacccgg

SEQ ID NO: 237976 - DNA, 988 bp, Homo sapiens
  misc_feature: GYAE6OF02H5XGF.42.74.G08.1.454.CMB.1.raw
  modified_base (184)..(184): a, c, t, g, unknown or other
  misc_feature (184)..(184): n is a, c, g, or t
tcagtgacgtatgtcacgaccggtgctcgatttagtagctctatcaggggacccaacaacccacatccctcctcagaagccccagagcacaactcctaaccatggactggacctggaggatcctctttttggtgcagcagccacgagtggccactcccgagtaccactttgtgcagtcgtgggnttggaggtgcaaggaacggcccgggtacctcgagtcgtaccgtactttccgtgaccgtaacggtcttacgtacggtaataccgacggtcgtttacgaagttagtttacgtcacgttataccgtaagggttgggtacgtccgtacccgacgggaccccccggaaacgtaaacggttccgttaggaacgtgggtcgacggggtagtaggacgtaccggtcggtacggccttacgtaccctaaagtaagaaacggttacttaacgttaacaggttaaaccggtaaacgttttcgttaacgtaacacggttaactccccgttaaacgtttcggaaccctaacgggacccgtaaaaccgtaaccggtaaccgtacccgggaaccggaacccgttaaacggtaccgtaaaccgtaaacccgttaagggttaacggtttaacgggttacggtaaccggtttaaccggtacgggtttaaaaccgtacgggtttacgttaaaaaccggaaaccgggttaaacccggtacgggtttaaccgtttaaacccgggtttccgttttttaaaccggttaccggtaacgggtttttacgggaaaccccggggtaaaggtttaaacggtaccgtttaaccgtaacccggttttaaaccgaaccccgggggggttaaacccggggttaaccccggggttaacccgtttttaaccgggtttaaccggtttaaaccccgggtttacggggtaacccgggggtaaacccgggttaaccccgggtttaccccgggtttacccgggtttaacccggtacccccggg

SEQ ID NO: 237977 - DNA, 730 bp, Homo sapiens
  misc_feature: GYAE6OF02IHPTN.42.74.G08.1.454.CMB.1.raw
  modified_base (173)..(173): a, c, t, g, unknown or other
  misc_feature (173)..(173): n is a, c, g, or t
  modified_base (221)..(221): a, c, t, g, unknown or other
  misc_feature (221)..(221): n is a, c, g, or t
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
tcagtgacgtatgtcacgaccggtgctcgatttagtagctctatcagggacccaacaaccacatccctcctcagaacgcccccagagcacaactcctaaccatggactggacctggaggatcctcgtttttggtggcagcagccacaggtggccactcccaggtccactttgngcagtctgggctgaggtgcagacgcccgggctgagtgacgtatttccngcgaaggtcttcgtggatacagtcttcgagttagttangctatacagttggngtcgcctacgggcccccggtaacaaacgggtcttacggaggtcggtccgtaggggtacgtcgggaagttccggtcgggtcggtaccgaccttaccgtaaaacgaagttaaagagttaacttccaacgttaggtaaacgttttcaacggtttctaaggtacgtaccttaaccgttttagactacggaccgtaaccacgtaacgtaccgtacgaaccgtaaccgaccgttaccgtaacgtaacgttacgggtaacggttaggtacggttacggtaccgttaaacgtaacgttcgtaacgttaacgaaccggtaccggtacgttacgttaccgtagttaccgtagtcgtacggtagacgtagtacgtacttacgacggtacggtaccgggtccttaaccgttagtaacgttacggtacgggtaccgtaacgggtacccgttacggtacccgttaccccgg

SEQ ID NO: 237978 - DNA, 700 bp, Homo sapiens
  misc_feature: GYAE6OF02GPPH0.42.74.G08.1.454.CMB.1.raw
  modified_base (135)..(135): a, c, t, g, unknown or other
  misc_feature (135)..(135): n is a, c, g, or t
  modified_base (171)..(171): a, c, t, g, unknown or other
  misc_feature (171)..(171): n is a, c, g, or t
  modified_base (179)..(179): a, c, t, g, unknown or other
  misc_feature (179)..(179): n is a, c, g, or t
  modified_base (190)..(190): a, c, t, g, unknown or other
  misc_feature (190)..(190): n is a, c, g, or t
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (309)..(309): a, c, t, g, unknown or other
  misc_feature (309)..(309): n is a, c, g, or t
  modified_base (530)..(530): a, c, t, g, unknown or other
  misc_feature (530)..(530): n is a, c, g, or t
  modified_base (558)..(558): a, c, t, g, unknown or other
  misc_feature (558)..(558): n is a, c, g, or t
tcagtgacgtatgtcacgaccggtgctcgatttagtagctctatcaggggacccaacaaccacatccctcctcagaacgcccccagagcacaactcctaaccatggactggacctggagactccttcgttttggngcagcagccagaggtcgccactccaggtccacttgngcagtcgngggctggagtnacagacggcccgggctgagtgacgtcttcgngacgaggtcttcgtggactacngtctgagttagtancgatatacgnggttggcgcgtaccgccccgggacccgtaagaaggtctaggnggtacgtcggtaggtgtcggtagtccggtcggtcgactaccgtacctaaagacgttaagagttactaccgagtaaaggttacttttacgagtttacgaaggtaccgttaccgtacctttaagaccgacgtcgaactacgacctccggacgaagttaccgactcctagacgtagggttcgtagaggtccgaagtaatctaggtacgaacgtacgtccgggtnttacgttacctttaagtacggttacggnttaacgggaactacggttacttaacccggtccgtaaaccggaccggggaacccgggggtacccgttaccgtttaacggtaggttaacccgtacggggtacgggaaccccggaaccgggttacccggttcggaccccttccgg

SEQ ID NO: 237979 - DNA, 777 bp, Homo sapiens
  misc_feature: GYAE6OF02HEUTH.42.74.G08.1.454.CMB.1.raw
  modified_base (663)..(663): a, c, t, g, unknown or other
  misc_feature (663)..(663): n is a, c, g, or t
tcagtgacgtatgtcacgaccggtgctcgatttagtagctctatcaggggacccaacaaccacatccctcctcagaagcccccagagcacaactcctaaccatggactggacctggaggatccttcttttggtggcagcagccacaggtcggccactcccaggtccactttgtgctagtcctggggctgaggtgcagaacgcccggggcctcgagtcggacgtactttcccgtgcgaaacggtcttcgttcggaattaccaaggcctttaccgaaggttatttatacggtacttagtaaccgtaggtggggtacgtccggaccctaccggggacccccccggaaagaaacggtccgtttaggacggttcgggaccggttgggggaacgttgggtacgttcgggttcccgggtacggtacccgtacggtacccttaaacgtaacgttaaaggtacttacttaccggaaacgtaacggttaacgtttccgtaacggttacctaacggtacgtaaccctttacgtttaacgccgtaaggacccgtaaccgtaacgaccgtaccccgggtacgaccggaacttgaaccgttacgtacgtaggtacgttaggacgtacggtacgtacgtatcgtagaacgacctggtctagtactattgtcgttacgngacgtgtacctacggtacttacggaccgggtacgggtaccggtcccgttaacggttaggaccgtttaccggagggggttaccccgtaacggtaccggttacgtccgttacccgg

SEQ ID NO: 237980 - DNA, 952 bp, Homo sapiens
  misc_feature: GYAE6OF02G7C6G.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacgaggtggccactcccaggtccactttgtgcagtcgtggggctggaggtgcaggaacggcccggggcctgagtgacgtatttcctgacaaggtcttcgtaggatacgagtcttcgagttagttatgcttatacgaggtggggtcgcggtccgaccgggaccccccggtaagaaaacgggtccttagggtacggttcgggaccggttgggggtaacgttcggggtaacgttccgggttaccggggtcgggtaccaccgttacccccgttaaaagtaagttaaaacggtaatttaaccgtttacgtaaaccgttaacgggttaaacgtttttaccggtaaacggtttttcccgaaacggttaccggtttaacccctttaaacccgtttttaacggaaacgaacccgggtacccgtaaacccgggtaaacccttaaccggttaccccggacccggtaaacccgggtaaacccgttaccgggtaacccttaaaccgttaacggtttacgggtaacgggttttagggtaaccgggtttacgggtaaaccccgtttaaaggtaaacgttacggttaacggtaaacggtaacccggtacccggtaacgtttacccggtttaaccgttaacccgtttaagttccgggttaagggtacccggtaaagtaacggtaacgttacccgtacccgttttaaaccggaccgggttaacccgggggaaccgggttacccgttaacgttttaccggaagttttaaccgggcggggttaacccgtaaccggggttaacccgtcgggttaaccccgttccccggg

SEQ ID NO: 237981 - DNA, 633 bp, Homo sapiens
  misc_feature: GYAE6OF02II9PL.42.74.G08.1.454.CMB.1.raw
  modified_base (133)..(133): a, c, t, g, unknown or other
  misc_feature (133)..(133): n is a, c, g, or t
  modified_base (148)..(148): a, c, t, g, unknown or other
  misc_feature (148)..(148): n is a, c, g, or t
  modified_base (172)..(172): a, c, t, g, unknown or other
  misc_feature (172)..(172): n is a, c, g, or t
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (295)..(295): a, c, t, g, unknown or other
  misc_feature (295)..(295): n is a, c, g, or t
tcagtgacgtatgtcacgaccggtgctcgatttagtagctctatcaggggacccaacaaccacatccctcctcagaagcccccagagcacaactcctaaccatggactggacctggaggatcctctttttggngcagcagccacaggnggccactcccaggtcccactttgngcagtctggggctgagtgcagacgcccgggctcgagtgacgtattccngcaaggtcttcnggactacagcttacgaggttagttancgctatacgngtagggtgcggccacgggcccccgganaaaacggtccttgagtcggctggggatggaatcggtcggtggcacgttccgtaacataagatattcacagaacgttttacagttcagtagtactactttagctagcgaacacacgtaccgcgaaccgacacgtactagtactaggacggttgaggtcggtacctaaggtactacgtacgaacgaaccgacggtactcgttactaacgtttacgtacgtacgacgtaggtacgtagtaccgtcttaacggacggtaccgggaacggggtaccctacggttttacgacgtttacggtacgggccggtaaccgggtacccggttacggtacgttaccccgg

SEQ ID NO: 237982 - DNA, 830 bp, Homo sapiens
  misc_feature: GYAE6OF02IQ026.42.74.G08.1.454.CMB.1.raw
  modified_base (224)..(224): a, c, t, g, unknown or other
  misc_feature (224)..(224): n is a, c, g, or t
tcagtgacgtatgtcacgaccggtgctcgatttagtagctctatcaggggacccaacaaccacatccctcctcagaagcccccagagcacaactcctaaccatggactggacctggagatccttctttttggtggcagcagccacgaggtggccactcccaggtccactttgtgcagtcgtgggctgaggtgcagacgcccgggcctcgagtgacgtatttccngcgaggtcttcgaggtatacagtccttagagttattatgtactactacgaggttgggtgccggacccgaccgggacccccgaacgaaacggtcgttaggtacggtggtcgtaggggagttagggtacgttaccgggtccgggtggtaccctaccgttaaccctaaacgtaacgttaaacgtaacttaccgtttaaccgaacgtaaggttaaaccgttttacgtacggtttacaaacggttaacgttaacctttaaccgttttaaccggaacgtaaccggaccgtaaccctacgtaccgttaccccggacccgtaaaccgtaccggtaacgttaccgtaacgtagggttacgggttagttacgggtaggttaccgggtaaacttaacgtcgttaccggtaagtaaaccgaccgtacggttccgttacgtttaacctttaagttaccggttacggtacgtacgggaacgtaacggttaacgttccggtacccttaacggaccgggtaaccggggtacccggggtaccttaacggtttacggtaaccgttaccggggtacgggacccggtaacccggggtacccgttaccggttaccccgttaccccgg

SEQ ID NO: 237983 - DNA, 833 bp, Homo sapiens
  misc_feature: GYAE6OF02IMG47.42.74.G08.1.454.CMB.1.raw
tcagtgacgtatgtcacgaccggtgctcgatttagtagctctatcaggggacccaacaaccacatccctcctcagaagcccccagagcacaactcctaaccatggactggacctggagatccttctttttggtggcagcagccacaggtggccactccaggtcctactttgtgcctatcgtggggactggaggtgacgagaacggcccggggcctcgagtcggacgtactttccgtgctaacggtctttcgaggtactacgagtcttacagttacttatcgtctacgtagtaggtggtcgccgccgtaccggcccccggagtaaacggtccttaggtaggtcggacggttacgggtaagtcggtacgttccgggtcgggtcggacctaccgttaaccgtaaactaacgtaagtacttacgttaacgacgtaacggttaacgtttccgaagtttaccgaacggtacttaccgttaccgtttaaagccgtaacgtacccgtaatacccgtaacgtacccggtacggtaaacccggactttacggtaacccgtagttaacggttacgggtacggttttagggaaccggttacggtaacccgttaaagtaccggttacgtaaacggtaacgtaccggttacggtaaccgttcgtttaacgttacgttacgtacggtacggtaccggtaaggaccgttacgtacccgttaccgttaacggacccgggtaaaccgggttccggggtaccctttaacggttttacggtaaaccgggtttcgggtacccggggttaaccggtaacccgggtttaaccccggtccggtaccgtttaccccgg

SEQ ID NO: 237984 - DNA, 933 bp, Homo sapiens
  misc_feature: GYAE6OF02JDPZO.42.74.G08.1.454.CMB.1.raw
  modified_base (207)..(207): a, c, t, g, unknown or other
  misc_feature (207)..(207): n is a, c, g, or t
tcagtgacgtatgtcacgaccggtgctcgatttagtagctctatcaggggacccaacaaccacatccctcctcagaagccccagagcacaactcctaaccatggactggacctggaggatccttctttttggtggcagcagccacaggtggccactcccaggtccactttgtgcagtctggggctgaggtgcagaggcccgggctcngtgacgtattcctgaccaaggtcttcgtaggatacgagtccttctaaggttagttactgtactacgttaacgaggtggggttcgccggaccgaccccggggaccccccggtaaacggtaaaacgggtcctttagggtacggttaggggtccggttagggggtacgttacggggacgtttccggggttcggggttacggggcccttaaacccggtaccccttaaaaaccgttaagttaaaacggtaatttaacctttaaccggaaacgttaaagttaacgttttaacccgtaggtttaccaaggtacgttaaccgttaaccgtttagactaccggaccgtaacaccctccgtacccggtaccggaacccgacgtacgttaccgtaacgtacggtagggttaagttggacgggttcggtaaaccgttacgtaaagttccgtaaaacggtaaccggaaccgggttaccgggttaccgttacgtttaccgtttaaattttaccggtttagggtaacgggtgggtaaaacgggtagttaacgtttaccccgggttaccccgtttaaacgggtaaaccccgggggtcggggtaaacccccggggggtttaaccctttaaacggtttttaccgggttaaaaccgggtttccgggttaaccgggggggtaaccccggttaaaccccggggggttaaccccggtttcccggggttaaccccggtttacccccggg

SEQ ID NO: 237985 - DNA, 569 bp, Homo sapiens
  misc_feature: GYAE6OF02G8W41.42.74.G08.1.454.CMB.1.raw
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (379)..(379): a, c, t, g, unknown or other
  misc_feature (379)..(379): n is a, c, g, or t
  modified_base (400)..(400): a, c, t, g, unknown or other
  misc_feature (400)..(400): n is a, c, g, or t
tcagtgacgtatgtcacgaccggtgctcgatttagtagctctatcaggggacccaacaaccacatccctcctcagaagcccccagagcacaactcctaaccatggactggacctggaggatcctcttttggtggcagcagccacaggtggccactcccaggtccactttgtgcagtctggggctgaggtgcagaagcccggggctcagtgacgatttcctgcaaggcttctggatacagcttnagttagtttngctatacgagtgggtgcgccaggcccccggacaaaggcttgaggtggctgggtatggatcgtcgggtggcactcctaacatagatattcacagtagtttnattnagagtataccttagcagcacanactaccgcgacgacagtctanatggagttgagtagactaacgatctagaagacacggtctacgttctaacttacgtaggtagtcggtagacgagttcgaccttacgacgaacggtaccgggggtcctaacggtttgtaacgtttacggtacgggtacccggtaacggggtacccgtacggtcgtacccgg

SEQ ID NO: 237986 - DNA, 701 bp, Homo sapiens
  misc_feature: GYAE6OF02GBHNH.42.74.G08.1.454.CMB.1.raw
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (271)..(271): a, c, t, g, unknown or other
  misc_feature (271)..(271): n is a, c, g, or t
  modified_base (291)..(291): a, c, t, g, unknown or other
  misc_feature (291)..(291): n is a, c, g, or t
tcagtgacgtatgtcacgaccggtgctcgatttagtagctctatcaggggacccaacaaccacatccctcctcagaagcccccagagcacaactcctaaccatggactggacctggaggatccttctttttggtggcagcagccacaggtgccactcccaggtccactttgtgcagtctgggctgaggtgcagaacgcccggggcctcagtgacgatttcctgcaaggcttcgnggatacancttcagtagttatgtctatacagttgggngcgccgacggcccccggaanaaacggcttggagtgggcgtagggatggacgttcggtcgggtggacctaccgtacctaaactaagttaacgtaagttacttacaacgtaaggtaacgtttttacgaacgtttacgtaacggtacgttacctaacccgttttagaccgtaacggaccgaacctacgacgtacccggacgtaaccgactacgtaccgtacacgttgggttactagggtagtacggtaaccgtaagtacgtacgtacggaaacgtaccggacggttcctacggttacttaacgtttcgtggtaccggacgtaaacgtgtacgtacggtccctaaacggaccgggtaacgggacgggttccccgttaagttacgtacggttcggtacggggtaccgaacgggtccccgtaggtacccgtacccg

SEQ ID NO: 237987 - DNA, 654 bp, Homo sapiens
  misc_feature: GYAE6OF02FOHQY.42.74.G08.1.454.CMB.1.raw
  modified_base (267)..(267): a, c, t, g, unknown or other
  misc_feature (267)..(267): n is a, c, g, or t
  modified_base (526)..(526): a, c, t, g, unknown or other
  misc_feature (526)..(526): n is a, c, g, or t
tcagtgacgtatgtcacgaccggtgctcgatttagtagctctatcaggggacccaacaaccacatccctcctcagaagccccagagcacaactcctaaccatggactggacctggaggatccttctttttggtggcagcagccacaggtggccactcccaggtccactttgtgcagtcgtggggctggaggtgcaggaacgcccggggcctcgagtgacgtatttcctgcaacggcttcgtggataacagtcttacgagttagttancgtctaactacgaggtggtgcgccgacggcccccggaacgaaacggtctaggagtaggcgtggagtggagtcggtacggtcggcacctcctaaacacgtaaacgactaattacactaacgttaagtttacgtacgttacagtacgttcctaaccgttttacgctagaccgtaccaacgacgtccgacgacgaacgacgttcctaacagtacgggtagtacggagttacggactaaggtactcgtaagaacgacgacgtntacgttactattcgtgtagacgagtaagtacgtacgtaccgttacgaccggtaacgggtaccgggacctaacgttagttacgtacggttccgggaaccgtacgggtacccgttacggacccgttaccg

SEQ ID NO: 237988 - DNA, 1060 bp, Homo sapiens
  misc_feature: GYAE6OF02GMTZJ.42.74.G08.1.454.CMB.1.raw
tcagtgacgtatgtcacgaccggtgctcgatttagtagctctatcaggggacccaacaaccacatccctcctcagaacgcccccaggcacaactacctaccaactagacgtcgcgacgaggactacttcctttttggtttggcgcgacgacgaccgaccgaggtcgggccaccctacccgtacccggtaccgtaccctttgtttggcaagtcggttcgggacggttgtagggtacgacacggaacgggtccccgggcccggtactaggacggacgttaacgtttaccttccgacggaaggtaccgttccgttagggtactaatacgtcgttctagttaaggtttactcgtcttactaacgtcggtagggttcggtcccgaccgtaacccgggaacccccggaacccggaaaacggtaaccgttcggttaagggtcggggttcggggtaacgggttaggtacgggtaacggttccggttaccgggtcgggtacccgtaaccgttaccccgttaaaaccgtaaaccgttaaagaacgttttaaccgttaaccgtaacgtaaaccggttaaaggtttaacgttttacccgtaagttaacggttacgttaaaccgtttacccgttaaacgttcggaaccgtaacggtaccctaaaccgtacccggttaccgacccggaaaccgtaacccggtaacgttttaccgaaccgttaacggttacgggtacggtttagggaaccggtaaccgttacgtaaaccggttaaccgtacgttaacgaaccggaaaccggtacgggttacccgttacggttttaaacgtttacccgggttttaaacctttggggtaccgggttaaacgtaacgggtttataaacccggttccggttaaacccggttttaacgggaccggtttaaacccccggggggaaacggggtttacccccgtttaaacggtttaaggtttacccgggtttaaacccggggttaccccgggtttaaccgggggaaaacccggggtttacccccgttccggggtttaaccccggacccccctttaaccggggg

SEQ ID NO: 237989 - DNA, 829 bp, Homo sapiens
  misc_feature: GYAE6OF02JRAFI.42.74.G08.1.454.CMB.1.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
  modified_base (706)..(706): a, c, t, g, unknown or other
  misc_feature (706)..(706): n is a, c, g, or t
tcagtgacgtatgtcacgaccggtgctcgatttagtagctctatcaggggacccaacaaccacatccctcctcagaagcccccagagcacaactcctaaccatggactggacctggagatcctcgttttggtggcagcagccacgaggtggaccacctcccgaggtccactttgtcgcagtcgtggggctggaggtncaggacggcccgggctcacggtaggacgtacttccncgtacgacggtcttcgtggacttaccgaagtccgtttacaggttacgtttacgcgtacctaataaccggtcggtaggggttcgcccggtaccccgtaaccgggtaccccccggtaaagaaacgggtccgttacgggacggtgggtacccggtaggggtaaccgtagggacggttccgggtacgggtcggtccaacccgtttccggtaaataaggttaacgtacttacgttaccgaacgtaagttaccggttttccaacggtttacgtaacggtaccgttacgtaaccgtttaacgggaccaacgggtacctaccgtaacgtacgtacccggacctaaacgtaccgtaggtacctaacggtacgtagggtcgttaacgacggtacggacgttaacgacggtcctaaagggtacgaaccgtacggttacctagttaaccgggttaattaccggtacggttacgacgtaaccggtnaagggttcccttaccggtacaaccgggggtaacggttacccgggcgtttaaccggttaacgtacggttaacccgggtacgggttcccgaaacccggggttccgttccggtaaccctaccccgg

SEQ ID NO: 237990 - DNA, 987 bp, Homo sapiens
  misc_feature: GYAE6OF02IMBM9.42.74.G08.1.454.CMB.1.raw
  modified_base (176)..(176): a, c, t, g, unknown or other
  misc_feature (176)..(176): n is a, c, g, or t
tcagtgacgtatgtcacgaccggtgctcgatttagtagctctatcagggggacccaacaaccacatccctcctcagaagcccccagagcacaactcctaaccatggactggacctggaggtatccttctttttggtggcagcagccacaggtggccactcccgaggtccactttgngctaggtcgtggggactggaggtgacaggaacggccccggggtcctacgaggtcgacgtactttcccgtagcgtaagggtccttcgtaggtaactaccgaggttaccttacgtagttagttacgtcgtacttaagtacgtaggttcggggtcggaccgtcccgaccgggtaccccccggtaactaaacgggtccgttaggtacggtcgggtacggttacggggaacgttggggaacgtttcccgggtacggggtacggcccgttaacccgttaacccgttaaacgtaaacgttaacggtaacgtttaacttaccgtaaaccgtaagttaacggttttaccgttaaccggtttacgaacggttacgttacccgtttaaccgttttaacggaccgtaacgggtacccgaactaccgtaccgtaccccgggtacgtaaacccggtaccgttaaccggttaactacccgtaaaggtccgggttaaggtttacggtaacggtttacgggtaacctttaaacggtacgttaaccgttacggaaacggttaaccgggtaccggttacgttacccggtttaaccggttaacttttaccgggttagttaccgggtacggtaaacgggttacgttaaccggttccggttacccgttaaccgggaacccggggtaaaccgggggttacccgggggtaaccccttttaaccggggtttacggtttaaacccgggttacccgggggtttaccccgggggttaaccgggtttaaccccgggggggtaacccctttaccgggggttaaccccccgtttaccccggg

SEQ ID NO: 237991 - DNA, 757 bp, Homo sapiens
  misc_feature: GYAE6OF02JSHI7.42.74.G08.1.454.CMB.1.raw
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
tcagtgacgtatgtcacgaccggtgctcgatttagtagctctatcaggggacccaacaaccacatccctcctcagaacgcccccagagcacaactcctaaccatggactggacctggagactccttctttttggtggcagcaggccacaggtggccacctcccagggtccacgttttgtgcgacgtctggggctaggagtgcagacggcccgggctcagtgactntttccngccgtaagcttcgtggaatacngtcttacgagtagtatcgtattagtacgaggtcgggtgaccgccgtaaccgggccccgaacgaacggtntaggtacggnggtcggtaggtacgtcggtagtcccggtggtcggtactaccgtaccgtaaacgaacgttaagacggtttactacgtaacgtaacggtttaaacgttttcaacggtttccgaacgttaacgtcttaaaccgtttaagcacggttacgacgtaactacgttaccgacccgactacgacgtactaacgtacggtggtagttacggagtaccggtacgtacgtagtacctaacgtaggaacccgtaggttccgttagttacgtttacgttaccgtgggttcaaacgggtaccgtagtaacgtccgtaccgttaaccggacccgggtaacgggtacccgggaccgtttaccgtttaaccggttaggtttaacccgggtaccgggtacccggttaaccggggaccccgttaacggttaccccggttcccgg

SEQ ID NO: 237992 - DNA, 905 bp, Homo sapiens
  misc_feature: GYAE6OF02GFFC1.42.74.G08.1.454.CMB.1.raw
  modified_base (196)..(196): a, c, t, g, unknown or other
  misc_feature (196)..(196): n is a, c, g, or t
tcagtgacgtatgtcacgaccggtgctcgatttagtagctctatcagggggacccaacaaccacatccctcctcgagaagcccccagagcacaactcctaaccatggactggacctggaggatcctcttttggtggcagcagccacaggtggcctactcccaggtccactttagtgcagtcgtggggctgaggtgngagaaggcccggggcctcgagtgacgatttccctggccgaacggtcttcgtggactacgagtcttcagtagttatcgtacgttatacgtaaggtggggtggaccgccccgtaacgggaccccccggaacgaaaacgggtccttaggagggtacgggtccggtaggggtaagttcggggaagttccggggttccggggttcgggtaccctaaccggttcccttaaacggtaacttaaacggtattacttaccgaacgtaaacgttaacggtttttacctaacggtttccgaacggtacgttaccttaaccgttttagggacctaacgggtaccgtaaccaaccgtacgtttacccgggacgtaaacccggtaaccgtaacgtttaccgtaacccgtaagtttacggggtaacggtttacgggtaaccggttagggttaaccccgttaaagggtaccgttacgtacgggaaaccggtaacgtaacccggggtacttacgtttacccgttaacttttaaccggtcgttaacgggaccggtaacgttaaaggtccgttaacgtaccccgggttaaacgacccgggttaaccggggtaccgggggtacccccgttaacgttttaacgggtaaccgttttacccggggtaccgggggtaaccccggttaaccgggggtaacccccgtttcggggtaaccccgtttaacccccggg

SEQ ID NO: 237993 - DNA, 296 bp, Homo sapiens
  misc_feature: GYAE6OF01BVXKQ.10.34.D01.1.454.CMB.1.raw
  modified_base (290)..(296): a, c, t, g, unknown or other
  misc_feature (290)..(296): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggactacccactactatgctgagcgggctggcaaggcgcatagnnnnnnn

SEQ ID NO: 237994 - DNA, 173 bp, Homo sapiens
  misc_feature: GYAE6OF01AWDE3.10.34.D01.1.454.CMB.1.raw
  modified_base (173)..(173): a, c, t, g, unknown or other
  misc_feature (173)..(173): n is a, c, g, or t
tcagcatagtagtgcacgaccggtgctcgatttagatcgtctgtgttgggtttgggggaagaggaagactgacggccctgctccaggagcacctccgagagcacagcggccctgggctgcctggtcaaggactacttccactacatgctgagcgggctggcaaggcgcatagn

SEQ ID NO: 237995 - DNA, 295 bp, Homo sapiens
  misc_feature: GYAE6OF01EXXXF.10.34.D01.1.454.CMB.1.raw
  modified_base (292)..(295): a, c, t, g, unknown or other
  misc_feature (292)..(295): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttcccctggcgccctgctccaggagcacctccgagagcacagcggccctgggctgcctggtcaaggactacttcccactactatgctgagcgggctggcaaggcgcatagnnnn

SEQ ID NO: 237996 - DNA, 296 bp, Homo sapiens
  misc_feature: GYAE6OF01AZYJD.10.34.D01.1.454.CMB.1.raw
  modified_base (292)..(296): a, c, t, g, unknown or other
  misc_feature (292)..(296): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggctacttcccactactatgctgagcgggctggcaaggcgcatagnnnnn

SEQ ID NO: 237997 - DNA, 176 bp, Homo sapiens
  misc_feature: GYAE6OF01CSCTH.10.34.D01.1.454.CMB.1.raw
  modified_base (175)..(176): a, c, t, g, unknown or other
  misc_feature (175)..(176): n is a, c, g, or t
tcagcatagtagtgcacgaccggtgctcgatttagatcgtctgtgttgggtttgggggaagaggaagactgacggccctgctccaggagcacctccgagagcacagcggccctgggctgcctggtcaaggactacttcccactactatgctgagcgggctggcaaggcgcatagnn

SEQ ID NO: 237998 - DNA, 295 bp, Homo sapiens
  misc_feature: GYAE6OF01CS6NR.10.34.D01.1.454.CMB.1.raw
  modified_base (293)..(295): a, c, t, g, unknown or other
  misc_feature (293)..(295): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggactacttcccactactatgctgagcgggctggcaaggcgcatagnnn

SEQ ID NO: 237999 - DNA, 296 bp, Homo sapiens
  misc_feature: GYAE6OF01DQW8K.10.34.D01.1.454.CMB.1.raw
  modified_base (292)..(296): a, c, t, g, unknown or other
  misc_feature (292)..(296): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttcccctggcgccctgctccaggagcacctccgagagcacagcggccctgggctgcctggtcaaggactacttcccactactatgctgagcgggctggcaaggcgcatagnnnnn

SEQ ID NO: 238000 - DNA, 296 bp, Homo sapiens
  misc_feature: GYAE6OF01C0X98.10.34.D01.1.454.CMB.1.raw
  modified_base (293)..(296): a, c, t, g, unknown or other
  misc_feature (293)..(296): n is a, c, g, or t
tcagcatagtagtgcacgaccggtgctcgatttagatcgtctgtgttgggtttgggtgccgaagttgctggaggtcacggtcaccacgctgctggagggagtagagtcctgaggaccttgacttctggggccagggaaccctggtcaccgtctcctcagcctccaccaagggcccatcggtcttcccctggcgccctgctccaggagcacctccgagagcacagcggccctgggctgcctggtcaaaggacctacttcccatactatgctgagcgggctggcaaggcgcatgnnnn

SEQ ID NO: 238001 - DNA, 293 bp, Homo sapiens
  misc_feature: GYAE6OF01BJ3AL.10.34.D01.1.454.CMB.1.raw
  modified_base (292)..(293): a, c, t, g, unknown or other
  misc_feature (292)..(293): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggctacttcccactactatgctgagcgggctggcaaggcgcatagnn

SEQ ID NO: 238002 - DNA, 299 bp, Homo sapiens
  misc_feature: GYAE6OF01CQ70Q.10.34.D01.1.454.CMB.1.raw
  modified_base (282)..(282): a, c, t, g, unknown or other
  misc_feature (282)..(282): n is a, c, g, or t
  modified_base (288)..(299): a, c, t, g, unknown or other
  misc_feature (288)..(299): n is a, c, g, or t
tcagcatagtagtgcacgaccggtgctcgatttagatcgtctgtggttgggtttgggtgccgaagttgctggaggtcacggtcaccacgctgctgaggagtagagtcctgaggaccttgacttctggggccagggaaccctggtcaccgtctcctcagcctccaccaagggcccatcggtcttcccctggccgccctgctccaggagcacctccgagagcacagcggcctgggctgcctggcaaggctactccatactatgctgagcgggctggcaagggcncatagnnnnnnnnnnnn

SEQ ID NO: 238003 - DNA, 299 bp, Homo sapiens
  misc_feature: GYAE6OF01CJFLF.10.34.D01.1.454.CMB.1.raw
  modified_base (294)..(299): a, c, t, g, unknown or other
  misc_feature (294)..(299): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccaggggaaccctggtcaccgtctcctcagcctccaccaagggcccatcggtcttccccctggcgccctgctccaggagcacctccgagagcacagcggccctgggctgcctggtcaaggactacttcccactactatgctgagcgggctggcaaggcgcatagnnnnnn

SEQ ID NO: 238004 - DNA, 297 bp, Homo sapiens
  misc_feature: GYAE6OF01BGAOE.10.34.D01.1.454.CMB.1.raw
  modified_base (293)..(297): a, c, t, g, unknown or other
  misc_feature (293)..(297): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggactacttcccactactatgctgagcgggctggcaaggcgcatagnnnnn

SEQ ID NO: 238005 - DNA, 596 bp, Homo sapiens
  misc_feature: GYAE6OF01E3E08.10.34.D01.1.454.CMB.1.raw
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
tcagcatagtagtgcacgaccggtgctcgatttagatcgtctgtgttgggtcccttagactctcctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctcaagagatgattacaaaaagtcgctgtatctgaacatgaacagcctagaaaacggnggacanagccgtgtattactgtgcccactcaggaccgtatattgttctgatggctatgctacgtaaggacgtacctttggacttcgtcggggccctaagggaaccctggtcctaccgtcctccctcgacgccctacccgaccgaacgggcccctacgttcccggtcccttcccccgtggcccgtcccctcgccctcccgacgggacgccgacccgtccgacgacgccgacgacggcccggcccgtgggctccggccgttcgggtcaaacgggtaccttcccgttaccccacttaaccgtactcggcctggcggcgggtccg

SEQ ID NO: 238006 - DNA, 304 bp, Homo sapiens
  misc_feature: GYAE6OF01DH5ZM.10.34.D01.1.454.CMB.1.raw
  modified_base (297)..(304): a, c, t, g, unknown or other
  misc_feature (297)..(304): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtccttccccctggccgccctgctccaggagccacctccgagagcacagccggccctgggctgcctggtcaaggactacttcccactactatgctgagcgggctggcaaggcgcatagnnnnnnnn

SEQ ID NO: 238007 - DNA, 176 bp, Homo sapiens
  misc_feature: GYAE6OF01B1XTJ.10.34.D01.1.454.CMB.1.raw
  modified_base (175)..(176): a, c, t, g, unknown or other
  misc_feature (175)..(176): n is a, c, g, or t
tcagcatagtagtgcacgaccggtgctcgatttagatcgtctgtgttgggtttgggggaagaggaagactgacggccctgctccaggagcacctccgagagcacagcggcctgggctgcctggtcaaggactacttcccactactatgctgagcgggctggcaaggcgctatagnn

SEQ ID NO: 238008 - DNA, 297 bp, Homo sapiens; identical to SEQ ID NO: 238004
  misc_feature: GYAE6OF01BT3P3.10.34.D01.1.454.CMB.1.raw
  modified_base (293)..(297): a, c, t, g, unknown or other
  misc_feature (293)..(297): n is a, c, g, or t

SEQ ID NO: 238009 - DNA, 175 bp, Homo sapiens
  misc_feature: GYAE6OF01ASIGE.10.34.D01.1.454.CMB.1.raw
  modified_base (175)..(175): a, c, t, g, unknown or other
  misc_feature (175)..(175): n is a, c, g, or t
tcagcatagtagtgcacgaccggtgctcgatttagatcgtctgtgttgggtttgggggaagaggaagactgacggccctgctccaggagcacctccgagagcacagcggccctgggctgcctggtcaaggactacttcccactactatgctgagcgggctggcaaggcgcatagn

SEQ ID NO: 238010 - DNA, 358 bp, Homo sapiens
  misc_feature: GYAE6OF01BN5NC.10.34.D01.1.454.CMB.1.raw
  modified_base (338)..(338): a, c, t, g, unknown or other
  misc_feature (338)..(338): n is a, c, g, or t
  modified_base (346)..(358): a, c, t, g, unknown or other
  misc_feature (346)..(358): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttcgtggggccagggaaccctggtccaccgtctcctcacgccctccaccgaacgggccccagtccggtccttcccccgtggccgcccctgcctccgaggacgccacctccgagacgccacgacggccggccctggggctcggccgtgggtaccaaggtaccttaccttacccaacttactagtcgccttggacggccggggctgggaccaaggggcncaagtagnnnnnnnnnnnnn

SEQ ID NO: 238011 - DNA, 308 bp, Homo sapiens
  misc_feature: GYAE6OF01D4P3D.10.34.D01.1.454.CMB.1.raw
  modified_base (209)..(209): a, c, t, g, unknown or other
  misc_feature (209)..(209): n is a, c, g, or t
  modified_base (300)..(308): a, c, t, g, unknown or other
  misc_feature (300)..(308): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtccttccccctggccgccctgctccagganccacctccgagagcacagccggccctgggctgcctggtcaaggtactaccttcccactactatgctggagcgggctggcaaggcgcatagnnnnnnnnn

SEQ ID NO: 238012 - DNA, 299 bp, Homo sapiens
  misc_feature: GYAE6OF01A3EAN.10.34.D01.1.454.CMB.1.raw
  modified_base (293)..(299): a, c, t, g, unknown or other
  misc_feature (293)..(299): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggactacttcccactactatgctgagcgggctggcaaggcgcatagnnnnnnn

SEQ ID NO: 238013 - DNA, 806 bp, Homo sapiens
  misc_feature: GYAE6OF01APHRS.10.34.D01.1.454.CMB.1.raw
  modified_base (589)..(589): a, c, t, g, unknown or other
  misc_feature (589)..(589): n is a, c, g, or t
tcagcatagtagtgcacgaccggtgctcgatttagatcgtctgtgttgggtcccttagactctcctgtgcagcctctggattcactttcagtaacgcctggatgaactgggtccgccaggctccagggaaggggctggagtgggttggccatattaaaatcaaagctgatggtagggacaacagagcacgctgcacccgtgaaaggcagattcagcatctacaagagatagattacaaaaagtacgctagtatctagaacatagaacagcctaggaaacggagacacagccgtagtacttactgtcgacctacgcgacggaccgtattacgttgttcgtagagtcggtcgtagtcgtacgttacgtaacggacggtaccgttacgtacgtttccggtacgggggacccgtaacggggtaaccccgttcgggtaccctacccggttccttacccgtaccgaccggtcccccttaacccggaaaccccggtaaaccggggtccccctacgggtttaccccgggttccccccttcccccgggtacgggtcccccgtccccgttaccgccccgttaaccggaccggggtaccncccccgtaaccccggttaccgggaaccgtacccgggtaccaacccggtaccgggggtacccccggttccccgggtggggtaccccttcccggggtaaccccgtttggggtaaaccccgaaacccgggttacccctttaacccccgtttacccccaaccgttttaaacgttcccggcgggtaaccccggttgggaacccggggtccccgggtaacggg

SEQ ID NO: 238014 - DNA, 304 bp, Homo sapiens
  misc_feature: GYAE6OF01AI4HQ.10.34.D01.1.454.CMB.1.raw
  modified_base (298)..(304): a, c, t, g, unknown or other
  misc_feature (298)..(304): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggccgccctgctccaggagccacctccgagagcacagccggccctgggctgcctggtcaaggactacttcccactactatgctggagcgggctgggcaaggcgcatagnnnnnnn

SEQ ID NO: 238015 - DNA, 296 bp, Homo sapiens
  misc_feature: GYAE6OF01D952A.10.34.D01.1.454.CMB.1.raw
  modified_base (291)..(296): a, c, t, g, unknown or other
  misc_feature (291)..(296): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttctccctggcgccctgctccaggagcacctccgagagcacagcggccctgggctgcctggtcaaggactacttcccatactatgctgagcggctggcaaggcgcatagnnnnnn

SEQ ID NO: 238016 - DNA, 776 bp, Homo sapiens
  misc_feature: GYAE6OF01C5LRP.10.34.D01.1.454.CMB.1.raw
  modified_base (746)..(746): a, c, t, g, unknown or other
  misc_feature (746)..(746): n is a, c, g, or t
tcagcatagtagtgcacgaccggtgctcgatttagatcgtctgtgttgggtcccttagactctcctgtgcagcctctggattcactttcagtaacgcctggatgaactggtcccgccaggctccgagggaaggggctggagtggttgccatattaaaatcaaagctgatggtggacaacagagcacgctgcacccgtgaagcagattcagcatctacgaagtagtatgaattaacgaaaagtcgctagtatcctagaaactagtacgaacctacggaaccgttaaacgggaaaaccggacggaaccgaccgtaccggtacccggtttagtttaccgttaacgttcggtacgacccctaaccggtccggtaaacgggtacccgtaattttaacgtttcggttaccgtagggtagttcggtacgttaacgtcgtaccgttaaggtaacgggttacggttaccgttaggtacccggtttcggtaccgggggtaaccgtacccgggtacccgtttcggtacccttaccgtcccttacccgaccgtacccgtcccctaacccggaaacccggtaaccggcccttaccggtcccggtttacccccttccccggtccggaccccgtcccgtcggtacccgacccggtacggaccgttacccgaaccgttccggaacgtccggacctaacggggccgtcccgggtaccggtcggtcctaccgggtcggtaacgacgtaaccgttaccttacccnccgtactagtccgagtcaggtcggcgtcgg

SEQ ID NO: 238017 - DNA, 643 bp, Homo sapiens
  misc_feature: GYAE6OF01BKARA.10.34.D01.1.454.CMB.1.raw
  modified_base (306)..(306): a, c, t, g, unknown or other
  misc_feature (306)..(306): n is a, c, g, or t
  modified_base (465)..(465): a, c, t, g, unknown or other
  misc_feature (465)..(465): n is a, c, g, or t
tcagcatagtagtgcacgaccggtgctcgatttagatcgtctgtgttgggtcccttagactctcctgtgcagcctctggattcactttcagtaacgcctggatgaactggtccgccaggctccagggaaggggctggagtgggttggccatattaaaatcaaagctgatggtgggacaacagagcacgctgcacccgtgaaaggcagattcagcatctcaagagatagattacaaaaagtcgctgtatcctagaacatagaacagacctaggaaaaccggaggacacagccgtgtattactagtcncccactcgaggaccgattattgttcgtgatcggacgtatgtactcgtaaaggacggtaccttgtacttcgtagggccgaaggtaacccgtcggtaccaccgttcctacctcgacgtccctaccgaaccgaacggccctacgtccggtccttcccccggngccccgacccttcgacccttccgaacgggtcgacccgtacccgtaccggacgtaccgaccaacgaccggccggtacccgtgggcctcggacccgttcgggtacccgaaagggtaccccttacccgttaccccaaacgttaccgtacgttcgacccggttaggcgggttccgggaccgg

SEQ ID NO: 238018 - DNA, 293 bp, Homo sapiens
  misc_feature: GYAE6OF01ERHS4.10.34.D01.1.454.CMB.1.raw
  modified_base (283)..(283): a, c, t, g, unknown or other
  misc_feature (283)..(283): n is a, c, g, or t
  modified_base (287)..(293): a, c, t, g, unknown or other
  misc_feature (287)..(293): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttcccctggccgccctgctccaggagcacctcgagagcacagcgcctggctgcctggtcaaggctactcccactactatgactgacgcggctggcaggcganatgnnnnnnn

SEQ ID NO: 238019 - DNA, 347 bp, Homo sapiens
  misc_feature: GYAE6OF01D8CT5.10.34.D01.1.454.CMB.1.raw
  modified_base (332)..(347): a, c, t, g, unknown or other
  misc_feature (332)..(347): n is a, c, g, or t
tcagcatagtagtgcacgaccggtgctcgatttagatcgtctgtgttgggtttgggtgccgaagttgctggaggtcacggtcaccacgctgctggagggagtagagtcctgacggaccttgacttcgtggggccagggaaccctggtccaccgtctcctcacgccctccaccgaacgggcccagttccggtccttcccccgtggccgccctgcctccgaggacgccacccgtccgagacgcacgagccggccgtgggctcgccgtggtaccaaggtaccttaccttcccactactagtgcgtggaggcgggctgggcaaggccgactagtgnnnnnnnnnnnnnnnn

SEQ ID NO: 238020 - DNA, 692 bp, Homo sapiens
  misc_feature: GYAE6OF01D1ZVO.10.34.D01.1.454.CMB.1.raw
  modified_base (681)..(681): a, c, t, g, unknown or other
  misc_feature (681)..(681): n is a, c, g, or t
tcagcatagtagtgcacgaccggtgctcgatttagatcgtctgtgttgggtcccttagactctcctgtgcagcctctggattcactttcagtaacgcctggatgaactgggtcccgccaggctccagggaaggggctggagtgggttggccatattaaaatcaaagctgatggtgggacaacagagcacgctgccacccgtagaaaggcagattcagcatctacaagagatgaattacaaaaagtacgctgtatctgaacatagaacagacctaagaaaacggacgacaacgagtccgtagtattacgtgtacgccacgtacgacggtaccgtattagtttcgttcgtagagtggacgttatgctacgtaaggacggtaccgttacgtaccgtttcggcggggtaccgaacggggtaacccgttcggtacctacccgttccttaccgtacctaccgtaccccgtacccgaaacccggaaccgggtaccctaacggttccccggttacccgttaccccccggtcgggtccccgtccccgtacggtcccgtacccgtaggaccgacccgtacccgtacccgacgacgaccgacgacgggcccggtccgtcgggtccgtcggtccgtacggtacgaaacggtcccttacccgtaccctaaccgtactacgtacgtcgtacgggngtcgggtacgg

SEQ ID NO: 238021 - DNA, 330 bp, Homo sapiens
  misc_feature: GYAE6OF01C5Y8H.10.34.D01.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (315)..(330): a, c, t, g, unknown or other
  misc_feature (315)..(330): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccgaagggcccatccggtccttccccctggccnccctgcctccgaggacgccacctcgagagcacngccggcctgggctgccgtggtacaaggaccttacctcccaactactatgcctggacggcgggctgggacaagggcgacaataggnnnnnnnnnnnnnnnn

SEQ ID NO: 238022 - DNA, 429 bp, Homo sapiens
  misc_feature: GYAE6OF01EBNBO.10.34.D01.1.454.CMB.1.raw
  modified_base (128)..(128): a, c, t, g, unknown or other
  misc_feature (128)..(128): n is a, c, g, or t
  modified_base (389)..(389): a, c, t, g, unknown or other
  misc_feature (389)..(389): n is a, c, g, or t
  modified_base (391)..(429): a, c, t, g, unknown or other
  misc_feature (391)..(429): n is a, c, g, or t
tcagcatagtagtgcacgaccggtgctcgatttagatcgtctgtgttgggtttgggtgccgaagttgctggaggtcacggtcaccacgctgctggagggagtagagtcctggaggaccttgacttcgnggggccaggggaacccctggtcaccgtctcctcagccctccaccgaagggccccagtcggtccttcccccgtggccgcccctgcctccgaggcgtccaccctccggaagacgccaacgacggcccgggtccccgtggggccttcggcccgttagggttaccaaaacgggtacctttaccctttacccccaacttaacgtattcggccttaggggaaggtcccgggggtctacggggaccgaaaggggccgtacaaattggngnnnnnnnnnnnnnnnnnnnnnnnnnnnnnnnnnnnnnnn

SEQ ID NO: 238023 - DNA, 395 bp, Homo sapiens
  misc_feature: GYAE6OF01DFP1Q.10.34.D01.1.454.CMB.1.raw
  modified_base (241)..(241): a, c, t, g, unknown or other
  misc_feature (241)..(241): n is a, c, g, or t
  modified_base (261)..(261): a, c, t, g, unknown or other
  misc_feature (261)..(261): n is a, c, g, or t
  modified_base (345)..(347): a, c, t, g, unknown or other
  misc_feature (345)..(347): n is a, c, g, or t
  modified_base (349)..(395): a, c, t, g, unknown or other
  misc_feature (349)..(395): n is a, c, g, or t
tcagcatagtagtgcacgaccggtgctcgatttagatcgtctgtgttgggtttgggtgccgaagttgctggaggtcacggtcaccacgctgctggagggagtagagtcctgaggtaccttgacttcgtggggccagggaacccctggtaccaccgtcctcctcgacgccctacccaaccgaacgggccccctagttccggttcccttccccccgtgggccctcccctgccctccgaggacnccaccgtccgagacgcacgnggccgcccgtgggtctgccgtggtacgaagtcctaccttcccatatatgcctggagccggctggaccaaggtcgactagtagcnnntnnnnnnnnnnnnnnnnnnnnnnnnnnnnnnnnnnnnnnnnnnnnnnn

SEQ ID NO: 238024 - DNA, 837 bp, Homo sapiens
  misc_feature: GYAE6OF01BVC5U.10.34.D01.1.454.CMB.1.raw
tcagcatagtagtgcacgaccggtgctcgatttagatcgtctgtgttgggtcccttagactctcctgtgcagcctctggattcactttcagtaaccgcctggatgaactggtccgccaggctccgagggagggctggagtggtgcatattaaatacaagctgagtgggtggacaacagagcacgctcgaccgaccgtaggaaaggcagtacttcagcatcacaaggagtatagtaactaactaaaaacgtcgtactagttactactaagaaactagtacgaaacgacggtaccgtaaacgggaaaacggacgaactacggacgttcggttactaagttccgtcgtaccacccgtacgtaccgtaacggtacttacgtttagtttacgtgttaggtcgtacggttagtaccgtataccggttaaggtaacgggtacgtacggtttaacgttcggtacggggttacccgggaaccggtaccggttaaccggccggttaccccgttccctccgttacccctacgtaacccggtacccccgtaaccggtaaccccgggaccccggtaccttcccccggtttacccggttccccccggttaccggtccccgggtccccttcccggaccgggtttcccgaaccggaaccggtacccgtccccgtaacccggtaccggacccgtaaaccgcccggacggtaaccccgggccgtaaccccgggtcgtccgggttacccggtaccgggttaacccgtaacggtacccccggttaccttaaaccccccgttcgtaacccgttcccggtactttacgggtaccggtacggggcggtcccgggtaacgg

SEQ ID NO: 238025 - DNA, 400 bp, Homo sapiens
  misc_feature: GYAE6OF01AMRVQ.10.34.D01.1.454.CMB.1.raw
  modified_base (207)..(207): a, c, t, g, unknown or other
  misc_feature (207)..(207): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
  modified_base (357)..(400): a, c, t, g, unknown or other
  misc_feature (357)..(400): n is a, c, g, or t
tcagcatagtagtgcacgaccggtgctcgatttagatcgtctgtgttgggtttgggtgccgaagttgctggaggtcacggtcaccacgctgctggagggagtagagtcctgaggtaccttgacttcgtggggccacggggaccctggtccaccgtctcctcacgccctaccaaccgaacgggcccagttccggttcccttcccccgnggcccgccctgcctccgaggcgccaccgtcgagacgccacgcggccggccgtcgggcctcgccgttggaccgaacggtaccttaccttacccattactgtcgctaggacggccgggctggggaccaaagggcccanaagttcgnctngcnnnnnnnnnnnnnnnnnnnnnnnnnnnnnnnnnnnnnnnnnnnn

SEQ ID NO: 238026 - DNA, 348 bp, Homo sapiens
  misc_feature: GYAE6OF01DZ7QX.10.34.D01.1.454.CMB.1.raw
  modified_base (332)..(348): a, c, t, g, unknown or other
  misc_feature (332)..(348): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttcgtggggccagggaaccctggtccaccgtctcctcacgcctaccaccaacgggcccatccggtccttccccctcggccgccctgctccaggacgccaccgtccgagacgcacgacgccggcccgtggcctcgccgtaggtaccaaacggtaccttaccttacccactacctatgctggaggccggcgtggacgaacggccgacagtagnnnnnnnnnnnnnnnnn

SEQ ID NO: 238027 - DNA, 471 bp, Homo sapiens
  misc_feature: GYAE6OF01E34O7.10.34.D01.1.454.CMB.1.raw
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
  modified_base (432)..(471): a, c, t, g, unknown or other
  misc_feature (432)..(471): n is a, c, g, or t
tcagcatagtagtgcacgaccggtgctcgatttagatcgtctgtgttgggtttgggtgccgaagttgctggaggtcacggtcaccacgctgcctaggaggtagtagacgtccgtaggaccggtaccttgtacctttcgggcggggaccgaaaccgggtaaccccgttggtaccctaccgttccttcctacgacgcccctacccaacggaaccgggtccctaggttccggttccccttcccccggngggccccgtccctcggccctaccggaagggaccnccctaccccgtaccggaaggaccgaccaacggcgggccccggtcccggtgggcctcggtcccgttggtaacgaaacggtaccctttacccctaccctaacttaactgtcgcgtaggacggggccggcgtcggacgtaacggccactaagtagnnnnnnnnnnnnnnnnnnnnnnnnnnnnnnnnnnnnnnnn

SEQ ID NO: 238028 - DNA, 176 bp, Homo sapiens
  misc_feature: GYAE6OF01C8VO1.10.34.D01.1.454.CMB.1.raw
  modified_base (145)..(176): a, c, t, g, unknown or other
  misc_feature (145)..(176): n is a, c, g, or t
tcagcatagtagtgcacgaccggtgctcgatttagatcgtctgtgttgggtttgggtgccgaagttgctggaggtcacggtcaccacgctgctggagggagtagagtcctgaggaccttgacttcgtggggcccagggtaacccnnnnnnnnnnnnnnnnnnnnnnnnnnnnnnnn

SEQ ID NO: 238029 - DNA, 455 bp, Homo sapiens
  misc_feature: GYAE6OF01B4CW2.10.34.D01.1.454.CMB.1.raw
  modified_base (385)..(386): a, c, t, g, unknown or other
  misc_feature (385)..(386): n is a, c, g, or t
  modified_base (390)..(392): a, c, t, g, unknown or other
  misc_feature (390)..(392): n is a, c, g, or t
  modified_base (394)..(455): a, c, t, g, unknown or other
  misc_feature (394)..(455): n is a, c, g, or t
tcagcatagtagtgcacgaccggtgctcgatttagatcgtctgtgttgggtttgggtgccgaagttgctggaggtcacggtcaccacgctgctggagggagtagagtcctggaggaccttggacttcgtgggggccaaggggaacccctgggtccaccgtctccctcacgccctcccaccgaaacggggcccctagttccggttcccctttcccccccgtgggcccgcccccttggcctaccgagggacgccctaccccgtccggaagacgaccacgacggcccggcccgtgggcctcgccgtggtaccgaacggtacctaccttccccattactagtgcgcggacggtccgggacgtacgggaacgaacgggccacgtagtcgnngctnnngnnnnnnnnnnnnnnnnnnnnnnnnnnnnnnnnnnnnnnnnnnnnnnnnnnnnnnnnnnnnnn

SEQ ID NO: 238030 - DNA, 999 bp, Homo sapiens
  misc_feature: GYAE6OF01EGMNH.10.34.D01.1.454.CMB.1.raw
tcagcatagtagtgcacgaccggtgctcgatttagatcgtctgtgttgggtcccttagactctcctgtgcagcctctggattcacttttcagtacacgtcgtagatacgtacggttcggtcccgacgacgtccacgggaagggggacgggtggtagggtgggttggggtcgactaattaaaattaaactaacgaacgtcgtagtaggttaggggtacggaaacgaagagacgaccgtacgtcgtaccgacccgtaccggtaaaggaacggacgtagttacttacgactacttactacgtaacgaaggaagtagttaattaaacgttaaaacgtaaacgtccgtacgttacgttactacgaactaaacgtacgtaaaccgaacgtaaccggtaaaccggtaaaaggggtaaaccggaccgaaccgtaccggtacggtttaccgtttaatttacccggtttgttaccggaccctaccgttacgaaccgggtaacgttacgtttacgttttacgtttcggtaaggtagtacgggttcggggttaacttacggtccgtaaacgggtttaacgggaaacgggtttccccgtttagttaccggtttaacccgggttaccggggggaaccccgggttaaacccggttaaacccgggtttcccttaccggggaaccccgtttaccctttacccggttcccgtaacccggttccccgtaaccccggtaaaccccggaaccccggtaccccggttaacccggtttacccccgggttccccccgttttcccccggttaccccgggtacccgtcccccgtccgttaacccggtacccggtaccgggtaccgacccgttaacccggttacccggaacggtaaccgtacccgaaccgttacccgggccgggttacccggtccgggtaccggtcccgtacgtaccggtaaccggacttacccggttaccctaccgttaccctagttcgtacggtaccggtggcgggtacggtcg

SEQ ID NO: 238031 - DNA, 464 bp, Homo sapiens
  misc_feature: GYAE6OF01AFY24.10.34.D01.1.454.CMB.1.raw
  modified_base (132)..(132): a, c, t, g, unknown or other
  misc_feature (132)..(132): n is a, c, g, or t
  modified_base (213)..(213): a, c, t, g, unknown or other
  misc_feature (213)..(213): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (397)..(400): a, c, t, g, unknown or other
  misc_feature (397)..(400): n is a, c, g, or t
  modified_base (402)..(406): a, c, t, g, unknown or other
  misc_feature (402)..(406): n is a, c, g, or t
  modified_base (408)..(409): a, c, t, g, unknown or other
  misc_feature (408)..(409): n is a, c, g, or t
  modified_base (411)..(464): a, c, t, g, unknown or other
  misc_feature (411)..(464): n is a, c, g, or t
tcagcatagtagtgcacgaccggtgctcgatttagatcgtctgtggttggggtttgggtgccgaagttgctggagggtcacggtcaccacgctgctggagggagtagagtcctggaggtaccttgcttcggnggggccacgggaccctggtccaccgtctcctcgacgccctaccaccggaacgggccctagttccggttcccttccccccgngggccctcccgtgcctaccggaaggcnccctaaccgtcgagacncgaacgcggcccggtccggtggggctacggtcccgtaggaccgtaaacggtacccttaccttaccccgaattaacgttacggtgtaccgtacggaccggggcccggggtatacgggggactaaaccggggctacagagcnnnntnnnnnanncnnnnnnnnnnnnnnnnnnnnnnnnnnnnnnnnnnnnnnnnnnnnnnnnnnnnnn

SEQ ID NO: 238032 - DNA, 294 bp, Homo sapiens
  misc_feature: GYAE6OF02HAEMW.10.34.D01.1.454.CMB.1.raw
  modified_base (292)..(294): a, c, t, g, unknown or other
  misc_feature (292)..(294): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttcccctggcgccctgctccaggagcacctccgagagcacagcggccctgggctgcctggtcaaggactacttcccactactatgctgagcgggctggcaaggcgcatagnnn

SEQ ID NO: 238033 - DNA, 307 bp, Homo sapiens
  misc_feature: GYAE6OF02GYVB7.10.34.D01.1.454.CMB.1.raw
  modified_base (290)..(307): a, c, t, g, unknown or other
  misc_feature (290)..(307): n is a, c, g, or t
tcagcatagtagtgcacgaccggtgctcgatttagatcgtctgtgttggttggtgccgagtgctggaggtcacgtcaccacgctgctgagggagtagagtcctgaggaccttgacttctggggccagggaaccctggtcaccgtcgtcctcagcctccaccaagggcccatcggtcttccccctggcgccctgctccaggagcacctccgagacgcacagcggccctgggcctgcctggtcaaggactacttcccactactatgctgagcgggctggcaaggcgcatagnnnnnnnnnnnnnnnnnn

SEQ ID NO: 238034 - DNA, 295 bp, Homo sapiens; identical to SEQ ID NO: 237995
  misc_feature: GYAE6OF02GCIZO.10.34.D01.1.454.CMB.1.raw
  modified_base (292)..(295): a, c, t, g, unknown or other
  misc_feature (292)..(295): n is a, c, g, or t

SEQ ID NO: 238035 - DNA, 297 bp, Homo sapiens
  misc_feature: GYAE6OF02GYYFX.10.34.D01.1.454.CMB.1.raw
  modified_base (292)..(297): a, c, t, g, unknown or other
  misc_feature (292)..(297): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttcccctggcgccctgctccaggagcacctccgagagcacagcggccctgggctgcctggtcaaggactacttcccactactatgctgagcgggctggcaaggcgcatagnnnnnn

SEQ ID NO: 238036 - DNA, 298 bp, Homo sapiens
  misc_feature: GYAE6OF02JDYLF.10.34.D01.1.454.CMB.1.raw
  modified_base (293)..(298): a, c, t, g, unknown or other
  misc_feature (293)..(298): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggactacttcccactactatgctgagcgggctggcaaggcgcatagnnnnnn

SEQ ID NO: 238037 - DNA, 295 bp, Homo sapiens; identical to SEQ ID NO: 237995
  misc_feature: GYAE6OF02GSWYM.10.34.D01.1.454.CMB.1.raw
  modified_base (292)..(295): a, c, t, g, unknown or other
  misc_feature (292)..(295): n is a, c, g, or t

SEQ ID NO: 238038 - DNA, 296 bp, Homo sapiens
  misc_feature: GYAE6OF02G51YP.10.34.D01.1.454.CMB.1.raw
  modified_base (292)..(296): a, c, t, g, unknown or other
  misc_feature (292)..(296): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggactacttcccatactatgctgagcgggctggcaaggcgcatagnnnnn

SEQ ID NO: 238039 - DNA, 557 bp, Homo sapiens
  misc_feature: GYAE6OF02GX8S5.10.34.D01.1.454.CMB.1.raw
  modified_base (274)..(274): a, c, t, g, unknown or other
  misc_feature (274)..(274): n is a, c, g, or t
  modified_base (339)..(339): a, c, t, g, unknown or other
  misc_feature (339)..(339): n is a, c, g, or t
  modified_base (459)..(459): a, c, t, g, unknown or other
  misc_feature (459)..(459): n is a, c, g, or t
tcagcatagtagtgcacgaccggtgctcgatttagatcgtctgtgttgggtcccttagactctcctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctcaagagatgattcaaaaagtacgctgtatctgaacatgaacagcctgaaaacggnggacacagccgtgtattactgtgccactcaggaccgatattgtctgatggcgtatgctctaaggngtaccttgacttcgtggggccagggaaccctggtcaccgtctcctcacgccctccaaccaagggcccatccggtccttcccctggcccgtccctgcctccgaggacgccaccctccgganacggccaacgacgccggcccctggggccctcggccctgggtaccaagggtacccttacgttccccaacttacctactcggccttggacggtcgggtcg

SEQ ID NO: 238040 - DNA, 294 bp, Homo sapiens
  misc_feature: GYAE6OF02IAAPG.10.34.D01.1.454.CMB.1.raw
  modified_base (293)..(294): a, c, t, g, unknown or other
  misc_feature (293)..(294): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggactacttcccactactatgctgagcgggctggcaaggcgcatagnn

SEQ ID NO: 238041 - DNA, 297 bp, Homo sapiens
  misc_feature: GYAE6OF02HJ8SG.10.34.D01.1.454.CMB.1.raw
  modified_base (292)..(297): a, c, t, g, unknown or other
  misc_feature (292)..(297): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggactacttcccatactatgctgagcgggctggcaaggcgcatagnnnnnn

SEQ ID NO: 238042 - DNA, 297 bp, Homo sapiens; identical to SEQ ID NO: 238004
  misc_feature: GYAE6OF02GCRB6.10.34.D01.1.454.CMB.1.raw
  modified_base (293)..(297): a, c, t, g, unknown or other
  misc_feature (293)..(297): n is a, c, g, or t

SEQ ID NO: 238043 - DNA, 296 bp, Homo sapiens
  misc_feature: GYAE6OF02IQAQM.10.34.D01.1.454.CMB.1.raw
  modified_base (293)..(296): a, c, t, g, unknown or other
  misc_feature (293)..(296): n is a, c, g, or t
tcagcatagtagtgcacgaccggtgctcgatttagatcgtctgtgttgggtttgcgtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggactacttcccactactatgctgagcgggctggcaaggcgcatagnnnn

SEQ ID NO: 238044 - DNA, 296 bp, Homo sapiens
  misc_feature: GYAE6OF02G17W5.10.34.D01.1.454.CMB.1.raw
  modified_base (291)..(296): a, c, t, g, unknown or other
  misc_feature (291)..(296): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttcccctggcgccctgctccaggagcacctccgagagcacagcggcctgggctgcctggtcaaggactacttcccactactatgctgagcgggctggcaaggcgcatagnnnnnn

SEQ ID NO: 238045 - DNA, 296 bp, Homo sapiens
  misc_feature: GYAE6OF02G339R.10.34.D01.1.454.CMB.1.raw
  modified_base (293)..(296): a, c, t, g, unknown or other
  misc_feature (293)..(296): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggactacttcccactactatgctgagcgggctggcaaggcgcatagnnnn

SEQ ID NO: 238046 - DNA, 304 bp, Homo sapiens
  misc_feature: GYAE6OF02GTECW.10.34.D01.1.454.CMB.1.raw
  modified_base (293)..(304): a, c, t, g, unknown or other
  misc_feature (293)..(304): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttcccctggccgccctgctccaggagcacctccgagagcacagcggcctgggctgcctggtcaaggactacttcccactactatgctgagcgggctggcaaggcgcatacgnnnnnnnnnnnn

SEQ ID NO: 238047 - DNA, 302 bp, Homo sapiens
  misc_feature: GYAE6OF02JI2CT.10.34.D01.1.454.CMB.1.raw
  modified_base (292)..(302): a, c, t, g, unknown or other
  misc_feature (292)..(302): n is a, c, g, or t
tcagcatagtagtgcacgaccggtgctcgatttagatcgtctgtgttgggtttgggtgccgaagttgctggaggtcacggtcaccacgctgctgagggagtagagtcctgaggactttgacttctggggccagggaaccctggtcaccgtctcctcagcctccaccaagggcccatcggtcttccccctggcgccctgctccaggagcacctccgagagcacagcggccctgggctgcctggtcaaggctacttcccactactatgctgagcgggctggcaaggcgcatagnnnnnnnnnnn

SEQ ID NO: 238048 - DNA, 297 bp, Homo sapiens
  misc_feature: GYAE6OF02G689M.10.34.D01.1.454.CMB.1.raw
  modified_base (292)..(297): a, c, t, g, unknown or other
  misc_feature (292)..(297): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggactacttccactactatgctgagcgggctggcaaggcgcatagnnnnnn

SEQ ID NO: 238049 - DNA, 331 bp, Homo sapiens
  misc_feature: GYAE6OF02J3KUR.10.34.D01.1.454.CMB.1.raw
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
  modified_base (319)..(331): a, c, t, g, unknown or other
  misc_feature (319)..(331): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatccggtccttcccctggccgcccctgctccgaggacgccacctcctagacgcacagccggccctgggcctgcccgtggtaccaacggtacctaccttccccgaactacgtatcgacctgacgcgggctggacaaggcncagngnnnnnnnnnnnnn

SEQ ID NO: 238050 - DNA, 294 bp, Homo sapiens
  misc_feature: GYAE6OF02G1T4J.10.34.D01.1.454.CMB.1.raw
  modified_base (291)..(294): a, c, t, g, unknown or other
  misc_feature (291)..(294): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttcccctggcgccctgctccaggagcacctccgagagcacagcggccctgggctgcctggtcaaggactacttcccatactatgctgagcgggctggcaaggcgcatagnnnn

SEQ ID NO: 238051 - DNA, 302 bp, Homo sapiens
  misc_feature: GYAE6OF02GTXF8.10.34.D01.1.454.CMB.1.raw
  modified_base (297)..(302): a, c, t, g, unknown or other
  misc_feature (297)..(302): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtccttccccctggccgccctgcctccaggagcacctccgagacgcacagccggccctgggctgcctggtcaaggactacttcccatactatgctgagcgggctggcaaggcgcatagnnnnnn

SEQ ID NO: 238052 - DNA, 530 bp, Homo sapiens
  misc_feature: GYAE6OF02G00TA.10.34.D01.1.454.CMB.1.raw
tcagcatagtagtgcacgaccggtgctcgatttagatcgtctgtgttgggtcccttagactctcctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctcaagagatgattcaaaaagtacgctgtatctgaacatgaacagcctagaaaacggaggacacagccgtgtattactgtgccactcaggaccgatattgttctgatggcgtatgctctaaggagaccttgacttcgtggggccagggaaccctggtcaccgtctcctcagcctccaccacggcccatccggtccttccccgtggccgccctcgcctccacggacgccaccgtccgagtacgcacgacgccggcctgggcctgccgtggtcaacggtacctaccttcccactactactcgcgtgacgcggtcg

SEQ ID NO: 238053 - DNA, 187 bp, Homo sapiens
  misc_feature: GYAE6OF02IGS1H.10.34.D01.1.454.CMB.1.raw
  modified_base (175)..(187): a, c, t, g, unknown or other
  misc_feature (175)..(187): n is a, c, g, or t
tcagcatagtagtgcacgaccggtgctcgatttagatcgtctgtgttgggtttgggggaagaggaagactgacggccctgctccaggagcacctccgagagcacagcggccctgggctgcctggtcaaggactacttcccactactatgctgagcgggctggcaaggcgcatagnnnnnnnnnnnnn

SEQ ID NO: 238054 - DNA, 303 bp, Homo sapiens
  misc_feature: GYAE6OF02F1KUE.10.34.D01.1.454.CMB.1.raw
  modified_base (288)..(288): a, c, t, g, unknown or other
  misc_feature (288)..(288): n is a, c, g, or t
  modified_base (294)..(303): a, c, t, g, unknown or other
  misc_feature (294)..(303): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccaggggaaccctggtcaccgtctcctcagcctccaccaagggcccatcggtccttcccctggcgccctgctccaggagcacctccgagagcacagcggccctgggctgcctggtcaaggactacttcccactactatgctgagcgggctggcaaggcncatagnnnnnnnnnn

SEQ ID NO: 238055 - DNA, 316 bp, Homo sapiens
  misc_feature: GYAE6OF02F9KHC.10.34.D01.1.454.CMB.1.raw
  modified_base (305)..(316): a, c, t, g, unknown or other
  misc_feature (305)..(316): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccaggggaaccctggtcaccgtctcctcagcctccaccaagggcccatcggtccttccccctggccgccctgcctccgaggagccacctccgagacgcacagccggccctgggctgccgtggtcaaggacctaccttccccatactatgctgagcgggctggcaaggcgacatagnnnnnnnnnnnn

SEQ ID NO: 238056 - DNA, 299 bp, Homo sapiens
  misc_feature: GYAE6OF02IH2JS.10.34.D01.1.454.CMB.1.raw
  modified_base (292)..(299): a, c, t, g, unknown or other
  misc_feature (292)..(299): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagccacctccgagagcacagcggcctgggctgcctggtcaaggactaccttccactactatgctgagcgggctggcaaggcgcatgnnnnnnnn

SEQ ID NO: 238057 - DNA, 304 bp, Homo sapiens
  misc_feature: GYAE6OF02HD2SQ.10.34.D01.1.454.CMB.1.raw
  modified_base (293)..(304): a, c, t, g, unknown or other
  misc_feature (293)..(304): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggctacgttcccactactatgctgagcgggctggcaaggcgcatagnnnnnnnnnnnn

SEQ ID NO: 238058 - DNA, 832 bp, Homo sapiens
  misc_feature: GYAE6OF02IRSN7.10.34.D01.1.454.CMB.1.raw
  modified_base (190)..(190): a, c, t, g, unknown or other
  misc_feature (190)..(190): n is a, c, g, or t
tcagcatagtagtgcacgaccggtgctcgatttagatcgtctgtgttgggtcccttagactctcctgtgcagcctctggattcactttcagtaacgcctggatgaactgggtccgccaggctccagggaaggggctggagtgggttggccatattaaaatcaaagctgatggtgggacaacagagcacgntgcacccgtagaaagcagattcagcatctacgaagacgtatagtacttaaacaaaaacggtccgtacttagtaactctaagaactaagtacggaacacgccgttaaggaaaacgggagacgaacgaccggcgtttagtaacttacgtcgtcgacccacgtaccgaacggtaccgtaatttacgtttcgttcgtagtacgttcgggtaaccgttagcggtaccgttaacgtaacggggtaacgttaccctttggtaaccgtttcgggtaccggggtaaccggtaacgggggtaaccccgtttcgggtaaccgttacccgtacccgttccgtaccgtaccgtaccccggtaccgtaaacccggtaacgggaccccgttaacgtttccccggtaccccgtttccccggttacggtccccggttaccccgtcggtaccgttaccccggtagggaacccgtcccgtaaccccggttaccggaacggacccgtaacccggaaccggaccggtacccgggccccggttagggtccccggttggtaccccggttccgggtaaccggtaaacccgggttaccgtaccctttacccggaacctttaccggtacctacggttaccgacgggttaccgggaaccggttcccggg

SEQ ID NO: 238059 - DNA, 185 bp, Homo sapiens
  misc_feature: GYAE6OF02GU9GW.10.34.D01.1.454.CMB.1.raw
  modified_base (175)..(185): a, c, t, g, unknown or other
  misc_feature (175)..(185): n is a, c, g, or t
tcagcatagtagtgcacgaccggtgctcgatttagatcgtctgtgttgggtttgggggaagaggaagactgacggccctgctccaggagcacctccgagagcacagcggccctgggctgcctggtcaaggactacttcccactactatgctgagcgggctggcaaggcgcatagnnnnnnnnnnn

SEQ ID NO: 238060 - DNA, 621 bp, Homo sapiens
  misc_feature: GYAE6OF02IG2GQ.10.34.D01.1.454.CMB.1.raw
  modified_base (305)..(305): a, c, t, g, unknown or other
  misc_feature (305)..(305): n is a, c, g, or t
  modified_base (485)..(485): a, c, t, g, unknown or other
  misc_feature (485)..(485): n is a, c, g, or t
  modified_base (510)..(510): a, c, t, g, unknown or other
  misc_feature (510)..(510): n is a, c, g, or t
  modified_base (524)..(524): a, c, t, g, unknown or other
  misc_feature (524)..(524): n is a, c, g, or t
tcagcatagtagtgcacgaccggtgctcgatttagatcgtctgtgttgggtcccttagactctcctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctacaagagatgattacaaaaagtacgctagtatctagaacatagaacagcctaggaaaacggaggacacgagcgtgtattactgtcnccatacgaggacctattagttgttctagtagtcggcgtagtcgtctacgtaaggacgtaccgttacgacgtttcggtacggggaccgtacgggtacccgtggtacccacccggtttcctcccgtaccgaccgtcccctacccgaccgaaccgggccctacgtcccggttcccttccccgnggcccgtcccgtgcctaccgaggcnccaccgtccgagcnccaacgcggcccggccgtagggtcctcgtccgtaggacctaaccggtacctaacccgttcccaacgtactacgtcggacgtcggacggtcggtacgg

SEQ ID NO: 238061 - DNA, 305 bp, Homo sapiens
  misc_feature: GYAE6OF02IB0XJ.10.34.D01.1.454.CMB.1.raw
  modified_base (191)..(191): a, c, t, g, unknown or other
  misc_feature (191)..(191): n is a, c, g, or t
  modified_base (206)..(206): a, c, t, g, unknown or other
  misc_feature (206)..(206): n is a, c, g, or t
  modified_base (296)..(305): a, c, t, g, unknown or other
  misc_feature (296)..(305): n is a, c, g, or t
tcagcatagtagtgcacgaccggtgctcgatttagatcgtctgtgttgggtttggtgccgaagttgctggaggtcacggtcaccacgctgctgagggagtagagtcctgaggaccttgacttctggggccagggaaccctggtcaccgtctcctcagcctccaccaaggcccatcggtcttccccctggcnccctgcctccagganccacctccgagagcacagcggccctgggcctgcctggtacaaggctaccttccactactatgctggagcgggactggcaaggcgcatagnnnnnnnnnn

SEQ ID NO: 238062 - DNA, 303 bp, Homo sapiens
  misc_feature: GYAE6OF02FN3YU.10.34.D01.1.454.CMB.1.raw
  modified_base (292)..(303): a, c, t, g, unknown or other
  misc_feature (292)..(303): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggactacttcccactactatgctgagcgggctggcaaggcgcatgnnnnnnnnnnnn

SEQ ID NO: 238063 - DNA, 526 bp, Homo sapiens
  misc_feature: GYAE6OF02HHLNK.10.34.D01.1.454.CMB.1.raw
  modified_base (192)..(192): a, c, t, g, unknown or other
  misc_feature (192)..(192): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (329)..(330): a, c, t, g, unknown or other
  misc_feature (329)..(330): n is a, c, g, or t
  modified_base (340)..(344): a, c, t, g, unknown or other
  misc_feature (340)..(344): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (468)..(468): a, c, t, g, unknown or other
  misc_feature (468)..(468): n is a, c, g, or t
tcagcatagtagtgcacgaccggtgctcgatttagatcgtctgtgttgggtttggtgccgaagttgctggaggtcacggtcaccacgctgctgagggagtagagtcctgaggaccttgacttctgggccagggaaccctggtcaccgtctcctcagcctccaccaacggcccatcggtcttccccctggccnccctgctccaggagccaccgtccgagacgccacagcggccctgggctggcctggtcaaaggtacctacgttcccactacgtatgcttaggacgcgggtctgggcaaggccgactaactagacngtcngagcngtacnngactgcgcgnnnnntatacgtgtacatgtagngtgngacgtagacnacngacanctncgngacgacncganangctacgngagngtacacgtagtacncgcncgagngacgcgtagtacgtactacgagtacgtacgngacgtacgtcgagacgtacgtgtaagtacgtaacgtacgtacggtacgtacacgtacg

SEQ ID NO: 238064 - DNA, 314 bp, Homo sapiens
  misc_feature: GYAE6OF02H0XQ8.10.34.D01.1.454.CMB.1.raw
  modified_base (189)..(189): a, c, t, g, unknown or other
  misc_feature (189)..(189): n is a, c, g, or t
  modified_base (207)..(207): a, c, t, g, unknown or other
  misc_feature (207)..(207): n is a, c, g, or t
  modified_base (227)..(227): a, c, t, g, unknown or other
  misc_feature (227)..(227): n is a, c, g, or t
  modified_base (303)..(314): a, c, t, g, unknown or other
  misc_feature (303)..(314): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttcgtgggccagggaaccctggtcaccgtctcctcacgcctcaccaagggcccatcggtccttccccnggcgcccctgctccaggnccacctccgagacggcacgngcggtccgtgggctgcttggacacggactaccttccacgttactagtgcctagacgcgggctgcaacgggcaatgnnnnnnnnnnnn

SEQ ID NO: 238065 - DNA, 297 bp, Homo sapiens
  misc_feature: GYAE6OF02GHXCQ.10.34.D01.1.454.CMB.1.raw
  modified_base (291)..(297): a, c, t, g, unknown or other
  misc_feature (291)..(297): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaaggcccatcggtcttcccctggcgccctgctccaggagcacctccgagagcacagccggccctgggctgcctggtcaaggactactcccactactatgctgagcgggctggcaaggcgcatagnnnnnnn

SEQ ID NO: 238066 - DNA, 404 bp, Homo sapiens
  misc_feature: GYAE6OF02JYG7W.10.34.D01.1.454.CMB.1.raw
  modified_base (196)..(196): a, c, t, g, unknown or other
  misc_feature (196)..(196): n is a, c, g, or t
  modified_base (356)..(404): a, c, t, g, unknown or other
  misc_feature (356)..(404): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagccctccaaccgaacgggcccatccggtccttccccccnggccgccctcgctcccgaggcgccacctcccgagagccaacacggccggcccctggggctcgcccgtggtacaacggtaccttaaccgttcccaacttacctaagttcgcgttacgaaggccggggcttagggaccgaaggccggtacctaagaacgcgnnnnnnnnnnnnnnnnnnnnnnnnnnnnnnnnnnnnnnnnnnnnnnnnn

SEQ ID NO: 238067 - DNA, 815 bp, Homo sapiens
  misc_feature: GYAE6OF02JZBXS.10.34.D01.1.454.CMB.1.raw
tcagcatagtagtgcacgaccggtgctcgatttagatcgtctgtgttgggtcccgttagactctcctgtgcagcctctggattcactttcagtaacgcctggatgaactgggtccgccaggctccgagggaagggcgtgggaggtgggtggccataattaaatacaaagctagagtggtagggacaacgagagacgacgctcgaccgacccgtaggaaacggacgaagtattacgagctatctacgaagagatagtattaacgaaaagttacgacttagtatcgtagaaacagtaacggaaccagaccgtaaggaaacggaggacgacacgaccgtagtattacgtgtcgacctactacgaggaaccgtatacgttcgttatcgtagtaggtaccgtatcggtaccgttaagtaacggggtacggtttaccgttaggttaaccgttcggacgggggtacccgaaccgggttaccccgtaggtccccgtaccgttccgtacccgtcgtaacccgtacccgtacccgaaacccggtaccggaccccgttaacggttccccggttaccccgtcccccggttccggtcccgtacccgtcccggtaccgtcccggtaaccgggcctaccgtaccccggtaccggaacgacccggtaccgacccggaaccggtccccggaccgggttccggaccggttcccgtaccgggttacccggtaacccggtaaccggttaccccgttaacccccgttacccggtaaaccgttacccgttaccgggttacccgtacggtacggtaccccggggtggttaaccccggg

SEQ ID NO: 238068 - DNA, 296 bp, Homo sapiens
  misc_feature: GYAE6OF02GDHVU.10.34.D01.1.454.CMB.1.raw
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (289)..(296): a, c, t, g, unknown or other
  misc_feature (289)..(296): n is a, c, g, or t
tcagcatagtagtgcacgaccggtgctcgatttagatcgtctgtgttgggtttgggtgccgaagttgctggaggtcacggtcaccacgctgctgagggagtagagtcctgaggaccttgacttctggggccagggaaccctggtcaccgtctcctcagcctccaccaaggccatcggtcttcccctggcgccctgctccaggagcacctccgagacgcacagcggcctgggctgcctggtcaaggactactcccactactntgctgagcgggctggcaaggcncatagnnnnnnnn

SEQ ID NO: 238069 - DNA, 296 bp, Homo sapiens
  misc_feature: GYAE6OF01DATZA.35.12.B01.1.454.CMB.1.raw
  modified_base (292)..(296): a, c, t, g, unknown or other
  misc_feature (292)..(296): n is a, c, g, or t
tcagtacagatcgtcacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgaacgatctgtactgagcgggctggcaaggcgcatagnnnnn

SEQ ID NO: 238070 - DNA, 531 bp, Homo sapiens
  misc_feature: GYAE6OF01C3IT4.35.12.B01.1.454.CMB.1.raw
  modified_base (355)..(355): a, c, t, g, unknown or other
  misc_feature (355)..(355): n is a, c, g, or t
  modified_base (432)..(432): a, c, t, g, unknown or other
  misc_feature (432)..(432): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagttcttttagacatgtccaaacaataagaattacttgacttggtaccagcagaaaccaggacagcctcgaagctgctcatttctggcatctgccgggaattcgggtcctgaccgatcagtggcagcggntggacagatttcactctcaccatcagcagcctgccaggctgagagtgtggtcggtttattacgtgtcagctaaagtntttacccgagttaattcccggtggtaccgttcggacccgtaaaggggacccaaagggtggaacgagttaacgaaacgaaacgttggtcggctggtaccc

SEQ ID NO: 238071 - DNA, 297 bp, Homo sapiens
  misc_feature: GYAE6OF01CC2RX.35.12.B01.1.454.CMB.1.raw
  modified_base (291)..(297): a, c, t, g, unknown or other
  misc_feature (291)..(297): n is a, c, g, or t
tcagtacagatcgtcacgaccggtgctcgatttagtagtgtagatcccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttccgccatctgaacgatctgtactgagcgggctggcaaggcgcatagnnnnnnn

SEQ ID NO: 238072 - DNA, 301 bp, Homo sapiens
  misc_feature: GYAE6OF01EDWU6.35.12.B01.1.454.CMB.1.raw
  modified_base (296)..(301): a, c, t, g, unknown or other
  misc_feature (296)..(301): n is a, c, g, or t
tcagtacagatcgtcacgaccggtgctcgatttagtagtgtagatcccgcggggccactggcatcccagacaggttcagtggcagtgggtctgggacagagttcactctcaccatcagcagcctgcagtctgaagattttgcagtttattactgtcagcaatataatagctggcctccgattgcacttttggccaggggaccaagctggagatcaaacgaactgtggctgcaccatctgtcttcatcttccgccatctgaacgatctgtactgagcgggctggcaaggcgcatagnnnnnn

SEQ ID NO: 238073 - DNA, 561 bp, Homo sapiens
  misc_feature: GYAE6OF01DJE8M.35.12.B01.1.454.CMB.1.raw
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtaccaacaataagaattacttgacttggtaccagcagaaaccaggacagcctccgaanctgctcattttcnggcatctcgcccgggtaattccggggtccctgacccgtattcgagtcggcaggcgggtctggggacaggtatttcgactctacaccatcagcagcctgcaggctgaggtatggtggtcgtttattactgtacagtactaattacttaccagttacgttccggtaggaccggtttaccggaccgtaaacgggtaccgaaagggtcggaacgtacgtaaccgaaacggtaacgtaggtacggcgtggtaccc

SEQ ID NO: 238074 - DNA, 506 bp, Homo sapiens
  misc_feature: GYAE6OF01B16UB.35.12.B01.1.454.CMB.1.raw
  modified_base (310)..(310): a, c, t, g, unknown or other
  misc_feature (310)..(310): n is a, c, g, or t
  modified_base (408)..(408): a, c, t, g, unknown or other
  misc_feature (408)..(408): n is a, c, g, or t
  modified_base (481)..(481): a, c, t, g, unknown or other
  misc_feature (481)..(481): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtccaacaataagaattacttgacttggtaccagcagaaaccaggacagcctccgaagctgctcattttcngggcatctgcccgggaattccgggtcctgaccgattcagtggcaggcgggtctgggacagtactttcactctcaccatcagcagcctgcaggctgagntggtggtcgtttatctgtcagtctaatcttcagtcttcggtgtacgttcggaccgaagggaccaagggtgganatacgaaacgactggtcggctgacc

SEQ ID NO: 238075 - DNA, 526 bp, Homo sapiens
  misc_feature: GYAE6OF01A3K50.35.12.B01.1.454.CMB.1.raw
  modified_base (282)..(282): a, c, t, g, unknown or other
  misc_feature (282)..(282): n is a, c, g, or t
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtccaacaataagaattacttgacttggtaccagcagaaaccnggacagcctccgaagctgctcattttcnggcatcngcccgggaattcgggtccctgaccgattcagtggcaggcgggtctgggacaggactttcactctcaccatcagcagcctgacgaggctggagagtggtggtcgttttattcgtgtcgagtctaattcttaccgagttacttccggtggtaccgtcggaccgaagggaccaagggtgagactacgaaacgtacgtaggcggtctggaccc

SEQ ID NO: 238076 - DNA, 660 bp, Homo sapiens
  misc_feature: GYAE6OF01AQJ7Y.35.12.B01.1.454.CMB.1.raw
  modified_base (324)..(324): a, c, t, g, unknown or other
  misc_feature (324)..(324): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtccctcccagagttcttttagactatcgtccaaacaataaagtaattacttgacttggtaccagtccaagaaaccaggacagccctaccgaagctgctctattttcgngggctatcgtcggacccgggtaagttccgggtccctgaccgtattcgaggtcgggcgtagggtcgggttcgtacggggactaggtactttcccgaccttccgtacccaaccgtatccgaacgccgaacgtcccgtaggacccgtagggtccgtagggaacggtagttcgggttacgggttaccggttttaagttccgttggttaccgtaaggtactaagttacttaccgtagttacgttccggtaggttacccggttaccggtaaccggtaacgggtaccgtaagggtacggacgtacgtaacgtaaacggtacgtaggtcggtacgtcgtacccg

SEQ ID NO: 238077 - DNA, 675 bp, Homo sapiens
  misc_feature: GYAE6OF01CR7UY.35.12.B01.1.454.CMB.1.raw
  modified_base (355)..(355): a, c, t, g, unknown or other
  misc_feature (355)..(355): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctcgtgggcgagacggccacatcagctgcaacgtcctccagtagttctttagactagttcgtaccaaaacaaattaaacgtaatttaaccttaggtaactttaggtaacccagacaacgaaaaccgaaggaaaacgccctaaccgaagtctcgaccttactagtttttcgngggtactagtccgtcggtacccgggtaagtttccggggtccctaggaacccgtagttccgaggttcggacgtacgggtccgggtcgtacggggaacctaggttactttccgactccgtaccacctatacagtccacgtcctagcgaggcgttaggaggtagttggtacgggttacgttttacgttacgtgtacgtagtacctaattacgttaccgtagtttacgttaccgggtcgtacggttacccgggaacgtaacgggtaaccgtaagggtacggaagtacgtaacgaaacgtacgtcggtagacgtcgacctaaccg

SEQ ID NO: 238078 - DNA, 802 bp, Homo sapiens
  misc_feature: GYAE6OF01CM9WA.35.12.B01.1.454.CMB.1.raw
  modified_base (310)..(310): a, c, t, g, unknown or other
  misc_feature (310)..(310): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctcgtgggcgagagggccaccatcagctgcaagtcctccagagtctttagacatgtccaacaataagaattacttgacttggtaccagcagaaaccaggacagcctcgaagctgctctattttcgnggctatcgtcggacccgggtaagttccggggtcccctaggacccgtaatttccgaggtcggcgtaagggccggggttcgtaggggaacctaagggtaactttttacccgaaccgtttcccttaccaaccccgtaattaccgaaacggtacccaacgggtcccccgttagggacccgaaacgggggtccctttaaggggaaacggggttaagtttcggggtttacgggggttaacccgggtttttttaaacgtttaacccggttagggttacccgtaaaaggggtacccttaaaaagttttaccgtttaccccgtaaagggttttaacccgtttacccgggttacggggtaaccccgggttttacccggggaaaccccgggtaaaacgggggtaaccccggtaaaacggggttggggaaaccggttaaacgttaaacccggaaaaacggtaaacccgtttagggttaacggggtcccttaacgggtaaccccg

SEQ ID NO: 238079 - DNA, 655 bp, Homo sapiens
  misc_feature: GYAE6OF01BXP88.35.12.B01.1.454.CMB.1.raw
  modified_base (308)..(308): a, c, t, g, unknown or other
  misc_feature (308)..(308): n is a, c, g, or t
  modified_base (323)..(323): a, c, t, g, unknown or other
  misc_feature (323)..(323): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgccgtacggggacatcgtgatcggcccagtctccagactctctggctgtgtctcgtgggcgagagggccacatcagctgcaagtcctccagtagttctttagacatcgtaccaaacaaataagaattacttagtacttaggtaccagcaagaaaccaggacacgcctacgaancctgctcattttcgnggctacgtcgtcggacccgggtaagttccgggtccctcgaacgtacgttcgaacggtggcgacggtcggtcgtagggacagtacttcgactcgtaccactactacgacgccgtaacgtccctaggcgacggtctgggaacggtagttcgggtaggtttaccgggttttaacttacgtcggtacctaaaggtacctaaaacgtttcgtttaacctaggttaccgtttaccgtacgggttaccggtttacgggaaccggtaacgggaacccggtaaggtacgggaacgtaacgtaaaccgaaacgttacggtaggtacggtgtccgggtaaccc

SEQ ID NO: 238080 - DNA, 549 bp, Homo sapiens
  misc_feature: GYAE6OF01ASQXI.35.12.B01.1.454.CMB.1.raw
  modified_base (313)..(313): a, c, t, g, unknown or other
  misc_feature (313)..(313): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtaccaacaataagaattacttgacttggtaccagcaagaaaccaggacagcctccgaagctgctctattttcngggcatctcggcccggtaagttccggggtcctgacccgtattccgagtcggctaggcggggtctgggactagtactttcactctcacatcagccagtcctgacaggctaggacggtatggtggtacgttttaatctgtcagtactaattataagtcgcgtcggtcctcggtagttcgcgttacgtttcggccgtaacgggacctagggtcctagggatacgaaccgtaacggtacg

SEQ ID NO: 238081 - DNA, 747 bp, Homo sapiens
  misc_feature: GYAE6OF01DQRM5.35.12.B01.1.454.CMB.1.raw
  modified_base (330)..(330): a, c, t, g, unknown or other
  misc_feature (330)..(330): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctcgtgggcgagacgggccaccatcagctgcaacgtcctcccagtagttcttttagacatcgtaccaaactaaataagaatttacttgtaacttcggtaccagcaaagaaaccaggacacgccgtacgaagctgctctattttcgnggctatcgtcggaccccgggtaagttccgggtcctaggacctattcgaggtcggcgaggtcgggtcgtaggggactagttacgtttccacttccgtaccaacctatccgaagccgtaacgccgttcggaccgtacgggtcgttaacggggaacggttacggtttaggggtttacgggtttttacccggggttttaatttacccggttaggttaaacccgtacggtaacttaaacgtttaccttaaccggttacggttttaccggtttaccccgggttaggggttaacccggttaacccggggtaaccccgggtaaaagggggttaaaccccggtaagggggttaaccggtaaacggtaaccttaaaccggtaaaaaccggttaacggttgggtcgggtaaccgtaccggtaaacccg

SEQ ID NO: 238082 - DNA, 585 bp, Homo sapiens
  misc_feature: GYAE6OF01EFIMA.35.12.B01.1.454.CMB.1.raw
  modified_base (322)..(322): a, c, t, g, unknown or other
  misc_feature (322)..(322): n is a, c, g, or t
tcagtacagatcgtcacgaccggtgctcgatttagtagtgtagattccgcgggggagctacaacaggcaggcaggggcagcaagatggtgttgcagacccaggtcttcatttctcttttgctctggatctctggtgcctacggggacatcgtgatggcccagtctccagactctctggctgtgtctcgtgggcgagagggccaccatcagctgcaagtcctcccagtagttcttttagactatcgtaccaaacaataaagaatttactgtacttggtaccagacaacgaaaccaggacagcctccgaagctgctctatttcnggcatctcggcccgggtaagttccgggggtccctggaccgtagttcgagtggcaggcggtcgtgggacagtactttcactactccaccatcagcagcctagccgagcgtagaggatggtggtcgtttatacgtgtacagctaagttacttaccgtagttacgttccggtacggtaccggtttaccggaccgtaaacgggaccgtaaggggttagaacggtaactaaccggaaaacgtacgtacggtggaccgtcgcctaaccg

SEQ ID NO: 238083 - DNA, 693 bp, Homo sapiens
  misc_feature: GYAE6OF01D8O9P.35.12.B01.1.454.CMB.1.raw
tcagtacagatcgtcacgaccggtgctcgatttagtagtgtagattccgcgtgggtagctcaggaggcagagcctggagcatctccactatggcctgggctccactacttctcaccctcctcgctcactgcacaggttcttgggccagtttcacgctgactcagccccactctgtgtcggggtctccgggggagtacggttaccctctcctgccacccgcaacagtggcagcatcgccaacaactatgtgcattggtaccagcagccggcccgggcacgttcccccatcattcgtctatttttgaagtatagtaccgaaacggtcccctcgttcggggttccccttggtttccggttcttcgtcggcctccatcgactacgttccctactaaacgtttcctcgtcccctccctaccacctacttcctcgtacggtactaggaacgactggaacggacggaggtcgtagtactttaagttacttcgttactagttactttatgtaactagtaccgaaccttccttaccgttggttacgggtccgtttcgggggacccggggggtaactacgggtcccgtaccgtacccggttacccgttaaacggtccgaaccggtaccccgtaaacgggtcccgttcccccgggtaccccccgttacccgggttccctaacccggttccgtttaccccccggg

SEQ ID NO: 238084 - DNA, 569 bp, Homo sapiens
  misc_feature: GYAE6OF01DX889.35.12.B01.1.454.CMB.1.raw
  modified_base (315)..(315): a, c, t, g, unknown or other
  misc_feature (315)..(315): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtaccaacaataagaattacttgacttggtaccagcaagaaaccaggacagcctaccgaagctgctctattttcgngggcatcgtcgcccgggtaagttccggggtccctggacccgtattcgagtcggcaggcgggtctggggactaggtactttcacgttctaccaccatacagcacgcctgacgaggctggaggatggtcggtcggtttaatacgtgtcagtactaattacttaccgtagttacgttccggtaggtaccgttacggaccgtaacgggaccgtaagggtcggaagataccgaaaacgtacgtaggtggcgtgtacccg

SEQ ID NO: 238085 - DNA, 554 bp, Homo sapiens
  misc_feature: GYAE6OF01EZYPX.35.12.B01.1.454.CMB.1.raw
  modified_base (310)..(310): a, c, t, g, unknown or other
  misc_feature (310)..(310): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtccaacaataagaattacttgacttggtaccagcagaaaccaggacagcctcgaagctgctctattttcngggcatctcggcccgggaattccgggtccctgaccgtattcaggtcggacaggtccgggtcgtgggacaggtactttaccgactcctaccacctatcgagcacgcctgcaggctgaggtatggtggtcggtttattacgtgtacagtactaattattcctagttacttccggtaggtaccgttacggaccgaacgggtaaccgtaagggtgacgatacgaaacggactaggtcgcgtgtacccg

SEQ ID NO: 238086 - DNA, 667 bp, Homo sapiens
  misc_feature: GYAE6OF01AVEGV.35.12.B01.1.454.CMB.1.raw
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagacgggccaccatcagctgcaagtcctcccagagttcttttagactatcgtaccaaacaataagaattacttgacttggtaccagcagaaaccaggacagcctaccgaagctgctcatttcgnggcatcncggcccggtaagttccgggtcctggaccgtattcgaggtcggctagggtccgggtacgtcgggaactaggttactttccgaccgttctaccaaccgtagtccgaagtccctagcccgttgcgtaacggtcgtacgggtaacggtattcgggttacgggtacggtttttaactacggttacgtacgtaacgaccttaatttacgtaccgttacgttacgtttcccgggtaggttaccggttccgggaaaccggtaacgggtaacccggaaggggttacggaacggtaacggttaacccgtaaaacgggtacgtttacgggtacgggtcccgttaacgtaccccg

SEQ ID NO: 238087 - DNA, 550 bp, Homo sapiens
  misc_feature: GYAE6OF01B7JLU.35.12.B01.1.454.CMB.1.raw
  modified_base (313)..(313): a, c, t, g, unknown or other
  misc_feature (313)..(313): n is a, c, g, or t
  modified_base (431)..(431): a, c, t, g, unknown or other
  misc_feature (431)..(431): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagttcttttagacatgtaccaacaataagaattacttagacttggtaccagcagaaaccaggacagcctccgaagctgctcattttcnggcatctgcccggaagttcgggtcctgaccgattcagtggcaggcgggtctgggacagtatttccactctacacctatcagcagcctgcaggctgaggatgtggtacgtttatacgtntacagtactaatacttaccgtagttacttccggttaggtaccgttacgggtacccgaaaggggtacccgaagggttcggaagtaacacgtaaacggtacgtaggtcggtcgtcgtaccg

SEQ ID NO: 238088 - DNA, 680 bp, Homo sapiens
  misc_feature: GYAE6OF01BPQOE.35.12.B01.1.454.CMB.1.raw
  modified_base (328)..(328): a, c, t, g, unknown or other
  misc_feature (328)..(328): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctcgtgggcgaggagggccaccatcagctgcaagtcctcccagagttcttttagactagtcgtaccaaacaataagaatttacttagacttaggtaccaggacaagaaaccaggacaggcctaccggaagctagctcattttcnggcatcgtcggcccgggtaagtttccggggtcctggacccgtagttccgaaggtcgggacctagggtccggggttacgtacgggggacctaaggttactttcctaacgtccttacgacccttaactcgtaacgacaacggtcccgtacgacgaacgggcgttacggaggtagttggttcgggttacgggttttacttacgtacgttacgtaagtacctaagttacttaccgagtttaaccgttcggttacggtaaccggtttaccggacccggttaaacgggaccgtaaacgggtacggtaaggtaacgtaacggtaaaaccgtaacgttaggtacggtccgtggtaacccg

SEQ ID NO: 238089 - DNA, 749 bp, Homo sapiens
  misc_feature: GYAE6OF01E2K8J.35.12.B01.1.454.CMB.1.raw
  modified_base (312)..(312): a, c, t, g, unknown or other
  misc_feature (312)..(312): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccacatcagctgcaagtcctcccagagtcttttagacatcgtccaaacaataagaattacttgacttgaccagacagaaaccaggacagcctacgaagctgctctattttcgngggctatccgtcggtacccgggtaagtttcccggggtccccttaggacccgttagttcgaggttcgggccgagggtccggggtcgtaggggacctaaggttaccttttaccaaccgtccttacccgaacctagtaccgaacgaccaacggtcccgttaacgccgtaagggtccgtagggaagggtaacgttcgggtttacggggtaccgggttttttaacgttaccgttagggttaacccgtagggttacctaaaatttaccgtttacccgtaagtttacccgttaccgggttaccgggttaaccgggtttacccggggaacccgggtaaaaccggggtaacccggtaaacgggggtttacgggtaaacgtaaacggttaaaccccgtaaaaacgggttaaccggttagggttaccggtcccgtaggtaaacccccg

SEQ ID NO: 238090 - DNA, 564 bp, Homo sapiens
  misc_feature: GYAE6OF01BB7AX.35.12.B01.1.454.CMB.1.raw
  modified_base (311)..(311): a, c, t, g, unknown or other
  misc_feature (311)..(311): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtccaacaataagaattacttgacttggtaccagcagaaaccaggacagcctccgaagctgctctattttcngggctatctggcccgggtaattccggggtccctgaccgtatcgagtggctaggcgggtctgggacagtattcactctcacatcagcacgcctgcaggctagagagtggtggtacgttttagtctgtacgagtactaattacttaccgtagttacttccggtacggtaccggttaccggaccggtaacggggtacccgaagggtcggaacgtaacgtaaccgtaaaacggacgttggtacggtccgtgtacccg

SEQ ID NO: 238091 - DNA, 601 bp, Homo sapiens
  misc_feature: GYAE6OF01BK8UR.35.12.B01.1.454.CMB.1.raw
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
  modified_base (376)..(376): a, c, t, g, unknown or other
  misc_feature (376)..(376): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggcccaccatcagctgacaacgtccctcccgagtacgttcttttagactatcgtaccaaacaaataaagtaacttacttgtacttcggtaaccagacaagaaaccaggacacgcctacgaanctgctctactttcgnggcatcgtcggacccgggtaacgttccgggtcctcggacgtnttcgagtcggcgaggtcgggtcgtcgggactaggttacttaccactcctacacctatcagcacgtccgtgacgacggcgtaggaggtgtggttcggttacgtttattaccgtgtaccgagtactaattacgtactagttacgttcggtaggttaccgttaccggaaccggtaacgggacgtaagggtggaagtacgtaacgaaacgtacgtgacggtgtcgaccg

SEQ ID NO: 238092 - DNA, 598 bp, Homo sapiens
  misc_feature: GYAE6OF01BR9WX.35.12.B01.1.454.CMB.1.raw
  modified_base (312)..(312): a, c, t, g, unknown or other
  misc_feature (312)..(312): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagttcttttagactatgtccaaacaataaagaattactgacttggtaccagcagaaaccaggacagcctcgaagctgctcattttcngggcatctcggcccgggtaagttccggggtccctggaacccgtagttcgaggtggcgaggccgggtctggggactagtactttcgactcgtaccaccatcagcacgctgcgaggctaggagtacgtggttggtacggttttatacgtgtacaggtcctaattactacctagttacgttaccggtgggtaaccgttccgggaaccgtaaacggggtacccgaaaggggttcggaaaggtaaccttaaccggtaaaaccgtacgtacggtcgggtactcggtaacccg

SEQ ID NO: 238093 - DNA, 764 bp, Homo sapiens
  misc_feature: GYAE6OF01E0SIW.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgccgtacggggacatcggtgagtcggcccagtctccagactctctggctgtgtctcgtggggacgaggacggccacatcagctgacacgtccctaccgagtacgttctttagacctagtcgtaccaaactaaataagtaactttacgttacgtacgttacggaaccaggtaccgaaacgaaaccgaggaaccacgccctacggaacgtcgtcgaccttacgttacgttttcgcgggactacgtccgtaccggggtacccgggttacgttccccggggtccctaggaacccgttgttcggacggtcgggccgagggtccgggtacgtacgggactacgtttaccttcgtacctccgtaccgacctacgtccgacgaccgtacgtcccgtaacggtcggtaccggtaggtacggtacgggtacgttcggggttacggtttacgtttacgttcgacgttaacgtacgtaattacgttaccgttaacggttagttacccggttacgggtaccggttacccggtaacggtaacccggggaagggttaaccggttaaccggggtaggtaaaacctaccgggtaaaaccgtaaccgggttacgtacgggttcccgggtaactacccggttaacccg

SEQ ID NO: 238094 - DNA, 557 bp, Homo sapiens
  misc_feature: GYAE6OF01B2RPS.35.12.B01.1.454.CMB.1.raw
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
  modified_base (364)..(364): a, c, t, g, unknown or other
  misc_feature (364)..(364): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagttctttagacatgtccaacaataagaattacttgacttggtaccagcagaaaccaggacagcctcgaagctgctcattttcngggctatcnggcccggtaattcgggtccctgaccgattcgagtgcaggcggtcgnggacagtatttcactctcacctatcagcacgcctgcaggtctaggaggattggtggtacggttttattactggtctaagtctaaattcttaccgacttaagttcccggtggtaccggtttcgggacccgtaaggggtaccaggggttacggacgtaattaccgaaacggtaacgttgtacgggctggtacccg

SEQ ID NO: 238095 - DNA, 766 bp, Homo sapiens
  misc_feature: GYAE6OF01DN3QM.35.12.B01.1.454.CMB.1.raw
  modified_base (327)..(327): a, c, t, g, unknown or other
  misc_feature (327)..(327): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgaggagggccaccatcagctgcaagtcctcccagtagttcttttagactatgtaccaacaaataagaattacttgacttaggtaaccagacaacgaaaccaggaacacgccgtaccgaagctgcttctattttcngggctagtcgtcggacccgggtaagtttccggggtcccctggaacccgtatttacgaggttcgggacgtacgggccggggttcgtacgggggaacctaggttaactttcctaaccgttaccttaccaaccctacttaccgaacgtccgtaacggtaccctgggccgtaacgggtccgttagggtacgggtaagtttcgggttacggggtttaccgggtttttaacgtttacggttacggtttaccgaacgggtaacttaaacgtttaaccgtttacccgttaaggtttacgtttacccgggttacggggttacccgggtttacccggggaacccggtaaacgggggtaaacccggtaaaggggttacgggaaacggtaacgttaaacccgggtaaaacccggtaaacggtttagggtacgggtccgtaggtaacccccg

SEQ ID NO: 238096 - DNA, 923 bp, Homo sapiens
  misc_feature: GYAE6OF01EF0PY.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaacgtcctcccagacgttcttttagacatgtaccaaacaataaagtaaattaccttagtaccgtttaggtaaccacgactaaacgaaacccgaaggaaccacggtccctaccggaacgtccgtacgtacctaccttacgttttttcgtacggggtactacttaccggtcgggtaccccggggtaaacggtttcccgggggttaccccttacgggtaacccgtacgtttacggtaacgggttcgggaccggtaacggggtcccgggggttaccggtttacgggggtaaaccgttaacgggtttacctttttaacccaacccggtttcctaaacccgttaaccccgtaacgttaccgaaacggacccgtaacggttccccgtacggaccggtaacgggtcccggttaagggacgggttaacggtttcgggtttaacggggtttaacccgggtttttaagttacccgtttacgggttaccgtaacgggttaacctttaaacgtttaccgtttaacccgtaacgggttttttaccgttaacccggggttaccggttaaaccggggtttacccggggtaaaccccgggtaaacgggggtaaaccccgggttaagggggttaacccggggtaaaggttaaaccccggtttaaacccggtaaaaaccggtaaacggtttaccgggttacgggtaaccccggtttggaaaccccccgg

SEQ ID NO: 238097 - DNA, 641 bp, Homo sapiens
  misc_feature: GYAE6OF01E52EV.35.12.B01.1.454.CMB.1.raw
  modified_base (330)..(330): a, c, t, g, unknown or other
  misc_feature (330)..(330): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtccctcccagtagttcttttagactattcgtaccaaacaaataagtaatttacttagacttcggtaccagacagaaaaccaggacacgcctaccgaagctgcttctattttcgnggcatcgtcggtcccgggtaacgttcccggggtccctaggacccgtagttcgacggttcggaccgagggtccgggtacgtcggggactaggttactttccacctcctaccaccatccagcacgcctgacgtaggctggacggtagttggttagggttcggtttattacgtgtacagtactaacttacgttaccgtagttacgttccggtgggtaccggttaccgggaccggtaaaccgggtaacggtaagggtcgggaacgtaacgtaccgtaaaaccggtacgttagggttccggtactcgggtaacccg

SEQ ID NO: 238098 - DNA, 753 bp, Homo sapiens
  misc_feature: GYAE6OF01DGV9B.35.12.B01.1.454.CMB.1.raw
  modified_base (745)..(745): a, c, t, g, unknown or other
  misc_feature (745)..(745): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggattctctggtcgccgtacggggacatcgtgatcggcccagtctccagactctctggctgtgtctcgtgggcgaggacgggcccaccatcagctgacacgtccctcccaaggtacgttactttaacggactacgtacgtaccaaaactaaaacttaaacgtaaacttttaacgttacgtaaccgtttacggggtaacccacggaacgaaaacggaaaaccggaacgggaaccgaacggtaccgtaacccggaagtccgtacgtaccttacgttaacgtttttcgcgggtaacctactccggtacgggacccggggttaacgtttcccggggtaccctcggtaacccgtaacgtttcgtacggtcgggaccgtagggtccgggttggtaacgggactaaggttactttccgaaccttaccgtaccaacccgtaataccgacgtaccgtaacgtccgtacgccgtacgggacgtacggaggtacgttaggttcgggtttacgtttaactacgttgtacgagtactaattcgttacgtacgtacgtttaccggaggttaccgtccgggaaccgtaaacgggtacgtaagggtcgaacgtacgaacgtaaactaaggtcgtcgngcgtaacc

SEQ ID NO: 238099 - DNA, 855 bp, Homo sapiens
  misc_feature: GYAE6OF01AH4VG.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctcgtggtcgcctacggggacatcgtgatggcccagtcctccagactctcgtgctgtgtctcgtgggcgagacgggccaccatcagctgacaacgtccctcccgaagtcgtttctttagactacgttacgtaccaaactaaagttaaacgtaactttaaccgttggtaaccgtttacgggtaaccaggtaaccgaaacggaaaaaccccgagggaaccgaaccggtaccccgtaaccggtaaaggtcccgttacggtacctttaccgtttaacggttttttccggtacggggaccttaacgttcccggttaccgggtaaccccggggtttaacggtttccccgggggttacccctacgggtacccgttacgtttaccggtaacgggttccgggaccgtacggggtccggggttccggtacgggtaaccgtaacggtttaccgtttaccgtacccgttacctaacccgaacctacgttaccgaaccgtaccgtaaccggtcccgtacggtccgggacgggtacggtacggtaggttacggtcgggttacggttacgtttaacgttcgtacggtacacgttaacgttaacgttacgttaccgttacgttaccggttaccggtacgggttaccggttaccggaaaccggtaacggggtaacggtaaggggttccggaaacgtaccgtaaaccggtaaacggttcggtagggtccgtacgtcggtaacccg

SEQ ID NO: 238100 - DNA, 711 bp, Homo sapiens
  misc_feature: GYAE6OF01CYTKN.35.12.B01.1.454.CMB.1.raw
  modified_base (306)..(306): a, c, t, g, unknown or other
  misc_feature (306)..(306): n is a, c, g, or t
  modified_base (320)..(320): a, c, t, g, unknown or other
  misc_feature (320)..(320): n is a, c, g, or t
tcagtacagatcgtcacgaccggtgctcgatttagtagtgtagattccgcgggggatctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagttcttttagactatgtaccaaacaaataagaatttacttgacttggtaccagacaagaaaccaggacagcctaccgaanctgctctattttcngggcatccgtggacccgggtaagttccggggtccctggaacccgtattcgaggtcggcgaggtcggggtcgtaggggactaggtacttttacacttccgtaccaaccgtattacgacgcctaacgcccgttgaccgacgggtcctagggacggtagtttcgggtacgggtttaccggtttttaagtttaccgtacggttaccgtaacggtaccttaaagttaccttttaacccgtaaggtttaacgtttaccccgggttacgggtacccgggtttaccgggaaccccggtaaaacgggggtaccccgtaaagggggttacgggtaaacgtaaaccgttaacggtaaaaaccgggttaaacgttgggttacggtccgttaccggtaaacccg

SEQ ID NO: 238101 - DNA, 697 bp, Homo sapiens
  misc_feature: GYAE6OF01ETL8E.35.12.B01.1.454.CMB.1.raw
  modified_base (351)..(351): a, c, t, g, unknown or other
  misc_feature (351)..(351): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgccgtacggggacatcgtgatcggcccagtctccagactctcgtggcttgtgtctcgtgggcgaggcggccaccgatcagctcggactaacgtccctccgagtagttctttagactatcgtaccaaacgaattaaagtaactttacgttacgtacgttacgtaccagacaacgaaaccgaggacacgccgtaccgaagctcgctacttattttcgnggactctcgtaccgggtacccggtacggttcccggggtacctggtaccgtatacggaggtcggcgtacgggtcggtacggtacggactagttacttcgtactcctaccacctagccgaacgcgaccgtcgtacgacttacgtcgtagtacgtttgttagttttacgacgtttagttttacttacgttcgtaatacgtacttaagtttacgtacgttaacgtacggttccggttaacccgttcgggttaaccgggtaccggttaccgggaaacgtaacccgggggtaacgttaaacgggtaaccggtaaacccgtacccggtaaagtaccggttggtccggtaccgg

SEQ ID NO: 238102 - DNA, 710 bp, Homo sapiens
  misc_feature: GYAE6OF01DRAXH.35.12.B01.1.454.CMB.1.raw
  modified_base (309)..(309): a, c, t, g, unknown or other
  misc_feature (309)..(309): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (466)..(466): a, c, t, g, unknown or other
  misc_feature (466)..(466): n is a, c, g, or t
  modified_base (572)..(572): a, c, t, g, unknown or other
  misc_feature (572)..(572): n is a, c, g, or t
tcagtacagatcgtcacgaccggtgctcgatttagtagtgtagattcggcgggggtagctcaggaggcagagcctggagcatctccactatggcctgggcctccactacttctccaccctcctcgctcactgcacgtggttcgtgggcctagtttcacgtctgacctcgaccgcccctactcgtggtacggtcggacgttccggtaacgggtaaacgtaccggttaccagttcctccgttcgacccgaccgagacgtacacgggtcggacacgtaccttaaccgttccgtccggtacttagtcggtacncgtaacggttcgaccgaggtacgccgggtcccggcccggtaccttccccgttaccccgactacggtctaacgtccgagaaccacgtaaaccgtacgtccgtggtcggttcagtcgttcgtcncgcgtcncgtacgtcacgtcctactcgtagttccncgtaccctacctaagtctccgtacgacgtataacggacgtcgaagggcgacgtcgtacctagtaacctcgttacgtcgttaacctttagtcgggttaggaaccgtntaacggttacgtgggttacgggttcggggtaccgggtacgggtacggtaacctacggtccggtacgaacccgttcgaaccgggttcaccggacgtccgtcgcccgtacctgtaccgccttacgtccctcccgtcgtcg

SEQ ID NO: 238103 - DNA, 823 bp, Homo sapiens
  misc_feature: GYAE6OF01DH2PX.35.12.B01.1.454.CMB.1.raw
  modified_base (754)..(754): a, c, t, g, unknown or other
  misc_feature (754)..(754): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctcgtggtcgccgtacggggacatcgtgatcggcccagtctccagactctctggcttgtgtctcgtggggcgacggacggacccacgatcgaaggctagacctaacgtcccctaccgaggtaccgttcgttttaacgacctactacggttaaacccaaacgtaaaacgttaaaacggttaaacttttaaccggttcgttaaacccggttttagggtaaacccgaaggtaaacccgaaaacggtaaaacccgacggggtaaaccaccggtacccgtaacccggaaagtccgttccgtacctttacgtttaacggttttccgtacgggtactaacgtttccggaccgggtacccgggttaaccggtttcccgggtacccgtacgaccgttacgttacggacggtcggtacgtcggggtcggggtacgtaacggacgttacgtactttaccacttccgtacccacgtacgtacacggtacaaccgttccgaggtctacggtccgtaggtacgggtagttacgggttcgttaacgttttacgtagtcgtacgtactaacgttaacgttcgtacgttaccgggttaacgttcccgggtaggttaacccgggtacggacccggtaaaacggnggttaaacgggacgtaacggtaaaccgtaacgtaaacgttacggacgggttcgtacctaccggtaaccg

SEQ ID NO: 238104 - DNA, 805 bp, Homo sapiens
  misc_feature: GYAE6OF01CV7Q9.35.12.B01.1.454.CMB.1.raw
tcagtacagatcgtcacgaccggtgctcgatttagtagtgtagattccgcggggaggctacaacaggcaggcaggggcagcaagatggtgttgcagacccaggtcttcatttctctgttgctctggatctctggtgcctacggggacatcgtgagtcggcccagtctccagactctctggctgtgtctcgtgggcgaggacgggccaccatcagctagactacgtccctcccagtacgttcttttagactatgtacccaaacaaattaaacgtaactttacgttcgtaacgtttacggtaaccagtaccaacgaaaacccgtacggtaacaccgtcccgtaccgaaagtccgtacgcctttacgttaactttttcgtacgggtacctacgtccggtaccggaccccggggttaacggtttcccggggtacccctacggtaacccgtacttcggagggtcggaccggtacggggtccgggttacggacggggtacctaaggtttacctttaccgtacccgttaccttacccaaccgtaactccgaacggaccgtaaccgtccgttaccggacgacgggtaccgtacgggtacgggtacgtttgggttacgggtttaaccggttttaatttccggtaaggttcaacggtacttaacgttacgttacccggttagttccggtttaccggtccgggttaaccggtttacccgggaaaccgggtaacccgggtaaggttaaacgggtcggtaacggtaaccttaacggtaaaacggtaccgttgggtaaccgggtcctaaccgggtaccc

SEQ ID NO: 238105 - DNA, 762 bp, Homo sapiens
  misc_feature: GYAE6OF01AJ8N4.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctcgtggtcgtccgtacggggactagtcgtgagtcggccctagtcctccagtacctctcgtggctgtgtctcgtgggcgaggcggccacatcgagtctgactacgtccctaccgtagtacgttacttagactagtccgtaaccaaacgtaataagtaactttacgtaggtaaccgtttacggtaccaaggtaccgaaaccgaaaccgtacggaaccaccgtcccgtacggaacgtctacgtccttagttacgttttcgcggtcacgttcggtaccgggtacccggttacggtcccggtacctagtaccgtagtccgtaggtcggtacggtcgggtcggtacggacggtacgtacgttaccttcacgtcctaactaccgagtcccgaacgtcgtcgtaccgtacgaccggtaggtccggttacggaggttacggttcggttacgggtttaactttacgtcgtacgtaccgtactaaacgtaccgtttcgaacgtttacggttcggtaccggtacggttaacccgggttacggaacccgggtaaaccgggttagggaacggttacggtaaaccgttaaccggttaaacgtaacccgggtttcgaacggtttccggtaaaccgtccggttaaacccg

SEQ ID NO: 238106 - DNA, 877 bp, Homo sapiens
  misc_feature: GYAE6OF01BAG3U.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgccgtacgggacatcgtagatcggcccagtctccagactctctggctgtgtctcgtgggcgagacggccaccatcagcctgccaacgtccctacccagtacgttacttttagactagttacgtacccaaaactaaataaacggtaaactttaccttaggtaaccgtttacgggtaaccctagtaccaacggaaaaccgaaggtaaccacggtccccttaccggaaacggtccctaggtacctttacgttacgtttttccgacggggtacctaacggttccgttaccgggtaccccggggttaaacggttttcccgggggttacccccgtacggggtaaccccgtaacgttttaccgggaacgggttccgggtaccggtaaccggggttccggggttaccgggtttaacggggaaacccgttaggtttaccggttttaaccgacccggttttaccctaccgtaacccgtaacttaccggtaaacgccgtaaccgtccggttacgacccggttaagggtccctaagggtaacgggttagtttcggggtttacgggtttaacccgggtttttaattccggttaacgttaccgtacggtaaccgtttaaaccggttatttacccgggtaaacgtttccgttaccgggggttacggttaaaccggttcccgggaaaccgggtaaacgggtaacccgtaagggtacggaacgtactaaacccgtagtaacgtggacgtcgacgtaacg

SEQ ID NO: 238107 - DNA, 849 bp, Homo sapiens
  misc_feature: GYAE6OF01B1DOK.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgccgtacggggacatcgtgatcggccagtctccagactctctggctgtgtctcgtgggcgagacgggccaccatcgagcgtcgacaacgtccctcccgagtagttcttttacgactatcgtaccaaacaaacgtaaagtaactttaacgttagtaacgtttacggtaaccaacgacgaaacggtaaaacccgaggaaccgacgtaccccgtaccggaaacgtccgtacggtaccttacgttaacttttccggtacggggacttacggtaccgtccgggtaaccccgggtaacggtttcccggggtaccccgtaacggtacccggttacgttaccgtagggttacgggaccgtacggggtcccgggttacggtacggggtaaccgtaacggttacttttacccaaccgtttacctaaccccgaaccctacgtttacgacccggtaccgtaaccggtccgtaaccggacgacgggttaccggtaacggtaagggttacgtcgggttacggtttaccggtttacgtttttaacgtaaccgttggttaaccgtacgtaaccgtttaaacttaccgttttacccgtaaaggtttacccggttaccgggtttaccgggtaacccgggtttaccccgggaagggtaaacggggtaaccggtaaacggggtggtaaacgaaccgtaacggtaaacccggtaggtttcggacggtccctacgg

SEQ ID NO: 238108 - DNA, 829 bp, Homo sapiens
  misc_feature: GYAE6OF01D82VU.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctcgtggctgtgtctcgtgggcgaggcggccaccatcagctgacaacgtcctacccgagtacgttctttagactatacgtaccaaactaataaagtaacttacttgtacttcggtaacctagaccaagaaaccgtaggaaccacgtaccctaccggaacgcgtcgtaccttctaacgtttttcgcgggtactacgttccgtccgggtacccggggtaacggtttccgggggtacccctacggtacccgttacttacgtacgggtcgggtaccgacggggtccgggtccggttaggggacctaaggttactttaccgtactcccgttaccaaccgtacgtacgtacccgtaccgaaccggtccgtacggtacccgtacggtaccgtcgggaagggttaggttcgggggtttacggtttaccggggtttttaacttaccggtttaggtaccgttacggtaacctttaaacgttacgtttaccgtaaacggttttccgggttacccgggttacggggttaaccccgggttaccggggttaaaccggggaaacccggggttaaacccggggtaaggggttacccgggaaacggtaacgttaaaccccgtaaaacgggtttacccggagggtttaccgggtacccgtacgttaaacccccgg

SEQ ID NO: 238109 - DNA, 840 bp, Homo sapiens
  misc_feature: GYAE6OF01AHU8A.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgccgtacggggacatcgtgatggcccagtctcagactctctggctgtcgtctcgtgggcgaggacgggcccaaccgtatccagcgtgacctaacggtcccctacccgaggtacttaccgttttacgactacgttacgtacccaaaactaaagttaaagtaactttaacgttagttaccgtttacggtaacccagacgaaacggaaaaccacgggtaaccacggtccccttaacccggaaacgtccgttcgaccttaccgttaacgttttttcggcgggtacctaacgttccggtacccggggtaccccgggttaacggtttccccgggtaccccgtacggtacccgtaagttccggaacggttggaccgtagggtccgggtaccgggttaggggaccctaagggtttacctttaccgtaccgttacccgtaccgtaacccgtacgttaccggaaccgtaccggtacgtaccccggacgttaaccgggaccgggtaacggttaacgggtaaacgggtcggtttacgggtacgggtttcggttttaaccgttacgtaccgttagaaccgttattaacttacgtttaccggtaacgttaccggtttaccggtcgggttaccggtaccgggtaccggtaaacgggtacccgtaagggtacggtaacgacgtaaacggaacccgaagttacggtcgtacgtcgtaacccg

SEQ ID NO: 238110 - DNA, 800 bp, Homo sapiens
  misc_feature: GYAE6OF01AH6TT.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatcggcccagtctccagactctctggctgtgtctcgtgggcgagaggccaccatcagctgcaacgtccctcccgagtacgttcttttacgactattcgtacctaaactaaataagtaactttacgttagtacgtttacggtaccagacctaacgaaaccgacggaaccacggtcccctaccggaacggtcctcgtaccttaccgttacgtttttcgacggggtctaacggttcgtacccggtaccccggggtaacggtttcccggggttaccccgtacgtaacccggttacgtccgtaggtcggaccgtagggtccgggtacgtggggactacggttactttcctaccgtacccgtaccctaaccgcgttaccgaacgtccgtacgccgttccggaacgtacgggtacgtagggaacgggttacggtttcggggttacgggttaccgtttttaacggtcgttagttaccggacggttaacttaaacgtttacgtttcccgaaggtttttaccggttacccgggtacgggtttacccggtttccgggaaacccgggtaaccgggggtaacctaaacggggtagggtaacggttaaaccgttaaaaccgtaacgggttaaccgtagggttccggttgaaccggtacccg

SEQ ID NO: 238111 - DNA, 743 bp, Homo sapiens
  misc_feature: GYAE6OF01BOUSN.35.12.B01.1.454.CMB.1.raw
  modified_base (159)..(159): a, c, t, g, unknown or other
  misc_feature (159)..(159): n is a, c, g, or t
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
  modified_base (408)..(408): a, c, t, g, unknown or other
  misc_feature (408)..(408): n is a, c, g, or t
  modified_base (559)..(559): a, c, t, g, unknown or other
  misc_feature (559)..(559): n is a, c, g, or t
tcagtacagatcgtcacgaccggtgctcgatttagtagtgtagattcggcggggggtagctcaggaggcagagcctggagcatcctccactatggcctgggcctccactacttctcaccctcctcgctcactgcacaggttcttgggacctaattttangctgactcacgccctactctggtcggtcggggtccggtccgggggagtacggtcgactactctcgcgccaccgnagcaggtcgacacgacactacagacaacgtatggtnacgtacgtacgaccaacgacggccggcccggtactaccgtaccctaatcgtctagtactacgttaaagtaacggtactactaacgaaaccgtccgtcggtcggtccgtagtacgtcgttcgcgtcggactaagcctacncgtaccttaccactaccgtccaccgtccctaccctactaccttacgttccctaggtaacgtacctaacgtacggtacgaacggggtaccgggacccgtaaggtcgtaactttaaccggtatttaaaccgggtcgtacgtttaacgggtttntaacggttaggttaagggtttaccgaggggtttttaaactagggttttcgtcgggttaccgggttaacgggtaaccggggaaccggtaaacgggtaaccctcggtccggtaacccgtacggtacccggtaccggtaacaacccgggtacccgtaaccgtccccggcccttacccgttcggtccc

SEQ ID NO: 238112 - DNA, 673 bp, Homo sapiens
  misc_feature: GYAE6OF01E3J3X.35.12.B01.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (565)..(565): a, c, t, g, unknown or other
  misc_feature (565)..(565): n is a, c, g, or t
tcagtacagatcgtcacgaccggtgctcgatttagtagtgtagattcggcgggggggtagctcaggaggcagagcctggagcatctccactatggcctgggctccactacttctcaccctcctcgctcactgcacaggttcttgggcctagtttcacgctgactcacgccccactctgtgtcggatctacgggaaancggttaccatcctcctgccacccgnagcagtgcagctacttccnccggtatatgtgcgtagtacggtaccagcacggccggcccgggtcttccccttccccccacccgtacccgtcacgtacccggtagaaacggaaccaaacgtaaaaccggtcccgttacggttcggggtttaccctaggtacgttccggtttcctcgttcgggtcctaccgtacgtaccgaccgtaccgttacccttaccctacgttccctcggtacccctaccccgtaaacctactccgttacgtcggtactacggaaacgtacgtggaacggacggagtcctacgtaactactctgtacgtagttcgttaggacgacaacgtntacgtggttgggtcggttccggggacgggtacgagcgtcggactacgtacgacgtcgaccgaggccctccgccccgttcgactaccgtcctccgtcccctaccgtccg

SEQ ID NO: 238113 - DNA, 796 bp, Homo sapiens
  misc_feature: GYAE6OF01BOUK2.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtcgtctcgtgggcgagagggtcccacatccagctgcaacgtcctaccagtagttcttttaagactacttcgtaccaaaacgtaaattaaagtaaactttacttacgtaactttagggtaaccaaggaccaacggaaaaaccccgagggaaccaacgcccgttaaccggaaacgccgttgtaccttacgttacgtttttcgacggggtaccagtttccgacgggtccccgggttaaagtttcccgggggttaccccttaggtaaccccgggttatttaccgaacggttcgggaccgtaacggggtccgggttacggtacggaactaacggttacttttccgaccttacgttacccaaccgtacgttaccccgaggtaacctaccgtacccggttacgaccgtaaacggggtccgttaagggacggtaacgtttgggttacgggtttacgggttttaactttccggtacgttacgaacgtaactaagttactttccgtaaggtttaccgccgggtttaggtaccggtttccgggaaccggtaacgggttaaccgagggggttacgtaacgtaacgtaccgtaaaacggttacgttacgggacgttacgcggtaaccc

SEQ ID NO: 238114 - DNA, 975 bp, Homo sapiens
  misc_feature: GYAE6OF01ATDSW.35.12.B01.1.454.CMB.1.raw
  modified_base (154)..(154): a, c, t, g, unknown or other
  misc_feature (154)..(154): n is a, c, g, or t
tcagtacagatcgtcacgaccggtgctcgatttagtagtgtagattccgcgggggagctacaacaggcaggcaggggcagcaagatggtgttgcagacccaggtcttcatttctctgtgctctggatctctggtcgccgtacggggacatcggngacgtcggccctagtcctccagactctcgtcggcttgtagtcgtcgtggggcgaggacggccaaccataccgagtcgtcgacaacgtccctaccgtaggtactttactttacgactacgtaccggtacccaaaagtaaattaaaagttaactttaaccgttacgttaaccgtttaccggtaaccacgaaccgaaaacggaaaacccgtaacggaaccgtacggtccccctaacggtaaaccgtcctcggttacccttacgttttaacgtttttccggagggtaccctacggttccgggtaccgggtaacccggggttaaccggttcccgggttacccgtaaccggttaacccgtacgtttaccggaggggttacggtaccgggaccggggttcggggtaacccgggtaagggtaaccgtaacgttttacgtttacccgtaaccgttcccgttaaccaaccgtaccgtaccgggaaaccttacggaaccgggttcccgtaaccggtaccggggtacgttagggtacgggtaacgggtttacggttaccgggggtttaagggtttttaaccccttttagggtttaaccgccggttaagtaaacccggtttaaactttaaccggtttaccgttaaacccgggttaggtttcccgggttaaaccgggggttaccccgggttaaccggggttaaccccgggggaaaaccgttaacggggggttaaacggtaacgggggtttaacgaaaccgggggttaacccttaaaaccggtaaaaccgggttcgggttaaccggttcccgggtaacccgggtttaccaaaccgg

SEQ ID NO: 238115 - DNA, 609 bp, Homo sapiens
  misc_feature: GYAE6OF01CM84Z.35.12.B01.1.454.CMB.1.raw
  modified_base (124)..(124): a, c, t, g, unknown or other
  misc_feature (124)..(124): n is a, c, g, or t
  modified_base (270)..(270): a, c, t, g, unknown or other
  misc_feature (270)..(270): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (389)..(389): a, c, t, g, unknown or other
  misc_feature (389)..(389): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
tcagtacagatcgtcacgaccggtgctcgatttagtagtgtagattccgtcggggtccgactggcatcccagacaggttcagtggcagtggtctgggacagacttcactctcaccatcacgcancctggaagctgaacgtattttgcagtgtacttactggtcacgcctagtagttgtagttccgaacctacgtacgttttccggaccgtaggggacctacggtcggtgaactacgaacgtaatcggtgctacgcaccatcctgtctacncttccctccgactacgtctacggaaattcttcgtacgttaacgtcggaagtcgggtactaggtacgaacggtcccgtaanataccggntacacgactacgnactcagtaagcttaacgntacctacggtcgctacgcgtacgagtntgtacncgtactcgactacacactacgactacgtacgtactactacgtacgtacgtacgcgcgtagtacgtacgtacgtactacgtacacgtacgtacgtacgtcgtactacgtacgactactacgactacgtacgtacgtacgtacgtacgtacgtacgacgtacgtacgcgtactactacgtacgtcgtac

SEQ ID NO: 238116 - DNA, 867 bp, Homo sapiens
  misc_feature: GYAE6OF01D4X32.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctgggtgccgtacgggactagtcgtgatcggcccagtctcagactctctggctgtgtctgtgggcgaggacggccacatcagctgacctaagtccctccaagtgttactttacgaactatacgtaccaaagtaaataagtaacttacgtagtaacgttcggtaaccagacctaaacgaaaaccgacggaaccacggtacccgttaaccgaacgtctacgtaccttacttacgtttttccgacgggtactacgttaccgtaccgggtacccgggtaacgtttcccggggtacccgttaccggtaccgtaagttaccgagggtacggcggtacggggtcgggttacggacgggtaacgtaggtacttttaccgaaccttccgtacgtaaacccctagttaccgacggtacgaaccgtccgttcggaacgtaggggttaacccgtagggtaacgggttaacggttcgggggtttaacgggttttaacgttttaacggttaccgtttacgggaaccgttaaagtaacccggtttaaatttacccgtttaaaccggttacggtttaacccggtttccgggttaaaccggggttaaccccggggttaacccgggtaaacccgggtaaaaccgggtaacccgggtaaaagggggtttacggtaaaacccgtaaacggttaaaacccggtaaaaaccggttacgggtttaacgggtcccgggttaaacgtccccgtaaaaccggg

SEQ ID NO: 238117 - DNA, 782 bp, Homo sapiens
  misc_feature: GYAE6OF01B85Z0.35.12.B01.1.454.CMB.1.raw
  modified_base (189)..(189): a, c, t, g, unknown or other
  misc_feature (189)..(189): n is a, c, g, or t
  modified_base (230)..(230): a, c, t, g, unknown or other
  misc_feature (230)..(230): n is a, c, g, or t
  modified_base (396)..(396): a, c, t, g, unknown or other
  misc_feature (396)..(396): n is a, c, g, or t
  modified_base (752)..(752): a, c, t, g, unknown or other
  misc_feature (752)..(752): n is a, c, g, or t
tcagtacagatcgtcacgaccggtgctcgatttagtagtgtagattccgcggggggagctacaacaggcaggcaggggcagcaagatggtgttgcagacccaggtcttcatttctctgttgctctggatctctggtgccgtacggggactagtcggtgatggcccagtcctaccagactcttcgtcggnttggtgttctcgtgggcggaggacgggccaacatcgaagtntacgcaaacgttcccgaaccaggtagtttctttaagactaactactaccaaaactaaaagtaaacgtaaactttaacgttaccgtaacgttaacgggttaacccaagaacctaaaacggaaaacccggaggaacctaacgggtaccctaaccgaaaggtctacgtntttacgtaagttttccggtagggacttacgtaccggtacgggttacccgggaaacggttttcccggggtacccgtaaacgtacccgttagttacggtaaccgggttcggggaaccgttacggggtacccggggtttaaacggtacgggggtaaaccctaaggttacccgtttaaccgtaccggttaaccccttacccggtaaaccgttaacccgttacgacgttaacggacgtaccgtacgaaccggtcgacgtaggtagtaacgtcgggtggttaccgtttatacgtgtacagtcaaattcttaacgtagtaacgtcgtacgtacgggtacgacggtaggtaaccaggtgaacgnttaacggaacaacgtggtgtcgtccgaccg

SEQ ID NO: 238118 - DNA, 297 bp, Homo sapiens
  misc_feature: GYAE6OF02HGXQS.35.12.B01.1.454.CMB.1.raw
  modified_base (292)..(297): a, c, t, g, unknown or other
  misc_feature (292)..(297): n is a, c, g, or t
tcagtacagatcgtcacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgaacgatctgtactgagcgggctggcaaggcgcatagnnnnnn

SEQ ID NO: 238119 - DNA, 317 bp, Homo sapiens
  misc_feature: GYAE6OF02IS0EV.35.12.B01.1.454.CMB.1.raw
  modified_base (296)..(317): a, c, t, g, unknown or other
  misc_feature (296)..(317): n is a, c, g, or t
tcagtacagatcgtcacgaccggtgctcgatttagtagtgtagattccgcggggtccgactggcatcccagacaggttcagtggcagtgggtctgggacagacttcactctcaccatcagcagactggaagctgaagattttgcagtgtattactgtcagcagtatggtagttccaccgtacacttttggccaggggacccacggtggtgatcaaacgaactgtggctgcaccatctgtcttcatcttcccgcatctgaacgatctgtacctgagcgggctggcaaggcgcatagnnnnnnnnnnnnnnnnnnnnnn

SEQ ID NO: 238120 - DNA, 502 bp, Homo sapiens
  misc_feature: GYAE6OF02GHNPJ.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtccaacaataagaattacttgacttggtaccagcagaaaccaggacagcctccgaagctgctcattttctgggcatctgcccgggaattcgggtccctgaccgattcagtggcagcgggtctgggacagatttcactctcaccatcagcagcctgcaggctgaggatgtggtcggtttatactgtcagcaatattccagtattccgtggtacgttcggaccaagggaccaagggtgagatacgaaacgacgtgtggctgacc

SEQ ID NO: 238121 - DNA, 584 bp, Homo sapiens
  misc_feature: GYAE6OF02JZJD3.35.12.B01.1.454.CMB.1.raw
  modified_base (310)..(310): a, c, t, g, unknown or other
  misc_feature (310)..(310): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtctttagacatgtccaacaataagaattacttgacttggtaccagcagaaaccaggacagcctccgaagcctgctcattttcngggcatctgcccggtaatcgggtccctgaccgattcagtggcaggcgggtctggggacaggtactttcgacttcgtacaacccgaatcagcaagcccttggccagggctaggaggtatggtggtaccggttttatacgtgtcaggtacaaattcttccagtacgtttccgtaggtaccgtttccggaccgtaaacgggggaaccctaaggggtacggtaaggtaacttaccggaaaaccggtaacgttggttacgggtacccgttaggaacccg

SEQ ID NO: 238122 - DNA, 506 bp, Homo sapiens
  misc_feature: GYAE6OF02IH5XZ.35.12.B01.1.454.CMB.1.raw
  modified_base (310)..(310): a, c, t, g, unknown or other
  misc_feature (310)..(310): n is a, c, g, or t
  modified_base (406)..(406): a, c, t, g, unknown or other
  misc_feature (406)..(406): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtccaacaataagaattacttgacttggtaccagcagaaaccaggacagcctccgaagctgctcattttcngggcatctgcccgggaattcgggtccctgaccgattcagtggcagcgggtctgggacagatttcactctcaccatcagcagcctgcaggctgaggntgtggcggtttatactgtcagcaatattccagttacttccgtggacgtttcggccgaaaggggaccaagggtggagatcaaacgacgtgtcggctggacc

SEQ ID NO: 238123 - DNA, 298 bp, Homo sapiens
  misc_feature: GYAE6OF02HJUMF.35.12.B01.1.454.CMB.1.raw
  modified_base (292)..(298): a, c, t, g, unknown or other
  misc_feature (292)..(298): n is a, c, g, or t
tcagtacagatcgtcacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgaacgatctgtactgagcgggctggcaaggcgcatagnnnnnnn

SEQ ID NO: 238124 - DNA, 233 bp, Homo sapiens
  misc_feature: GYAE6OF02IWLFF.35.12.B01.1.454.CMB.1.raw
  modified_base (178)..(179): a, c, t, g, unknown or other
  misc_feature (178)..(179): n is a, c, g, or t
  modified_base (181)..(233): a, c, t, g, unknown or other
  misc_feature (181)..(233): n is a, c, g, or t
tcagtacagatcgtcacgaccggtgctcgatttagtagtgtagatttcgggtttggggggaagaggaagacctgacggtccccccaggagttcaggtgcctgggcacagcggccctgggcctgcctggtcaaggctacttccacgatctgtactgagcgggctggcaaggcgcatagnncnnnnnnnnnnnnnnnnnnnnnnnnnnnnnnnnnnnnnnnnnnnnnnnnnnnnn

SEQ ID NO: 238125 - DNA, 513 bp, Homo sapiens
  misc_feature: GYAE6OF02GC2TR.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtccaacaataagaattacttgacttggtaccagcagaaaccaggacagcctcgaagctgctcattttctgggcatctgcccgggaattcggggtccctgaccgattcagtggcagcgggtctgggacagatttcactctcaccatcagcagcctgcaggctgaggatgtggcggtttattactgtcagctaattatccagttattccgtggacgttcggaccgaagggaccaagggtggaagagtacaaacgaacgtggtcggtcgtgtaccg

SEQ ID NO: 238126 - DNA, 762 bp, Homo sapiens
  misc_feature: GYAE6OF02JDNTA.35.12.B01.1.454.CMB.1.raw
  modified_base (213)..(213): a, c, t, g, unknown or other
  misc_feature (213)..(213): n is a, c, g, or t
  modified_base (257)..(257): a, c, t, g, unknown or other
  misc_feature (257)..(257): n is a, c, g, or t
  modified_base (288)..(288): a, c, t, g, unknown or other
  misc_feature (288)..(288): n is a, c, g, or t
  modified_base (699)..(699): a, c, t, g, unknown or other
  misc_feature (699)..(699): n is a, c, g, or t
tcagtacagatcgtcacgaccggtgctcgatttagtagtgtagattccgcggggagctacaacaggcaggcagggcagcaagatggtgttgcagacccaggtcttcatttctctgttgctctggatctctggtgccgtacgggacatcgtgatcggccagtctccagactctctggctgtgtctcgtgggcggaggacgggccgaccactacnacgcgtcgacgaacgtaccctacccgacgacgtcgtttaacgancgtactacgtacctaaacgaaattaaacgtnaaacttaacgttacgtaacgttacggttaaccgtaacgtacgaacgaaaaccgaacggtaaccgaaacggaccgtaccgaacgtaccgtacgttacgtaccgtactttacgttacggtacgtacgtacgttacggtacccgggtaacggttaccggggttacccggttaccgtaaccggtacgttaccgtaacggtacgggtaccgtacggtacgggtacggtacgggtacgtaacgtacgtttaccgtaaccgtacgtacctaaccgaacgtacgtacgacgaacgaccgtacgtacgacggtacgtacggtacggtaagttacgttacggtacggtttacgttacgttacgttacgtaacgtacgtaacgttaacttaccgtacgtacgttaccggtacggtacggttnaccggtaaccggtaacggtaaccggtaacggtaacggtaacggtaacgtacgtaacggtaacg

SEQ ID NO: 238127 - DNA, 547 bp, Homo sapiens
  misc_feature: GYAE6OF02I7MEV.35.12.B01.1.454.CMB.1.raw
  modified_base (221)..(221): a, c, t, g, unknown or other
  misc_feature (221)..(221): n is a, c, g, or t
tcagtacagatcgtcacgaccggtgctcgatttagtagtgtagattacgacgggggtagcgtcaggaggcagagcctcggagcatctccactatggcctgggctccgactacttctcaccctcctcgctcactgcacaggttcttgggccagtttcacgctgactcagccccactctgtgtcggagtctccgggaaagcggttaccatctcctgcacccgnagcagtggcagcattacctccggctatgtgcagtggtaccagcagcgcccgggctccttcccccaccacccgtcatcccgtgaacgacactaaaaggccctctggggttcctgatcggttctctggctccatcgacacgtctcaattctgcctcctaaccatcctctgactgaagactgagacgaggctgactactactgtcagtctttgaggtcaacgatctgtgggtggttcgggcgggggaccaaggctcgaccgtccgtaagtcaacggcccaaggcctcgcccccgtcggtcctaccgtctcggtttccccgcccttcccg

SEQ ID NO: 238128 - DNA, 297 bp, Homo sapiens
  misc_feature: GYAE6OF02H175T.35.12.B01.1.454.CMB.1.raw
  modified_base (261)..(261): a, c, t, g, unknown or other
  misc_feature (261)..(261): n is a, c, g, or t
  modified_base (293)..(297): a, c, t, g, unknown or other
  misc_feature (293)..(297): n is a, c, g, or t
tcagtacagatcgtcacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgaaccgntctgtactgagcgggctggcaaggcgcatagnnnnn

SEQ ID NO: 238129 - DNA, 547 bp, Homo sapiens
  misc_feature: GYAE6OF02I7NCZ.35.12.B01.1.454.CMB.1.raw
  modified_base (310)..(310): a, c, t, g, unknown or other
  misc_feature (310)..(310): n is a, c, g, or t
  modified_base (387)..(387): a, c, t, g, unknown or other
  misc_feature (387)..(387): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtccaacaataagaattacttgacttggtaccagcagaaaccaggacagcctccgaagctgctcattttcngggcatctgcccgggaattcgggtccctgaccgattcgagtggcaggcgggtctgggacagtatttcactctcaccntcagcagcctgcaggctggagatgtggtcggtttatcgtgtcagtcaattacttccgagttacgttccgtaggtaccgttcggaccgtaaacggggtacctaaggggtacggaagtaagttaccgaaacggtaaccgttaggtacgggtactcgtaaccg

SEQ ID NO: 238130 - DNA, 315 bp, Homo sapiens
  misc_feature: GYAE6OF02GMU6K.35.12.B01.1.454.CMB.1.raw
  modified_base (299)..(315): a, c, t, g, unknown or other
  misc_feature (299)..(315): n is a, c, g, or t
tcagtacagatcgtcacgaccggtgctcgatttagtagtgtagattccgcggggccgacctaggcatcccagacaggttcagtggcagtgggtctgggacagacttcactctcaccatcagcagactggaagctgaagattttagcagtttattactgtctagcaatataatagctggcctcgagttgcacgttttggcaggggaccaaggctggagatcaaacgaactgtggctgcaccatctgtcttcatcttccgcatctgaacgatctgtactgagcggctggcaaggcgcatgnnnnnnnnnnnnnnnnn

SEQ ID NO: 238131 - DNA, 508 bp, Homo sapiens
  misc_feature: GYAE6OF02GZKLY.35.12.B01.1.454.CMB.1.raw
  modified_base (309)..(309): a, c, t, g, unknown or other
  misc_feature (309)..(309): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtccaacaataagaattacttgacttggtaccagcagaaaccaggacagcctcgaagctgctcattttcngggcatctgcccggaattcgggtccctgaccgattcagtggcagcgggtctgggacagtatttcactctcaccatcagcagcctgcagtctagaagtatttgctagtttattactgtcagcaatataatagctgcctcgtagttcgcttacgtttcggaccgtaggggacctaggcgtaggaacgtatacgaacgtacg

SEQ ID NO: 238132 - DNA, 300 bp, Homo sapiens
  misc_feature: GYAE6OF02HTT2Y.35.12.B01.1.454.CMB.1.raw
  modified_base (285)..(285): a, c, t, g, unknown or other
  misc_feature (285)..(285): n is a, c, g, or t
  modified_base (291)..(300): a, c, t, g, unknown or other
  misc_feature (291)..(300): n is a, c, g, or t
tcagtacagatcgtcacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttccgccatctgaacgatctgtactgagcgggctggcaaggcncatagnnnnnnnnnn

SEQ ID NO: 238133 - DNA, 297 bp, Homo sapiens
  misc_feature: GYAE6OF02H0GFW.35.12.B01.1.454.CMB.1.raw
  modified_base (286)..(286): a, c, t, g, unknown or other
  misc_feature (286)..(286): n is a, c, g, or t
  modified_base (292)..(297): a, c, t, g, unknown or other
  misc_feature (292)..(297): n is a, c, g, or t
tcagtacagatcgtcacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgaacgatctgtactgagcgggctggcaaggcncatagnnnnnn

SEQ ID NO: 238134 - DNA, 536 bp, Homo sapiens
  misc_feature: GYAE6OF02INGAQ.35.12.B01.1.454.CMB.1.raw
  modified_base (309)..(309): a, c, t, g, unknown or other
  misc_feature (309)..(309): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtctttagacatgtccaacaataagaattacttgacttggtaccagcagaaaccaggacagcctccgaagctgctctatttcnggctatctgcccgggtaattcgggtccctgaccgtattcgagtggcagcgggtctgggacagtactttcactctcaccatcagcagcctgcagctgagatgtggtcgtttatctgtcagctaattattccagttacttccggtaggtacgttaccggtaccgaaacgggtacccgaagggtggaagtaacgtaccaaaacggttactgggtacggtcgtagtacccg

SEQ ID NO: 238135 - DNA, 724 bp, Homo sapiens
  misc_feature: GYAE6OF02IQ3TR.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgccgtacggggacagtcgtgatggcccagtctccagactctctggctgtgtctcgtgggcgaggacgggccaccatcagctgacaacgtcctccgagtacgttctttagactagttcgtaccaaaactaaataaagtaacttacttgtaccttacggtaaccagacaacgaaaccaggacacgccctaccgaagcctgcctactacgttttcgaggtccagttcgtacggacccgggttaacgttccgggtcccctaggacccgtattacgacggtcggcgtacgggtccgggttcggacgggtactagtttactttaccgacgtttcctacgacctagtcgacgtaccgacgtcccgtaggaccgtagggtccgttaggagggtagttcggttcggggttaccggttttacgttacgtcgtacgtaacgtacgtaaatttcgttacccgtaaaggtttccggttaccgggttaccggtaccggtttacccgggaaccggtaaacgggtaaccggtaaggggtaccggtaagttaccggtaaaccgttaaaccgggaacgtttcgggaacggttacctacggtaccccg

SEQ ID NO: 238136 - DNA, 806 bp, Homo sapiens
  misc_feature: GYAE6OF02IQN1L.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgacaagtcctcccagtagtctttagacatgtaccaacaataaagaattacttgacttgtaccagcaagaaaccaggacacgcctaccgaagctagctctattttctgggctatcgtcggacccgggtaagttccggggtcccctaggaacccgtagttacgacggttcggcgtacggtccgggtacgtacggggaccgtaagggtacttttaccgaaccgttccgttacccgtaaccctaacgttaccgaaacggtcccgtaacggtcccgttaggacccggtaagggtccgtaggtaacgggtacggtttacgggttcggggtttaacccgggtttttaagtttaacccggttaacgggtttacccgaacgggttaaccgttaaactttaaccgtttacccggtaaacggtttaacccgttttaccgggggtttaacccggtaccggggttttaccgggtaaccccgggtaaaccgggggtaaaaccccggtaacgggggttaacggggtaaacggttaacccggttaaaccgtaaaaccggggttaaacccgttagggggtttacccgggttaccgttacccggtaaacccgg

SEQ ID NO: 238137 - DNA, 554 bp, Homo sapiens
  misc_feature: GYAE6OF02JHHJA.35.12.B01.1.454.CMB.1.raw
  modified_base (308)..(308): a, c, t, g, unknown or other
  misc_feature (308)..(308): n is a, c, g, or t
  modified_base (378)..(378): a, c, t, g, unknown or other
  misc_feature (378)..(378): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtccaacaataagaattacttgacttggtaccagcagaaaccaggacagcctcgaagctgctcatttcnggcatctgcccgggaattccgggtccctgaccgattcagtggcagcgggtctgggacagtatttcactcncaccatcagcacgctgcaggctggagatggtggtcggttttattacgtgtacagctaattacttcctagtacttccggtaggtaccgttccggaccgtaaacggggtaccgtaaaggggtcggtaacgtacgttaacggaaaaccggtaaccgtggtacgggtactacggtacccg

SEQ ID NO: 238138 - DNA, 505 bp, Homo sapiens
  misc_feature: GYAE6OF02FIA3J.35.12.B01.1.454.CMB.1.raw
  modified_base (307)..(307): a, c, t, g, unknown or other
  misc_feature (307)..(307): n is a, c, g, or t
  modified_base (375)..(375): a, c, t, g, unknown or other
  misc_feature (375)..(375): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctccagagtcttttagacatgtccaacaataagaattacttgacttggtaccagcagaaccaggacagcctcgaagctgctcattttcngggcatctgcccgggaattcggggtcctgaccgattcagtggcagcgggtctgggacagattcactcncaccatcagcagcctgcaggctgaggactgtggtcggttttattacgtgtcagactaatattcctagtattccgtgtacgtcggccgaagggaccaagggtggaagagtacaacgaactggtggctgacc

SEQ ID NO: 238139 - DNA, 571 bp, Homo sapiens
  misc_feature: GYAE6OF02ITLG1.35.12.B01.1.454.CMB.1.raw
  modified_base (387)..(387): a, c, t, g, unknown or other
  misc_feature (387)..(387): n is a, c, g, or t
  modified_base (457)..(457): a, c, t, g, unknown or other
  misc_feature (457)..(457): n is a, c, g, or t
tcagtacagatcgtcacgaccggtgctcgatttagtagtgtagatttcggcgggggggtagctcaggagggcagagcctggagcatctccactatggccctgggctccactacttctcgaccctcctcgctcactgcaccagggttcttgggccagtttcacgctgactcagccccactctgtgtccggagtcctccgggaaagacggttaccatctcctgcacccgcagcagtggcagcattaccctcggctatgtgcagtggtaccagcagcgcccggctccttcccccaccgaccgtcactccgtagaacgacactaaacgcctgtgggttcctgatcggtctcgtgctcatcgacacgtcctcaattctgccctaccctaacntctctggactgaagactgaggacgaggcgtgacctacgtacgtgtcgtagttcgtttgacggtcaacgtntcgtggtgggtggtcgggcggggtacagcgtcgtaccgtcgtaacggtcgacggacccgaaggtccgtaccgtccccgtcggtccaccgttccgtccgttccccgcccttcccg

SEQ ID NO: 238140 - DNA, 521 bp, Homo sapiens
  misc_feature: GYAE6OF02G89WY.35.12.B01.1.454.CMB.1.raw
  modified_base (252)..(252): a, c, t, g, unknown or other
  misc_feature (252)..(252): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
  modified_base (404)..(404): a, c, t, g, unknown or other
  misc_feature (404)..(404): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtccaacaataanattacttgacttggtaccagcagaaaccaggacagcctcgaagctgctnattttcngggcatctgccgggaattcgggtccctgaccgnttcagtggcaggcgggtcngggacagatttcactctcacatcagcagcctgcaggctggaggntggtggacggtttatacgtgtcagctaatcttccagttactccgtggacgtttcggaccgtaacgggacctaagggtggaagtacgtacgaaacgtaccgtggtacggtctaggacc

SEQ ID NO: 238141 - DNA, 576 bp, Homo sapiens
  misc_feature: GYAE6OF02G675X.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtccaacaataaagaattacttgacttggtaccagcagaaaccaggacacgcctaccgaagctgctctattttctgggcatctcggcccgggtaagttccggggtccctcggaccgtattcgaggtcggcgacggcgggtctgggactagtatttcacttcctacacctatcacgcacgcctgcaggctaggacggatggtcggtcggtttattacgtgtacgtagctaagttacttccgtagttacttccggtaggtacgttccggaccgtaaacggggtaccgaagggtacggaacgaagtacgaaacggtaacgtggtacggtccgtagtaccg

SEQ ID NO: 238142 - DNA, 537 bp, Homo sapiens
  misc_feature: GYAE6OF02FVJBG.35.12.B01.1.454.CMB.1.raw
  modified_base (313)..(313): a, c, t, g, unknown or other
  misc_feature (313)..(313): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtccaacaataagaattacttgacttggtaccagcagaaccaggacagcctccggaagctgctctacttttcgngggcatctcggcccgggtaattccggggtccctggacccgagttcagtcggacaggcgggtcgtgggactggatttcgactctcaccatcagcacgcctgcnggctggagntggtggtacgtttattacgtgtcagactaattacttccagttacttccgtggtacgttcggaccgtaagggacctaggtggaagactacgaacggacgtggtcggactgaccg

SEQ ID NO: 238143 - DNA, 727 bp, Homo sapiens
  misc_feature: GYAE6OF02IA1TO.35.12.B01.1.454.CMB.1.raw
  modified_base (373)..(373): a, c, t, g, unknown or other
  misc_feature (373)..(373): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgccgtacggggacatcgtgagtggcccagtctccagactctctggctgtgtctcgtgggcgaggacgggccaccatcagctgacaacgtcctcccagtagttcttttagactatacgtaccaaaactaaataaagtaaacttacgttagaaccgttaggttaacccaaggtacaaacggaaaacccgaagggaaccaacgtacccgtaccgaaagcgtcgtcttcctaagttttccgnggctacgtcgtcggacccgggttaacgttcccggggtccccttagggaaccgttagttacgtaacgggtcggaacgtcgggcggggttcgtacgggacgtaaggttactttaccacgttcctaccgtaacctatccgaaggtccaacgtcctacggacgaacgggtccgtaggaaggttcgttcgggtacgggttaccggttttaataccgttaggtaccgtaagtaaccttaaacggtttactttaccggtaagttaccgtttaccgggtacgttaccgggttaccggaccgtaacgggaaccgtaggggtacgtaagacgtaacgaaacgcgtttagggacgttcgataccg

SEQ ID NO: 238144 - DNA, 718 bp, Homo sapiens
  misc_feature: GYAE6OF02IO2PG.35.12.B01.1.454.CMB.1.raw
  modified_base (385)..(385): a, c, t, g, unknown or other
  misc_feature (385)..(385): n is a, c, g, or t
  modified_base (548)..(548): a, c, t, g, unknown or other
  misc_feature (548)..(548): n is a, c, g, or t
tcagtacagatcgtcacgaccggtgctcgatttagtagtgtagattccgcgggggagcgtacaacaggcaggcagggcagcaagatggtgttgcagacccaggtcttcattctctgttgctctggatctctggtgcctacgggacagtcgtgatggcccagtctccagactctctggctgtgtctctggcgaggagggccaccgatcagctgacctaacggtccctcccgagacggttcttttacgaacaattcgtaccaaacctaaaataaacgtaaacgtttaaccttgtaaccgtttacggtaacccaacgtccgaaacgaaaacccaacgggaactaacggaccccgttaccgaaagcctacgctaccgtatttttaccgngggacctattccgtcggtaccgggtacgttaccgggttccctaggaaccttagttacgacggtacggctacgggtccgggtacgtagggaccgtagtacgtttccaccgtcctaccgaccacgtacgaaccgcacgtccgttacgcgtacggtctggtaacgngttcggttaggttaccggtttagttaccgtatacgtacggtaactaagtttacgtaccgtaaagttccgtttacggtcggttaccggtacggttaacccggaacggttaaccggacggtaaggagtaaccgtacgtaaacgtccggttaaggcgtacggtcgtaacccgg

SEQ ID NO: 238145 - DNA, 629 bp, Homo sapiens
  misc_feature: GYAE6OF02GS1QO.35.12.B01.1.454.CMB.1.raw
  modified_base (327)..(327): a, c, t, g, unknown or other
  misc_feature (327)..(327): n is a, c, g, or t
  modified_base (461)..(461): a, c, t, g, unknown or other
  misc_feature (461)..(461): n is a, c, g, or t
  modified_base (490)..(490): a, c, t, g, unknown or other
  misc_feature (490)..(490): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccacatcagctgcaagtccctccagtagttcttttagactatcgtaccaaacaataagtaatttactgtacttacggtaccagacaagaaaccaggacacggaccctacgaagctgctctattttcgngggctatcgtggccccgggtaatttcccggggtccctcgaccgtattcgaaggtcggtacagggtccgggtcgtgggacacggtattccgactctacaccatcagccacgtcctggacacggtcctaggaggtntggggttggttacgggtttattaccggtnttaccgatactaattaccgttccgtaagttcgttacgtccgggttaccgtcgggtacccggtaaggggaacccgtaagggtacgggaactacggttaccaaaaccgggtacgttacggtagggtcccttaaggaacccg

SEQ ID NO: 238146 - DNA, 672 bp, Homo sapiens
  misc_feature: GYAE6OF02GT95R.35.12.B01.1.454.CMB.1.raw
  modified_base (325)..(325): a, c, t, g, unknown or other
  misc_feature (325)..(325): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctcgtgggcgaggacgggccaccatcagctgcaacgtcctcccagacgttctttagacatcgtaccaacaataagtaattacttgacttggtaaccagcaagaaaccaggaacagcctacggaacgctgctctattttcgngggactacgttcgtcggaccccgggtaagtttcccgggggtacccctacggtaccgtagtttcgacggttcggccgtaaggggtccggggttcgtacgggggaactagggttactttcaccgttcgtaccaacccgtattccgacgccgaacgcctggacgaggtcgtaggaggtatgggttagggttacgtttaagttacggtgtaccgagtactaaagttacttacgtaacgtttacgttccgggtcggttaccgttaccgggaccggtaaacggggtaccgtaaggggtaggaacggtacgtaaaccgtaacggtaacgttcgggtacggtccgtaggtaaccc

SEQ ID NO: 238147 - DNA, 640 bp, Homo sapiens
  misc_feature: GYAE6OF02INS3Z.35.12.B01.1.454.CMB.1.raw
  modified_base (336)..(336): a, c, t, g, unknown or other
  misc_feature (336)..(336): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctcgtgggcgagaggccaccatcagctgcaacgtcctcccgagtacgttctttagactagtcgtaccaaactaataagtaattacttagacttacggtaccagacaacgaaaccaggacagtaccctacggaagctcgctacctattttcgngggctagtcgcggtaccccgggtaagttcccgggtaccctagtaccgtagttcgacggtggacgtacgggtcgggtacgtaggggactaggtactttcaccgttctaccacctatcgacgtcacgtcctagcgacggctaggacggtagttggttacgggtacgttttattacgtggtacacggtataattacttaccgtaagttcgttccggtacggtaccggttacgggaccgtaacggggtaacctagggtacggagttaacgaaccgtaaacggtccgttagggtacgtacgtggaaccc

SEQ ID NO: 238148 - DNA, 910 bp, Homo sapiens
  misc_feature: GYAE6OF02I4O1A.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagacgggccaccatcagctgacaacggtcctcccagtacgttcttttagactatcgtaccaacaaataagtaacttacttagtactttacggtaaccctagaccaaggtaaacccagggaaccacggaccccgttacccggaaacgtccgttacgtccttaccgttaacgtttttccgtacggggtacctaacgttccggtaccgggtaaccccggggtaaaccggttttacccggggggttacccctacgggtaacccggttaacgtttaccggtaacgggttccggggtaccggtacggggtacccggggtttacccgggtacgggggtaaccgtaacggtttaccgttttaccgaacccggtttacccttaacccgaaccccgttaacgtaacccggtaacggtaccctaaaccgggtccccgttaacgggcccggtaacggggttacgtacgggtaaacggggttacgttacgggtttacggggttttaaccggttttaacgtttaaccggttacgggttaccgtaaacgtaccggttaaatttaacccggttttaacccgtacggtttaaccggttttccggggaaccgggttaccgggtttaacccgggaacccggttaaacgggggaacccgttaaagggggtacggtaaccggtaacgttaacccggtaaacggtaaccggttcgggtaacggttcccgtaggtaaccc

SEQ ID NO: 238149 - DNA, 292 bp, Homo sapiens
  misc_feature: GYAE6OF02I190P.35.12.B01.1.454.CMB.1.raw
  modified_base (289)..(292): a, c, t, g, unknown or other
  misc_feature (289)..(292): n is a, c, g, or t
tcagtacagatcgtcacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccagggaccacggtggtgatcaaacgaactgtggctgcaccatctgtcttcatcttcccgcatctgaacgatctgtactgagcggctggcaaggcgcatagnnnn

SEQ ID NO: 238150 - DNA, 619 bp, Homo sapiens
  misc_feature: GYAE6OF02FTUXK.35.12.B01.1.454.CMB.1.raw
  modified_base (315)..(315): a, c, t, g, unknown or other
  misc_feature (315)..(315): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctccagagtcttttagacatcgtccaaacaataagaattacttgacttggtaccagacagaaaccaggacacgcctaccgaagctgctctatttcgngggctatcgtcggacccgggtaattccggggtccctaggaccgtattcgaggtggacgaggcgggtctgggacagtatttcgacttctccaacctatcagacacgccctgacgtggccgtggaggtatcggtggttaccggttttaattacgttcgtaccgtagtacgtaatttaccttaccgtagtttacgtttcccgtagggttaccgttaccgggaccggtaaacggggtaccgtaacgggttagggaacgtaaggttaaccgaaaccggtaacggttaggtacggtaccgtaggtacccg

SEQ ID NO: 238151 - DNA, 564 bp, Homo sapiens
  misc_feature: GYAE6OF02FOV0K.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctccagagtcttttagacatgtccaacaataagaattacttgacttggtaccagcagaaaccaggacagcctccgaagctgctctattttctgggcatctggcccgggtaattccggggtccctgaccgtattcgagtggcaggcgggtctgggacagtatttcactctcaccatcgagcacgcctgcaggtctaggaggagtggtggtacgtttagttactgtacagtactaattacttacctagttacgttaccggtggtaccggttcggacccggtaacgggaaccgaacgggtaggacgtaacgtacgaaaccggtacgttaggtcggtaccgtgtaacccg

SEQ ID NO: 238152 - DNA, 809 bp, Homo sapiens
  misc_feature: GYAE6OF02HD1MH.35.12.B01.1.454.CMB.1.raw
  modified_base (216)..(216): a, c, t, g, unknown or other
  misc_feature (216)..(216): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctgatctcgtggtcgccgtacgggacactcgtgatcggccagtcctccagacctctcgtgtctgtcgtctcgtgggcgagacggaccacatacngctggactaacgtcctccgagtacttactttagactactacgtaaccaaactaaagtaaaacgtaaattaccgttacggtaaccgttacggtaacccgtaagaaccgaaacggtaaaaacccggaaggaaccgaaccggtacccctacccggaaagtccgtcggtcccttacggttacttttacggcgggacttaacgtccggtacggggtaccccgggttaacggtttcccgggtaaccctccggtaaccgtacgtttaacggtacgggttacggacggtacgggtacggggttaacgtacggggaaacgttaacggttaaccgtttaccctaacggttcccttaacgtaccgaaccgttagaccggtaacgacgttccgtacgccggtaacggcgttaagggaggttacgttacgggtcggttaacgtttaacgttacggttactacgacgtaactaacgtttcgttaacgtaacggtttaacgtcgggttaacgtaccggttacggtaccgggaaacggttaacggaacggggtagtaacggtaaccgtaaacgaaggtaacgttcgggtacgttacgaccggttaaccc

SEQ ID NO: 238153 - DNA, 705 bp, Homo sapiens
  misc_feature: GYAE6OF02F4NJY.35.12.B01.1.454.CMB.1.raw
  modified_base (327)..(327): a, c, t, g, unknown or other
  misc_feature (327)..(327): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctctgggcgagagggccaccatcaggctgcaagtcctccagtacgttctttagactatgtccaacaataagaacttacttgtacttggtaccagctaagaaacctaggaaaacgcctaccgaacgtctcgcctctaattttcnggggtctatccgtcggacccgggtaacgttccgggggtaccctcggtacccgtagttccgaacggtcggacgtacggtcggggtacgtcggggtaaccaggttactttcactcctacctaccctataccgtacgtacgtacgtacccgtcgcgtaacgggtccgttcgaacgggtacttgggttcgggttacgggttttacgttaacgttcggtacgtacgtacgttaacgttacgtttaccgtaacgttacgtttaccggttacggtaccgggtttccggaaccggtaacgggtaacccggtaaagggttcgggtaacgtacggtaaccgtaaacggtaccgttacggttacggtaccggttacggacctaacccgg

SEQ ID NO: 238154 - DNA, 584 bp, Homo sapiens
  misc_feature: GYAE6OF02GLJIU.35.12.B01.1.454.CMB.1.raw
  modified_base (326)..(326): a, c, t, g, unknown or other
  misc_feature (326)..(326): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctcgtgggtcgagagggccaccatcagctgcagtcctccagagtcttttagacatgtccaacaataagtaattacttagacttaggttaacccagacctaacgaaacctaggaacagccctccgaagctgctctattttcgngggctatcgtcgcccgggtaattccgggtaccctcggaccgtagttcaggtggcagtcgggtctgggacagtactttcgacttactcacccatcacgcgtacgcctcgccgaggcgtggagtagtcgtgggtcgtttacgttatggttacagtctaattacgtcgtagtacgttccggtacgttacggtccggaccgaacgggtaaccgaagggttcgaagtacgtaaccgaagtaccggtagttcggcgtacgtacc

SEQ ID NO: 238155 - DNA, 751 bp, Homo sapiens
  misc_feature: GYAE6OF02HG4OB.35.12.B01.1.454.CMB.1.raw
  modified_base (225)..(225): a, c, t, g, unknown or other
  misc_feature (225)..(225): n is a, c, g, or t
tcagtacagatcgtcacgaccggtgctcgatttagtagtgtagattccgcgggggagctacaacaggcacggcaggggcagcaagatggtgttgcgagacccaggtcttccatttctctgttgctctggatctctggtgcctacggggacagtcgtgatggcccagtctccagactctctggctgtgtctctgggcgagagggccaccatcagctgcaagtcccncccagtagttcttttagactatcgtaccctaaacaataaacgtaattttaccttagtactttcggtaaccaggacgaacgaaaacccaggaacgacgcccgtaccggaaggccttcggaccttctaactttttcgtcgggctactcgtcggtacccgggtaacgtttccggggaccctcggaccgtacgtttcgaggttcgggcgtacggtccggggttcgtacgggggtaactaggttacttttaccgaccgttacctacccgtaccgtactacgtacgtaccgacgtcccgtagccggaacgggtctacgggtaggtagttcgggttagggtttccggttttaaacgttcgttacggtaccgtaagtacctttaaaggttccgtttaaccgttaacgttcgttacccgggtttacgggtccggttacccgggaaccgggtaacgggtaacccgtaaggggttaacggaacgttaacgttaaccggaaacgttacggttacggtcggttaccgtacggtaacccg

SEQ ID NO: 238156 - DNA, 729 bp, Homo sapiens
  misc_feature: GYAE6OF02IRUD6.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgccgtacggggacatcgtgatggcccagtcctccagactctctggctgtgtctcgtgggcgagacgggccaccatcagctcgacaacgtccctacccagtacgttcttttagactactcgtaccaaaccaaagtaaagtaaattacgttacgtaacgttcggtaacccacgacaacgaaaccgaaggacaacgcccgtacggaacgcgtcgactacctattttcgcgggtactacgtcgtcggtacccgggtaacggttccgggtccctacggtaccgtacttcgacggtcggcgtacgggcgggtcgtaggggtactaacggttctttaccgaccttcctaaccgtacctaacgttacgaacggtaccgtaccggtccgttacggccggtacggtacggtagggacggtacgtcgggtacggtacggtttattttaacgttacgtacggttacctaacgtactaaacgtttaaccttacgttaacggttacgtttaccgggtacggttaccgggttaccggaaccggtaacgggtaaccggtaaggtaccgaagtaaccgtaacggaaacgtacgtacgggtcgaccgtacgg

SEQ ID NO: 238157 - DNA, 775 bp, Homo sapiens
  misc_feature: GYAE6OF02FIJHV.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctccagactctctggctgtgtctcgtgggcgaggagggccaccatcagctgcaagtcctccagagttcttttagacatgtaccaaacaaataagtaattactgtacttggtaccagcaagaaaccgaggacacgcctaccgaagctgcttctacttttcgagggtcagtcgtcggaccgggtaacgtttccggggtaccccttggtaacccgtagtttaccgacgggttacgggtaccgtaacggggtaccgggggttcggtacgggggtaccctaagggtaccgttttacccgtaaccttccgtaccctaaccccgtaacgttaccgaacggtaccgtaaccggccgttcggaccgtacggggtaaccggttgggaaacgggttagttacgggtttacggggttaaccgggttttttaacgttaccggttacggtacgtaacggttaaccttaacgttaacctttaaccggtaaaggtttcgtttacccgggtaggggttaacccggtttaccggggaacccggttaaaccgggaaccgggtaaacggtacgggaacgtaaccgttaacggaaaaccggttacgttagggtacggtaccgttaggaacccg

SEQ ID NO: 238158 - DNA, 861 bp, Homo sapiens
  misc_feature: GYAE6OF02GA2IE.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgccgtacggggacatcgtgatggcccagtctccagactctcgtggctgtcgtctcgtgggcgaggacggccacatcagctgctaagtccctaccgagtagttctttagactattcgtacccaaactaaataagtaaactttacgttacgtaacgtttacgggtaacccaacgacaacgaaaacccgacgggaaaccacggtaccctaccggaaacgtccgtacggtacctacgttaacgttttttcggacggggtacctacgttccggttaccgggtaccccgggttaaggtttcccggggtcccgttacggaccgtacgtttaccgtaacgggtcgggtaccgtacggggtcggggttaccgtaacggggtaaccgtaacgggttttaaccttttacccggtaaccctttacccgtaacccgtaaccccgtaacgtttacccggaacggaacccgtacggttaccccggttacggaaccgttaacggggttaccgttacggggttaaacgggttacggtttaggggtttaccgggtttacggggtttttaaactttacccggttaaggttaccgtaacgttacttaaacgtttaccgtttaaccgtaaacgttaccgtttaccgggtaccggttacggttccgggaaccgtaacgggtaccgtaaggggtacgtaagtaaccgtaacgaaaccggttacggtcgtaccggtacggtataacccgg

SEQ ID NO: 238159 - DNA, 767 bp, Homo sapiens
  misc_feature: GYAE6OF02HAHWO.35.12.B01.1.454.CMB.1.raw
  modified_base (212)..(212): a, c, t, g, unknown or other
  misc_feature (212)..(212): n is a, c, g, or t
  modified_base (313)..(313): a, c, t, g, unknown or other
  misc_feature (313)..(313): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtcgccgtacggggacatcgtgactggacccagtctccagactctctggctgtgtctcgtgggcgaggacggccaccgntcagctgacaacgtcctccgagtacgttcctttaagactatcgtaccaacaaataaacgtaattaccgttagtacttacggtaccagacgaacgaaaaccnggtaacacggccctacgaagtccgtacgtaccttcttaattttcggacgggtactacgtccgtaccgggtaccgggtaacggtttcccggggtaccccgtaggaaccttacgttacgtacggtcggacgtcggtacccgggggttcgtagggaaccgttacggtttacgtttacccaaccgtttcccctacgtaaacccctacgtaccgaccgccgttaacgcccgggttacgacggttaccgggacgttagggtacgggttacgtcgggtttaaccggttcgttttaaacgttcggttacgtaccggtaagttacgtaactttaaccttcggtaaacgttttcccggaacgggtttccgggtacccggttcgggtaaccccggaaggtaacggttaagggtaacgagtaacccgtaacggtaacgtaccggttagtacggtcctacgtaaccg

SEQ ID NO: 238160 - DNA, 944 bp, Homo sapiens
  misc_feature: GYAE6OF02HTMVW.35.12.B01.1.454.CMB.1.raw
  modified_base (196)..(196): a, c, t, g, unknown or other
  misc_feature (196)..(196): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatggcccagtctcagactctcgtggctgtgtctctgggcgagngggcctaccatacagcctgactaacgtcctcccaagtagttccttttagaccattcgtcccaaaactaaataaaacgtaaatttacgttacgtacgtttacggtaccaagccgaaacgaaaaccagggaaaccaccggtacccgtacccggtaaagccttacggtaccttaccgttaagtttttccgtagggggtacctaacgttccgtacgggaacccccgggggttaaagttttacccgggggtcccccgtacgtaaaccccgggttatttaccggtaacgggttgggtaccaacgggggtaacccggggttccggttaacgggggaacgtaaacggttacgtttaaccctaccgtttacccgtttaacccaaaccccggtaatacccggtaaacgaccgttaaccggacccgttacggacgtaaccggggtacgttacgggtaaaagggtcgggtttaccgggcgggggtttttaaccgggtttttaaacgttttaaccggtttaccggtaccgtaaaccgttaacccgaaattttttaccgtaaacccgggttaattttaaccccgggtttacgggtttaacccggggtttacccggtttcccgggaaacccgggtttaaaacccggggggaaccccgtttaaaaagggggtcggggtaaacccgtaaacgggttaaccggtaaaaaaccgggttaacgtttttaaccggggaacggggttacccttaacccggggtaaccccg

SEQ ID NO: 238161 - DNA, 873 bp, Homo sapiens
  misc_feature: GYAE6OF02F5NTB.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatcggcccagtctccagtactctcgtggctgtgtctcgtgggcgacggtacgggccaccgtatcgaggctcggactaacgtccctccgagtacgttcttttacgacctagttcgtaccaaactaagtaaagtaatttaccgttgtaacgtttacggtaccgagacgtaacgaaaacccaggaaccgacggtacccgtaccggtaacgcctttacgggcctttacgttaacgttttttccggcgggggtaccttaacgggtttccggtaccggggtaaccccgggggttaacggttttcccccgggggttaaccccgttagggtaaaccccgttacgttttaacccggtaaagggttcgggaccgtaacgggggtccggggttaccggtacggggtaaacgtacgggtttactttacctaaccgttccttaacccgaaccttactaccgacgaccggtacgtccgtaacgcggtaacgggtacggttaccggaagggttacggttcgggttaccggggtttacgggtttttaacgtttaccggtacggttacgaacgtttactaacgtttaaccgttaccgtacggtttaccgggttaccggtttacggggtacccgttttaccgggaaccggtaaaccggggtaaccggttaaacggggtacggtaacgtaacgtaacccgaaacggttacggtacgggtaccggtcgtacccggtaacc

SEQ ID NO: 238162 - DNA, 795 bp, Homo sapiens
  misc_feature: GYAE6OF02JUPLO.35.12.B01.1.454.CMB.1.raw
  modified_base (153)..(153): a, c, t, g, unknown or other
  misc_feature (153)..(153): n is a, c, g, or t
  modified_base (752)..(752): a, c, t, g, unknown or other
  misc_feature (752)..(752): n is a, c, g, or t
  modified_base (782)..(782): a, c, t, g, unknown or other
  misc_feature (782)..(782): n is a, c, g, or t
tcagtacagatcgtcacgaccggtgctcgatttagtagtgtagattccgcgggggagctacaacaggcaggcagggcagcaagatggtgttgcagacccaggtcttctatttctctgttgctctggtatctcgtggtcgccgtacggggactntcgtgatcggcccagtcctccgagctctcgtggctgtcgtctcggtgggcgacggcgggccactagccacgtcgtacgactacgtccctaccgtagtacgtttaccttaggactacttcgtaaccaacgtaaataacgtaactttacttagtaaccgttacgtaccgaacgacgaacgaaaccgacggacctacggaaccctacggtaacgtaccgtacgacgttctttacgtttaccggtcgggtaacctacgttccgggtaccggtaccggggttaaaccgggtttcccgggtaccttaccgggaacgtaccgtttccgggaaacggttcgggtaacgtcgggtttaccggaccgggttagggtacgtacgtttaacgttacctaaccgttcccgtaaccgtacgttaacgtaacgtaacccggtcggtaaccgtcccgtacgggtaccgtacggttgtaaccgggtaggtaccgttagggttaccggttttacggttaagtttccggttataccgtactaacgttactacgttttagtacccggttcggttcgtaccgggtaccgttaccgggacggtaacggtacggttaacggngtaacgtaccgtaacggtacgaacgttcgnggaccgtatccgg

SEQ ID NO: 238163 - DNA, 700 bp, Homo sapiens
  misc_feature: GYAE6OF02I2PBH.35.12.B01.1.454.CMB.1.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (506)..(506): a, c, t, g, unknown or other
  misc_feature (506)..(506): n is a, c, g, or t
  modified_base (514)..(514): a, c, t, g, unknown or other
  misc_feature (514)..(514): n is a, c, g, or t
  modified_base (521)..(521): a, c, t, g, unknown or other
  misc_feature (521)..(521): n is a, c, g, or t
tcagtacagatcgtcacgaccggtgctcgatttagtagtgtagattccgcgggggagctacaacaggcaggcaggggcagcaagatggtgttgcagacccaggtcttcatttctctgttcgctctggatcctcgtggtcgccgttacgggggacagttcggtgacgtggcccaggttcctccagacctctacgtggcttgtcgtctcgtgggacgnggacggccaccntcagctgacaacgtcctaccgagtacggtttactttagactacgttacgtaaccaaactaaagtaacgtaaactttacgttacgacgtttacggtaccagtacaacgtaaccggacgaacgacgcccgtacgaacgtcgtacgccttaacgttacgttttcggacggtactacgtccgtcgggtacccgggtacggtttcccgggtcctaccgtacgtcgttcgacggttcggcaacggggtccggtgtacgggactagtacttcacgtcgtacactncgagtccncggtacncgaggtacgacgaggtcgtacgtgggtttacggtccgtttaacggttcgtccgtacacggttaactacgttccgttaactgggtttccttaccggggtgttacccgggtcgtacggaaacgggtcgtaccgggtaagacctacggtaacgaaccggtaggttgcgtacggtcgtaaccg

SEQ ID NO: 238164 - DNA, 808 bp, Homo sapiens
  misc_feature: GYAE6OF02I8T88.35.12.B01.1.454.CMB.1.raw
  modified_base (152)..(152): a, c, t, g, unknown or other
  misc_feature (152)..(152): n is a, c, g, or t
  modified_base (177)..(177): a, c, t, g, unknown or other
  misc_feature (177)..(177): n is a, c, g, or t
  modified_base (188)..(188): a, c, t, g, unknown or other
  misc_feature (188)..(188): n is a, c, g, or t
  modified_base (226)..(226): a, c, t, g, unknown or other
  misc_feature (226)..(226): n is a, c, g, or t
tcagtacagatcgtcacgaccggtgctcgatttagtagtgtagattccggcgggggagctacaacaggcaggcaggggcagcaagatggtgttgcagacccaggtcttcatttctctgttcgctctggatctcgtggtcgccgtacgggacngtcgtgacgtcggccagtcctaccngtacctctcgnggctgtcgtacgtcgtaggacgacgacgggccaccgtntcgacgcgtacgacgtaccgtccctaccgtaaggtaccgtttacgttaacgacgtacgttaccgtaacccgaaaacgttaaaaggtaaacgttaacttttacgttaccggtaaccggtttacggaaaccacgtaaaccggtaaaccgtaaaacccgtaacggggaaccaaaccggtcccgtaacggaaacgttcgtaacggtaccttaccgttacgttttccggaacggtcgttaccgttccgacgggttaaccggttacggttcccggtcgttacgtaccgtaacgttcggaggttacggccggtacgggttccggtggtacgggtaaacccgttcgtcgttttaacccagtcctaacggtacgaccgtagtaccgcgtacggtccgtacggcgtagttcggaaggtacgttcggtaacgttgttaccgtgttacgtgaccgttagtcgtaaccttcgaaacccgttggtacccggttacggtaacggttccgtacgtaaccggtaaccggtaccgggacggttaaaccgaacggttaccgaaccgttaaccggagtaccgggtcgaccgtacggtaaccc

SEQ ID NO: 238165 - DNA, 862 bp, Homo sapiens
  misc_feature: GYAE6OF02FPKPE.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctctggtgcctacgggacatcgtgagtcggcccagtcctaccatacgttctcgtggcttaggtcgtctcgtcgggcgaggaccgggccacccgtagtaccgagtcctagacctaacgtcccctacccgagtacgttttaccttttaggacctagttcgtaaccctaaacgtaaagttaaagttaaacctttacgttagtaaccgtttacgggttaaccgagtaaccgaaacgaaaacccgacgggtaacctaaccgtacccgttaccggaaacgtcccgtacgtaccgtacctttaagtttttccggacggtacctaacgttcggtacccggtacccggggttaaccggttcccgggggttacccgtaacgtacccggttagttacccggtaaggtccgggtccgtacggggtccgggtacgggttaccgggtaacgtacgtttaacgttcccgttaacgttccctaacctaaccgttaccgtaccgtaacgtccgtaacgtcccggtacgaccggtacggttacggtacggttaggtacgttcggttaccgggtttaacgttttagttaacgtcggttaccgtaagttaacttaacgttaacctttacggtaaccggttttacggttacccgttacggggttaccgttaccggggtaacggtaaacgggtaacggtaaacggtcggtaaacgacgttaaacgtaacgtacggtacgtcggtaccaggtaaccg

SEQ ID NO: 238166 - DNA, 869 bp, Homo sapiens
  misc_feature: GYAE6OF02ITYTW.35.12.B01.1.454.CMB.1.raw
tcagtacagatcgtcacgaccggtgctcgatttagtagtgtagattccgcgggggagctacaacaggcaggcaggggcagcaagatggtgttgcagacccaggtcttcatttctctgttgctctggatctcgtggtcgccgtacggggacatcgtgagtcggacccagtcctccagtacctctcgtcggtctgtcgtctcgtcggcgacggacggcccaaccatcacgtctcgactaaccgtccctacccgtagtacggtttacttttaacggaacctattaccggtaacctaaaactaaaagttaaaacgttaaacttttaaccgttacgtaaccggtttacggtaaaccccgaagtaaccggaaaaccggtaaaacccggaacgggaaccgtacccggtaccccgttaacccggaaacggtcccttacggtacctttaccgtttaacgtttttccggacgggtaaccttacgttccggtaccggggtaaccccgggttaacggtttcccgggtaccccgtaacggtacccggttacgttaccgtaagggtccggtaacggtccgggtcggggtacgtacgggaactacggtttacttcgtaccctacgtacctaacgacgtaccgacggtaccgtacgcccgtacggaccggcggttacgtacgggtaggttacggtttacggggttaggtttaccgttttaacgttaccggttagtaaccgtaattcgttaaaccttacgtttaccgaacgttttaaccgtcgggttaaccggttaccgggtcggtaaaccgggaaggttaaaccgggtgggaacggtaataccggtaaaccggaaacgttcgacggtacgttaccgactaacccg

SEQ ID NO: 238167 - DNA, 723 bp, Homo sapiens
  misc_feature: GYAE6OF02I7X0L.35.12.B01.1.454.CMB.1.raw
  modified_base (131)..(131): a, c, t, g, unknown or other
  misc_feature (131)..(131): n is a, c, g, or t
  modified_base (165)..(165): a, c, t, g, unknown or other
  misc_feature (165)..(165): n is a, c, g, or t
  modified_base (267)..(267): a, c, t, g, unknown or other
  misc_feature (267)..(267): n is a, c, g, or t
  modified_base (390)..(390): a, c, t, g, unknown or other
  misc_feature (390)..(390): n is a, c, g, or t
  modified_base (425)..(425): a, c, t, g, unknown or other
  misc_feature (425)..(425): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
  modified_base (518)..(518): a, c, t, g, unknown or other
  misc_feature (518)..(518): n is a, c, g, or t
tcagtacagatcgtcacgaccggtgctcgatttagtagtgtagattccgcgggggagctacaacaggcaggcagggcagcaagatggtgttgcacgacccaggttcttcgatttctctgttgctcgtggtntccgtcgtagtcgaccggtacgggactgtcgtangtcggccagtctcagctctctggctgtcgttacgtcgtgggcacggacggcctaccgagtcacgtccgtagcctaacggttcccctaccgtaagtcggtttntttaccggaatcttaccgacaaaccgttaagtaacgtacgttacttacgacgttcgaccgtgaacaacgaacgttacgacgaccgttaccacgacggtttacacgacgttcgttacgtttcgnggtactcgtcgacggtaccgtcggttccgtacccnggtaacctgtcgtacggcgttggacgtacgggtcacgggaccttagttaccgttccactttcacgtanaccggtnaaccgtcgtagtacccgngtaccgtgacgtacggtagcggttaggttccggtacgtttacgttgtacgtacgacggttaacttcggtactaccggttaccggttcgttacggtacgggtttacccgttacgggttaacgtgggtaaacccgggtaggttaacggagttaacccggttaacgacggggttaccgttctaaccgggaccttaccgttaacccggg

SEQ ID NO: 238168 - DNA, 409 bp, Homo sapiens
  misc_feature: GYAE6OF01BX31L.33.60.F05.1.454.CMB.1.raw
  modified_base (403)..(409): a, c, t, g, unknown or other
  misc_feature (403)..(409): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgaagtgtgtgtactgagcgggctggcaaggcgcatagnnnnnnn

SEQ ID NO: 238169 - DNA, 406 bp, Homo sapiens
  misc_feature: GYAE6OF01D0PIP.33.60.F05.1.454.CMB.1.raw
  modified_base (402)..(406): a, c, t, g, unknown or other
  misc_feature (402)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcggtgggtctgggacagacttcactctcaccatcagcagcctagagcctgaagattttgcagtttattactgtcagcagcgtagcaactggtcttggacgttcggccaagggaccaaggtggaaatcaaacgaactgtaggctgcacatctgtcttcatcttcccgcatctgaagtgtgtgtactgagcgggctggcaaggcgcatagnnnnn

SEQ ID NO: 238170 - DNA, 410 bp, Homo sapiens
  misc_feature: GYAE6OF01A2KX6.33.60.F05.1.454.CMB.1.raw
  modified_base (402)..(410): a, c, t, g, unknown or other
  misc_feature (402)..(410): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcacatctgtcttcatcttcccgccatctgaagtgtgtgtactgagcgggctggcaaggcgcatagnnnnnnnnn

SEQ ID NO: 238171 - DNA, 407 bp, Homo sapiens
  misc_feature: GYAE6OF01AXC6A.33.60.F05.1.454.CMB.1.raw
  modified_base (401)..(407): a, c, t, g, unknown or other
  misc_feature (401)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttcccgcatctgaagtgtgtgtactgagcgggctggcaaggcgcatagnnnnnnn

SEQ ID NO: 238172 - DNA, 402 bp, Homo sapiens
  misc_feature: GYAE6OF01CFHQE.33.60.F05.1.454.CMB.1.raw
  modified_base (398)..(402): a, c, t, g, unknown or other
  misc_feature (398)..(402): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcgcattaagtgtgtgtactgagcgggctggcaaggcgcatagnnnnn

SEQ ID NO: 238173 - DNA, 406 bp, Homo sapiens
  misc_feature: GYAE6OF01A280X.33.60.F05.1.454.CMB.1.raw
  modified_base (400)..(406): a, c, t, g, unknown or other
  misc_feature (400)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtttattactgtctgcagcgtagcaactggcctaacaccttcggccaagggacacgactggagattaaacgactgtggctgcaccatctgtcttcatcttccgccatctgagtgtgtgtactgagcgggctggcaaggcgcatagnnnnnnn

SEQ ID NO: 238174 - DNA, 405 bp, Homo sapiens
  misc_feature: GYAE6OF01D80AU.33.60.F05.1.454.CMB.1.raw
  modified_base (371)..(371): a, c, t, g, unknown or other
  misc_feature (371)..(371): n is a, c, g, or t
  modified_base (401)..(405): a, c, t, g, unknown or other
  misc_feature (401)..(405): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttcccgcatctgaagtgtntgtactgagcgggctggcaaggcgcatagnnnnn

SEQ ID NO: 238175 - DNA, 408 bp, Homo sapiens
  misc_feature: GYAE6OF01EJL1X.33.60.F05.1.454.CMB.1.raw
  modified_base (402)..(408): a, c, t, g, unknown or other
  misc_feature (402)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgaagtgtgtgtactgagcgggctggcaaggcgcatagnnnnnnn

SEQ ID NO: 238176 - DNA, 404 bp, Homo sapiens
  misc_feature: GYAE6OF01CRQ2B.33.60.F05.1.454.CMB.1.raw
  modified_base (398)..(404): a, c, t, g, unknown or other
  misc_feature (398)..(404): n is a, c, g, or t
tcagtacacacactcacgaccggtgctcgatttagtacgtcatcagggaaagggccaccctctcttgtagggccagtcagagtgttagcagcaactacttagcctggtaccaacaaaaacctggccagactcccaggctcctcatccatggtgcatccaccagggccactggcatcccagacaggttcagtggcagtgggtctgggacagacttcactctcaccatcagcagcctagagcctgaagattttgcagtttatactgtcagcagcgtagcaactggtcttggacgttcggccaagggaccaaggtggaaatcaaacgaactgtggctgcacatctgtcttcatctccgcatctgaagtgtgtgtactgagcgggctggcaaggcgcatagnnnnnnn

SEQ ID NO: 238177 - DNA, 409 bp, Homo sapiens
  misc_feature: GYAE6OF01EC7D9.33.60.F05.1.454.CMB.1.raw
  modified_base (402)..(409): a, c, t, g, unknown or other
  misc_feature (402)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttccgcatctgaagtgtgtgtactgagcgggctgggcaaggcgcatagnnnnnnnn

SEQ ID NO: 238178 - DNA, 408 bp, Homo sapiens
  misc_feature: GYAE6OF01EMA71.33.60.F05.1.454.CMB.1.raw
  modified_base (401)..(408): a, c, t, g, unknown or other
  misc_feature (401)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttcccgcatctgaagtgtgtgtactgagcgggctggcaaggcgcatagnnnnnnnn

SEQ ID NO: 238179 - DNA, 410 bp, Homo sapiens
  misc_feature: GYAE6OF01B7VVG.33.60.F05.1.454.CMB.1.raw
  modified_base (402)..(410): a, c, t, g, unknown or other
  misc_feature (402)..(410): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtcttcatcttcccgccatctgaagtgtgtgtactgagcgggctggcaaggcgcatagnnnnnnnnn

SEQ ID NO: 238180 - DNA, 409 bp, Homo sapiens
  misc_feature: GYAE6OF01BKY4S.33.60.F05.1.454.CMB.1.raw
  modified_base (401)..(409): a, c, t, g, unknown or other
  misc_feature (401)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttcccgcatctgaagtgtgtgtactgagcgggctggcaaggcgcatagnnnnnnnnn

SEQ ID NO: 238181 - DNA, 392 bp, Homo sapiens
  misc_feature: GYAE6OF01DBK04.33.60.F05.1.454.CMB.1.raw
  modified_base (284)..(284): a, c, t, g, unknown or other
  misc_feature (284)..(284): n is a, c, g, or t
  modified_base (381)..(381): a, c, t, g, unknown or other
  misc_feature (381)..(381): n is a, c, g, or t
  modified_base (387)..(392): a, c, t, g, unknown or other
  misc_feature (387)..(392): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcactctcaccatcgacagactggagcctgaagattttgcagtctattactgtcagcagtatactgggganacgttcggccaagggaccaaggtcggaaatcaaacgaactgtaggctgcaccatctgtcttcatcttccgcatcgtactgagcgggctggcaaggcncatagnnnnnn

SEQ ID NO: 238182 - DNA, 407 bp, Homo sapiens
  misc_feature: GYAE6OF01CWH5W.33.60.F05.1.454.CMB.1.raw
  modified_base (403)..(407): a, c, t, g, unknown or other
  misc_feature (403)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggtcaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgaagtgtgtgtactgagcgggctggcaaggcgcatagnnnnn

SEQ ID NO: 238183 - DNA, 409 bp, Homo sapiens
  misc_feature: GYAE6OF01AWM7C.33.60.F05.1.454.CMB.1.raw
  modified_base (403)..(409): a, c, t, g, unknown or other
  misc_feature (403)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgaagtgtgtgtactgagcgggctggcaaggcgcatagnnnnnnn

SEQ ID NO: 238184 - DNA, 408 bp, Homo sapiens
  misc_feature: GYAE6OF01A6224.33.60.F05.1.454.CMB.1.raw
  modified_base (403)..(408): a, c, t, g, unknown or other
  misc_feature (403)..(408): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgaagtgtgtgtactgagcgggctggcaaggcgcatagnnnnnn

SEQ ID NO: 238185 - DNA, 416 bp, Homo sapiens
  misc_feature: GYAE6OF01CPL4I.33.60.F05.1.454.CMB.1.raw
  modified_base (391)..(392): a, c, t, g, unknown or other
  misc_feature (391)..(392): n is a, c, g, or t
  modified_base (407)..(416): a, c, t, g, unknown or other
  misc_feature (407)..(416): n is a, c, g, or t
tcagtacacacactcacgaccggtgctcgatttagtacgtcatcaggggaaagggccaccctctcttgtagggccagtcagagtgttagcagcaactaacttagcctggtaccagcagacacctggccaggctcccaggctcctcatccatggtgcatccaccagggccactggcatcccagacaggttcagtggcagtgggtctggggacagacttcattctcaccatcagcagcctagagcctgaggattctgcagtttattactgtcagcagcgtctcaactggcctccgtgcaccttcggccaagggcacgattggagattaaacgaactgtggctgcaccatctgtcttcatcttcccgcatctgaagtgtgtgtactgagcgggnnggcaaggcgcatagnnnnnnnnnn

SEQ ID NO: 238186 - DNA, 406 bp, Homo sapiens
  misc_feature: GYAE6OF01CYQX1.33.60.F05.1.454.CMB.1.raw
  modified_base (400)..(406): a, c, t, g, unknown or other
  misc_feature (400)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcacatctgtctcatcttccgccatctgaagtgtgtgtactgagcgggctgggcaaggcgcatagnnnnnnn

SEQ ID NO: 238187 - DNA, 410 bp, Homo sapiens
  misc_feature: GYAE6OF01A3RKE.33.60.F05.1.454.CMB.1.raw
  modified_base (403)..(410): a, c, t, g, unknown or other
  misc_feature (403)..(410): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgaagtgtgtgtactgagcgggctggcaaggcgcatagnnnnnnnn

SEQ ID NO: 238188 - DNA, 425 bp, Homo sapiens
  misc_feature: GYAE6OF01BMLR4.33.60.F05.1.454.CMB.1.raw
  modified_base (239)..(239): a, c, t, g, unknown or other
  misc_feature (239)..(239): n is a, c, g, or t
  modified_base (337)..(337): a, c, t, g, unknown or other
  misc_feature (337)..(337): n is a, c, g, or t
  modified_base (412)..(425): a, c, t, g, unknown or other
  misc_feature (412)..(425): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagtattttgcagtgtattactgtcagcagtacggtagttcatcgtccgtacgttcggaccaagggaccaaggtaggaaatcgaaaacgactgngctgcacatctgtcttcatcctcccgctatctagaagtgtgtgtactgagcgggctggacaaggcacgtatacgnnnnnnnnnnnnnn

SEQ ID NO: 238189 - DNA, 411 bp, Homo sapiens
  misc_feature: GYAE6OF01A9MFJ.33.60.F05.1.454.CMB.1.raw
  modified_base (402)..(411): a, c, t, g, unknown or other
  misc_feature (402)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcacatctgtcttcatcttcccgcatctgaagtgtgtgtactgagcgggctgggcaagggcgcatagnnnnnnnnnn

SEQ ID NO: 238190 - DNA, 411 bp, Homo sapiens
  misc_feature: GYAE6OF01CN1TZ.33.60.F05.1.454.CMB.1.raw
  modified_base (407)..(411): a, c, t, g, unknown or other
  misc_feature (407)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctccatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtgctgcacatctgtcttcactcttcccgctatctgtaagtgtgtgtacgtgaggcgggctggcgtaaggcgcatagnnnnn

SEQ ID NO: 238191 - DNA, 412 bp, Homo sapiens
  misc_feature: GYAE6OF01BWXLE.33.60.F05.1.454.CMB.1.raw
  modified_base (344)..(344): a, c, t, g, unknown or other
  misc_feature (344)..(344): n is a, c, g, or t
  modified_base (403)..(412): a, c, t, g, unknown or other
  misc_feature (403)..(412): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcactctcaccatcagcagcctagagcctgaggattctgcagtttattactgtcagcagcgtctcaactggcctccgtgcaccttcggccaagggcacgattggagattagacgaactgtggctgcacctntgtcttcatcttcccgcatctgaagtgtgtgtactgagcgggctggcaaggcgcatagnnnnnnnnnn

SEQ ID NO: 238192 - DNA, 409 bp, Homo sapiens
  misc_feature: GYAE6OF01DGLAD.33.60.F05.1.454.CMB.1.raw
  modified_base (404)..(409): a, c, t, g, unknown or other
  misc_feature (404)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctccgacgttcggccaagggaccaaggtggaaaatcaaaacgaactgtggctgcaccatctgtcttcatcttcccgccatctgaagtgtgtgtactgagcgggctggcaaggcgcatagnnnnnn

SEQ ID NO: 238193 - DNA, 406 bp, Homo sapiens
  misc_feature: GYAE6OF01CVQSD.33.60.F05.1.454.CMB.1.raw
  modified_base (392)..(392): a, c, t, g, unknown or other
  misc_feature (392)..(392): n is a, c, g, or t
  modified_base (398)..(406): a, c, t, g, unknown or other
  misc_feature (398)..(406): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtgctgcaccatctgtctcatcttccgccatctgagtgtgtgtactgagcgggctggcaggcncatagnnnnnnnnn

SEQ ID NO: 238194 - DNA, 410 bp, Homo sapiens
  misc_feature: GYAE6OF01BK9RT.33.60.F05.1.454.CMB.1.raw
  modified_base (396)..(396): a, c, t, g, unknown or other
  misc_feature (396)..(396): n is a, c, g, or t
  modified_base (401)..(410): a, c, t, g, unknown or other
  misc_feature (401)..(410): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgaagtgtgtgtactgagcgggctggcaaggcnatagnnnnnnnnnn

SEQ ID NO: 238195 - DNA, 409 bp, Homo sapiens
  misc_feature: GYAE6OF01BJJ62.33.60.F05.1.454.CMB.1.raw
  modified_base (401)..(409): a, c, t, g, unknown or other
  misc_feature (401)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatctcccgccatctgaagtgtgtgtactgagcgggctggcaaggcgcatagnnnnnnnnn

SEQ ID NO: 238196 - DNA, 408 bp, Homo sapiens
  misc_feature: GYAE6OF01BB1VL.33.60.F05.1.454.CMB.1.raw
  modified_base (396)..(396): a, c, t, g, unknown or other
  misc_feature (396)..(396): n is a, c, g, or t
  modified_base (401)..(408): a, c, t, g, unknown or other
  misc_feature (401)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtttattactgtctgaagcgtagcaactggcctaacaccttcggccaagggcacgactggagattaaaacgaactgtaggctgcaccatctgtcttcatcttcccgcatctgaatgtgtgtactgagcgggctggcaaggcncatgnnnnnnnn

SEQ ID NO: 238197 - DNA, 404 bp, Homo sapiens
  misc_feature: GYAE6OF01DSX6J.33.60.F05.1.454.CMB.1.raw
  modified_base (400)..(404): a, c, t, g, unknown or other
  misc_feature (400)..(404): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgagattttgcagtgtattactgtcagcagtacggtagttcatctccgacgttcggccaagggaccaaggtggaaatcaaacgactgtggctgcaccatctgtcttcatcttcccgcatctgaagtgtgtgtactgagcgggctggcaaggcgcatagnnnnn

SEQ ID NO: 238198 - DNA, 412 bp, Homo sapiens
  misc_feature: GYAE6OF01EUCTI.33.60.F05.1.454.CMB.1.raw
  modified_base (288)..(288): a, c, t, g, unknown or other
  misc_feature (288)..(288): n is a, c, g, or t
  modified_base (344)..(344): a, c, t, g, unknown or other
  misc_feature (344)..(344): n is a, c, g, or t
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
  modified_base (403)..(412): a, c, t, g, unknown or other
  misc_feature (403)..(412): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatcnccgagttcggccaagggaccaaggtggaaatcaaacgaactgtggctgcaccatcngtcttcatcttcccgccatctgaagtgtgtntactgagcgggctggcaaggcncatagnnnnnnnnnn

SEQ ID NO: 238199 - DNA, 414 bp, Homo sapiens
  misc_feature: GYAE6OF01DG45S.33.60.F05.1.454.CMB.1.raw
  modified_base (403)..(414): a, c, t, g, unknown or other
  misc_feature (403)..(414): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctggggacagacttcactctcaccatcgacagactggagcctgaagattttgcagtctattactgtcagcagtatactgggggagacgttcggccaaggggaccaagggtggaaaatcaaaacgaactgtaggctgcaccatctgtcttcatcttccgcatctgaagtgtgtgtactgagcgggctgggcaaggcgcatagnnnnnnnnnnnn

SEQ ID NO: 238200 - DNA, 408 bp, Homo sapiens
  misc_feature: GYAE6OF01AD6OZ.33.60.F05.1.454.CMB.1.raw
  modified_base (398)..(408): a, c, t, g, unknown or other
  misc_feature (398)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcacatctgtcttcatcttcccgcatctgaagtgtgtgtactgagcggctggcaaggcgcatgnnnnnnnnnnn

SEQ ID NO: 238201 - DNA, 410 bp, Homo sapiens
  misc_feature: GYAE6OF01ARKRC.33.60.F05.1.454.CMB.1.raw
  modified_base (398)..(410): a, c, t, g, unknown or other
  misc_feature (398)..(410): n is a, c, g, or t
tcagtacacacactcacgaccggtgctcgatttagtacgtcatcagggaaagggccaccctctcttgtagggccagtcagagtgctggcagcaacttagcctggtaccaacaaaaacctggccagactcccaggctcctcatctatgatgcatccaccagggccactggcatcccagccaggttcagtggcagtgggtctgggacagacttcactctcaccatcagcagcctagagcctgaagattttgcagtttattactgtctgcagcgtagcaactggcctaacaccttcggccaagggacacgactggagattaaacgactgtggctgcaccatctgtcttaatcttcccgcatctgaagtgtgtgtactgagcgggctggcaaggcgcatagnnnnnnnnnnnnn

SEQ ID NO: 238202 - DNA, 406 bp, Homo sapiens
  misc_feature: GYAE6OF01AG3DH.33.60.F05.1.454.CMB.1.raw
  modified_base (399)..(406): a, c, t, g, unknown or other
  misc_feature (399)..(406): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgagttcggccaagggccaaggtggaaatcaaacgactgtggctgcacatctgtcttcatcttcccgcatctgaagtgtgtgtactgagcgggctggcaaggcgcatagnnnnnnnn

SEQ ID NO: 238203 - DNA, 460 bp, Homo sapiens
  misc_feature: GYAE6OF01DM1GP.33.60.F05.1.454.CMB.1.raw
  modified_base (402)..(402): a, c, t, g, unknown or other
  misc_feature (402)..(402): n is a, c, g, or t
  modified_base (429)..(460): a, c, t, g, unknown or other
  misc_feature (429)..(460): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacagggttcagtggcagtgggtctgggacagacttcattcgtcaccatcagcagactggagcctagaagattttgcagtgtattactgtcagcagtacggtagttcatctccgacggttcggccaagggaccaaggtcgaaatcaaacgaactgtggctgcacatctagtctctactcttcccgctatctacgtaagtcgtagtgtaacgtgaggccgggtnttacgggctaagggtcgactagtacgnnnnnnnnnnnnnnnnnnnnnnnnnnnnnnnn

SEQ ID NO: 238204 - DNA, 427 bp, Homo sapiens
  misc_feature: GYAE6OF01A6IQV.33.60.F05.1.454.CMB.1.raw
  modified_base (416)..(427): a, c, t, g, unknown or other
  misc_feature (416)..(427): n is a, c, g, or t
tcagtacacacactcacgaccggtgctcgatttagtacgtcatcagggaaggggctggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagttagcagtggctggtatcctttcttccagcactggggccagggtaccctggtcaccgtctcctcagcctccaccaagggcccatcggtcttcccctggcgccctgctccaggagcacctccgagagcacagcggccctgggctgcctggtcaaggctacttccagtgtgtgtactgagcgggctggcaaggcgcatagnnnnnnnnnnnn

SEQ ID NO: 238205 - DNA, 408 bp, Homo sapiens
  misc_feature: GYAE6OF01BRP43.33.60.F05.1.454.CMB.1.raw
  modified_base (403)..(408): a, c, t, g, unknown or other
  misc_feature (403)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgtttcggccaagggaccaaggtggaaatcaaacgaactgtggctgcaccatctgtcttcatcttcccgcatctgaagtgtgtgtactgagcgggctggcaaggcgcatagnnnnnn

SEQ ID NO: 238206 - DNA, 407 bp, Homo sapiens
  misc_feature: GYAE6OF01CWPLD.33.60.F05.1.454.CMB.1.raw
  modified_base (402)..(407): a, c, t, g, unknown or other
  misc_feature (402)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcttctatgatgcatccaacagggccactggcatcccagccaggttcagtggcggtgggtctgggacagacttcactctcaccatcagcagcctagagcctgaagattttgcagtttattactgtcagcagcgtagcaactggtcttggacgtttcggccaaggggccaaggtggaaatcaaacgaactgtggctgcaccatctgtcttcatctcccgcatctgaatgtgtgtactgagcgggctggctaaggcgcatagnnnnnn

SEQ ID NO: 238207 - DNA, 400 bp, Homo sapiens
  misc_feature: GYAE6OF01DEDDG.33.60.F05.1.454.CMB.1.raw
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (392)..(400): a, c, t, g, unknown or other
  misc_feature (392)..(400): n is a, c, g, or t
tcagtacacacactcacgaccggtgctcgatttagtacgtcatcaggggaaagggccgaccctctcttgtagggccagtcagagtgttagcagcaactacttagcctggtaccagcagacacctggccaggctccaggctcctcatccatggtgcatccaccagggccactggcatcccagacaggttcagtggcagtgggctgggacagacttcattcctcaccatcagcagactggagctgagattttgcagtgtattactgtcagcagtacgtagttcatctccgacgttcgccaaggccaaggtgaaatcaaacgactgagctgcacntcngtctcatctttccgctatctgaagtgtgtgtactgagcggctggcaaggcacatagnnnnnnnnn

SEQ ID NO: 238208 - DNA, 425 bp, Homo sapiens
  misc_feature: GYAE6OF01EGV67.33.60.F05.1.454.CMB.1.raw
  modified_base (240)..(240): a, c, t, g, unknown or other
  misc_feature (240)..(240): n is a, c, g, or t
  modified_base (329)..(329): a, c, t, g, unknown or other
  misc_feature (329)..(329): n is a, c, g, or t
  modified_base (398)..(425): a, c, t, g, unknown or other
  misc_feature (398)..(425): n is a, c, g, or t
tcagtacacacactcacgaccggtgctcgatttagtacgtcatcagggaaaggggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagttgtattactgtcagcagtacggtagttcatctccgacgttcggcaagggacaaggtgaaatcaaacgactgnggctgcacatctgtcttcatctccgcatctgaacgtgtgtcgtatgagcgggctggcaaggcgcatagnnnnnnnnnnnnnnnnnnnnnnnnnnnn

SEQ ID NO: 238209 - DNA, 409 bp, Homo sapiens
  misc_feature: GYAE6OF01D6ZJ4.33.60.F05.1.454.CMB.1.raw
  modified_base (399)..(409): a, c, t, g, unknown or other
  misc_feature (399)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcttctatgatgcatccaacagggccactggcatcccagccaggttcagtggcggtgggtctgggacagacttcactctcaccatcagcagcctagagcctgaagattttgcagtttattactgtctgcagcgtagcaactggcctaacaccttcggccaagggacacgactggagattaaacgactgtggctgcaccatctgtcttcatcttcccgcatctgagtgtgtgtactgagcgggctggcaggcgcatagnnnnnnnnnnn

SEQ ID NO: 238210 - DNA, 508 bp, Homo sapiens
  misc_feature: GYAE6OF01BCXTK.33.60.F05.1.454.CMB.1.raw
  modified_base (397)..(397): a, c, t, g, unknown or other
  misc_feature (397)..(397): n is a, c, g, or t
  modified_base (490)..(492): a, c, t, g, unknown or other
  misc_feature (490)..(492): n is a, c, g, or t
  modified_base (494)..(508): a, c, t, g, unknown or other
  misc_feature (494)..(508): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggcctcccaggcctcctcttctatgatgcatcccaaacgacgggccactggcactccccagccaggttcaggtggcgggtgggtctgggacagacttcactctcaccatcagcacgcctagacgcctgaggtattctgctagtttattactgtcagcagcgtctacaacgtcggccctccgtgcctacccgttccgggacccgaaaggggaccaacggtagttacgggagtaattaacggaacgtaacgtgggtggctcgccctaccctntcgttccttcacttcccttcccgcctatcgtgtaacgttgttgtcgttactggacggccgggtcgtcgggacgaacgggccgacgaagtacgnnngnnnnnnnnnnnnnnn

SEQ ID NO: 238211 - DNA, 479 bp, Homo sapiens
  misc_feature: GYAE6OF01CM3LI.33.60.F05.1.454.CMB.1.raw
  modified_base (241)..(241): a, c, t, g, unknown or other
  misc_feature (241)..(241): n is a, c, g, or t
  modified_base (449)..(449): a, c, t, g, unknown or other
  misc_feature (449)..(449): n is a, c, g, or t
  modified_base (452)..(479): a, c, t, g, unknown or other
  misc_feature (452)..(479): n is a, c, g, or t
tcagtacacacactcacgaccggtgctcgatttagtacgtcatcagggaaagggccgaccctctcttgtagggccagtcagagtgttagcagcaactacttagcctggtaccagcagacacctggccaggctcccaggctcctcatccatggtgcatccaccagggccactggcatcccagacaggttcaggtggcagtgggtctgggacagacttcattctcaccatcagcagactggancctgaagaacttttgcagtgtattactgtcagcagtacggtagttcatctccgacgttcggcctaagggaccaaggttggaaatcgaaaacgaacctaggtggacgtgacacgatctggtcttcgacttcttcccgtcctactctagtacgtgtgttagtacgtgtacggtcgggacgttgggaccgtaagggccgtacaacgttagnagnnnnnnnnnnnnnnnnnnnnnnnnnnnn

SEQ ID NO: 238212 - DNA, 403 bp, Homo sapiens
  misc_feature: GYAE6OF01CL6JJ.33.60.F05.1.454.CMB.1.raw
  modified_base (239)..(239): a, c, t, g, unknown or other
  misc_feature (239)..(239): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (398)..(403): a, c, t, g, unknown or other
  misc_feature (398)..(403): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcgccaaggccaaggtgaaatcaaacgaactgtggctgcaccgatctgtctcatcttcccgcatctgaagtgtgtgtactgagcgggntggcaaggcncatagnnnnnn

SEQ ID NO: 238213 - DNA, 408 bp, Homo sapiens
  misc_feature: GYAE6OF01D35A3.33.60.F05.1.454.CMB.1.raw
  modified_base (395)..(395): a, c, t, g, unknown or other
  misc_feature (395)..(395): n is a, c, g, or t
  modified_base (401)..(408): a, c, t, g, unknown or other
  misc_feature (401)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatctatgatgcatccaccagggccactggcatcccagccaggttcagtggcagtgggtctgggacagacttcactctcaccatcagcagcctagagcctgaagattttgcagtttattactgtctgcagcgtagcaactggcctaacaccttcggccaagggacacgactggagattaaacgactgtggctgcaccatctgtcttcatcttcccgcatctgaagtgtgtgtactgagcgggctggcaaggcncatagnnnnnnnn

SEQ ID NO: 238214 - DNA, 417 bp, Homo sapiens
  misc_feature: GYAE6OF01C0VQR.33.60.F05.1.454.CMB.1.raw
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (403)..(417): a, c, t, g, unknown or other
  misc_feature (403)..(417): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctccaggctcctcatccatggtgcatccaccagggccactggcatcccagacaggttcagtggcagtgggtctgggacagacttcattcncaccatcagcagactggancctgaagattttgcagtgtattactgtcagcagtacggtagttcatctccgacgtttcggccaagggaccaaggtggaaatcaaacgaactgtggctgcaccgatctgtcttcatcttccgccatctgaatgtgtgtactggagcgggctggcaaggcgcatagnnnnnnnnnnnnnnn

SEQ ID NO: 238215 - DNA, 406 bp, Homo sapiens
  misc_feature: GYAE6OF01B6SPL.33.60.F05.1.454.CMB.1.raw
  modified_base (395)..(395): a, c, t, g, unknown or other
  misc_feature (395)..(395): n is a, c, g, or t
  modified_base (400)..(406): a, c, t, g, unknown or other
  misc_feature (400)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttcccgcatctgaagtgtgtgtactgagcgggctggcaaggcnatagnnnnnnn

SEQ ID NO: 238216 - DNA, 451 bp, Homo sapiens
  misc_feature: GYAE6OF01C4TO8.33.60.F05.1.454.CMB.1.raw
  modified_base (414)..(414): a, c, t, g, unknown or other
  misc_feature (414)..(414): n is a, c, g, or t
  modified_base (416)..(417): a, c, t, g, unknown or other
  misc_feature (416)..(417): n is a, c, g, or t
  modified_base (420)..(429): a, c, t, g, unknown or other
  misc_feature (420)..(429): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (435)..(451): a, c, t, g, unknown or other
  misc_feature (435)..(451): n is a, c, g, or t
tcagtacacacactcacgaccggtgctcgatttagtacgtcatcagggaaaggggaccgaccctctcttgtagggccagtcagagtgttagcagcaactacttagccctggtaccagccagacacctggccaggctcccaggctcctcatccatggtgcatccaccagggccactggcatcccagacaggttcagtggcagtggatctgggacagacttcattctcaccatcagcagactggagcctgaagattttgcagtgtatactgtcagcagtacggtagttcatctccgacgttcggccgaacggaccaaggtaggaatcaaacgactgtagctgcaccatctgtctcatcttccgcatctgaagtgtgtagtactggagcgggctgggacgaagggcgaccatagacntnnagnnnnnnnnnngngngnnnnnnnnnnnnnnnnn

SEQ ID NO: 238217 - DNA, 405 bp, Homo sapiens
  misc_feature: GYAE6OF01EI6DR.33.60.F05.1.454.CMB.1.raw
  modified_base (291)..(291): a, c, t, g, unknown or other
  misc_feature (291)..(291): n is a, c, g, or t
  modified_base (391)..(391): a, c, t, g, unknown or other
  misc_feature (391)..(391): n is a, c, g, or t
  modified_base (397)..(405): a, c, t, g, unknown or other
  misc_feature (397)..(405): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccagactcccaggctcctcatctatgatgcatccaccagggccactggcatcccagccaggttcagtggcagtgggtctgggacagacttcactctcaccatcagcagcctagagcctgaagattttgcagtttattactgtctgcagcgtagcaactggcctaacnccttcggccaagggacacgactggagattaaacgactgtgctgcacatctgtcttcatctcccgcatctgagtgtgtgtactgagcgggctggcaaggcncatagnnnnnnnnn

SEQ ID NO: 238218 - DNA, 408 bp, Homo sapiens
  misc_feature: GYAE6OF01EKIXR.33.60.F05.1.454.CMB.1.raw
  modified_base (401)..(408): a, c, t, g, unknown or other
  misc_feature (401)..(408): n is a, c, g, or t
tcagtacacacactcacgaccggtgctcgatttagtacgtcatcagggaaagggctaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcactctcaccatcagcaacctagaacttgaagatttttcattttattactgtcaacatcacggcagctggcctctcactttcggcggagggaccaaggtggagctcaaacgactgtggctgcaccatctgtcttcatcttcccgcatctgagtgtgtgtactgagcgggctggcaaggcgcagtagnnnnnnnn

SEQ ID NO: 238219 - DNA, 411 bp, Homo sapiens
  misc_feature: GYAE6OF01CEKPT.33.60.F05.1.454.CMB.1.raw
  modified_base (404)..(411): a, c, t, g, unknown or other
  misc_feature (404)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcgaaacgaactgtggctgcaccatctgtcttcatcttcccgcatctgaagtgtgtgtactgagcgggctggcaagggcgcatagnnnnnnnn

SEQ ID NO: 238220 - DNA, 407 bp, Homo sapiens
  misc_feature: GYAE6OF01BA0OZ.33.60.F05.1.454.CMB.1.raw
  modified_base (239)..(239): a, c, t, g, unknown or other
  misc_feature (239)..(239): n is a, c, g, or t
  modified_base (398)..(407): a, c, t, g, unknown or other
  misc_feature (398)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggaccaaggtgaaatcaaacgactgtggctgcacatctgtcttcatctcccgcatctgaagtgtgtgtactgagcgggctggcaaggcgcatagnnnnnnnnnn

SEQ ID NO: 238221 - DNA, 410 bp, Homo sapiens
  misc_feature: GYAE6OF01B7VML.33.60.F05.1.454.CMB.1.raw
  modified_base (402)..(410): a, c, t, g, unknown or other
  misc_feature (402)..(410): n is a, c, g, or t
tcagtacacacactcacgaccggtgctcgatttagtacgtcatcagggaaagggtcaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacgatctgtcttcatcttcccgcatctgaagtgtgtgtactgagcgggctggcaaggcgcatagnnnnnnnnn

SEQ ID NO: 238222 - DNA, 432 bp, Homo sapiens
  misc_feature: GYAE6OF01CWOP9.33.60.F05.1.454.CMB.1.raw
  modified_base (423)..(432): a, c, t, g, unknown or other
  misc_feature (423)..(432): n is a, c, g, or t
tcagtacacacactcacgaccggtgctcgatttagtacgtcatcagggaaggggcgtggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagtttagcagtggctggtatcctttctccagcactggggccagggtaccctggtcaccgtctcctcagcctccaccaagggcccatccggtcttccccctggccgccctgctccaggacgcacctccgagagcacagcggccctgggctgcctggtcaaggactacttcagtcgtgtgtactggagcgggctggcaaggcgcatagnnnnnnnnnn

SEQ ID NO: 238223 - DNA, 409 bp, Homo sapiens
  misc_feature: GYAE6OF01CM0XQ.33.60.F05.1.454.CMB.1.raw
  modified_base (402)..(409): a, c, t, g, unknown or other
  misc_feature (402)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgaagtgtgtgtactgagcgggctggcaaggcgcatagnnnnnnnn

SEQ ID NO: 238224 - DNA, 592 bp, Homo sapiens
  misc_feature: GYAE6OF01E5JOW.33.60.F05.1.454.CMB.1.raw
  modified_base (515)..(515): a, c, t, g, unknown or other
  misc_feature (515)..(515): n is a, c, g, or t
  modified_base (547)..(547): a, c, t, g, unknown or other
  misc_feature (547)..(547): n is a, c, g, or t
  modified_base (553)..(553): a, c, t, g, unknown or other
  misc_feature (553)..(553): n is a, c, g, or t
  modified_base (564)..(564): a, c, t, g, unknown or other
  misc_feature (564)..(564): n is a, c, g, or t
tcagtacacacactcacgaccggtgctcgatttagtacgtcatcagggaaaggggccgaaccctctcttgtagggtccgacgtcaggaacgtgttaggacaccgcaactacttagccttggtacctacgccagaccaccctggccgacggcctcccgaggcctcccgtcaattccattggtgccaattcccaaccgacgggccctacgtcggtcactccccaggacaggtcgacgtcggctacgtgggtctggggaccagtacttcattctcgaccatctaagcctaggacctggaagccgtcgaagactttggcctacgtaggtacttacctgtacagtctaggtacggtagttctactaacgtccgaacgttcggaccaagggacccaaagggtcggaaagttcaaacggtacgtgtaggtcgtcgcgaaccagtctgtcttcactcctccgccatctacgaagtgtcgttgtacgtgtacgcggtctggtactaacggcgtacgaagtacgngcgtcagtgctctattcgccgtaggcagtcgngagtcnacgacgagtgngctcgacacactctctctctctcgtccc

SEQ ID NO: 238225 - DNA, 404 bp, Homo sapiens
  misc_feature: GYAE6OF01CFD4Z.33.60.F05.1.454.CMB.1.raw
  modified_base (397)..(404): a, c, t, g, unknown or other
  misc_feature (397)..(404): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctcgacgttcggccaagggaccaaggtggaaatcaaacgaactgtgctgcacatctgtctcatcttcccgcatctgagtgtgtgtactgagcggctggcaaggcgacatagnnnnnnnn

SEQ ID NO: 238226 - DNA, 403 bp, Homo sapiens
  misc_feature: GYAE6OF01CUIG6.33.60.F05.1.454.CMB.1.raw
  modified_base (396)..(403): a, c, t, g, unknown or other
  misc_feature (396)..(403): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccagactcccaggctcctcatctatgatgcatccaccagggccactggcatcccagccaggttcagtggcagtgggtctgggacagacttcactctcaccatcagcagcctagagcctgaagattttgctagtttattactgtctgcagcgtagcaactggcctaacaccttcggcaagggacacgactggagattaaacgactgtgctgcacatctgtctcatctccgcatctgaagtgtgtgtactgagcgggctggcaaggcgcatagnnnnnnnn

SEQ ID NO: 238227 - DNA, 429 bp, Homo sapiens
  misc_feature: GYAE6OF01B5IR0.33.60.F05.1.454.CMB.1.raw
  modified_base (341)..(341): a, c, t, g, unknown or other
  misc_feature (341)..(341): n is a, c, g, or t
  modified_base (409)..(409): a, c, t, g, unknown or other
  misc_feature (409)..(409): n is a, c, g, or t
  modified_base (415)..(429): a, c, t, g, unknown or other
  misc_feature (415)..(429): n is a, c, g, or t
tcagtacacacactcacgaccggtgctcgatttagtacgtcatcagggaaaggggcgtggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagttagcagtggctggtatcctttcttccagcactggggccagggtaccctggtcaccgtctcctcagcctccaccaagggcccatcggtcttcccctggcgcctgctcagagcacctccgagngcacagcggccctgggctgcctggtcaaggactactccagtgtgtgtactgagcgggctggcaaggcncatagnnnnnnnnnnnnnnn

SEQ ID NO: 238228 - DNA, 414 bp, Homo sapiens
  misc_feature: GYAE6OF01ARJSO.33.60.F05.1.454.CMB.1.raw
  modified_base (402)..(402): a, c, t, g, unknown or other
  misc_feature (402)..(402): n is a, c, g, or t
  modified_base (407)..(414): a, c, t, g, unknown or other
  misc_feature (407)..(414): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggctgggacagacttcattctcaccatcagcagactggagcctgaagattttgcagtgtattactgtcagcagtacggtagttcatctccgacgtttcggccaagggacccaagggtggaaaatcaaacgaactgtggctgcaccatctgtcttcatcttcccgccatctgaagttgtgtgtactgagcgggctggcaagggcncatgnnnnnnnn

SEQ ID NO: 238229 - DNA, 407 bp, Homo sapiens
  misc_feature: GYAE6OF01BFEAR.33.60.F05.1.454.CMB.1.raw
  modified_base (401)..(407): a, c, t, g, unknown or other
  misc_feature (401)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatctcccgcatctgaagtgtgtgtactgagcgggctggcaaggcgcatagnnnnnnn

SEQ ID NO: 238230 - DNA, 406 bp, Homo sapiens
  misc_feature: GYAE6OF01DT53J.33.60.F05.1.454.CMB.1.raw
  modified_base (394)..(394): a, c, t, g, unknown or other
  misc_feature (394)..(394): n is a, c, g, or t
  modified_base (400)..(406): a, c, t, g, unknown or other
  misc_feature (400)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcttctatgatgcatccaacagggccactggcatcccagccaggttcagtggcggtgggtctgggacagacttcactctcaccatcagcagcctagagcctgaagattttgcagtttattactgtcagcagcgtagcaactggtcttggacgttcggccaagggaccaaggtggaaatcaaacgaactgtgctgcacatctgtcttcatcttcccgcatctgaagtgtgtgtactgagcgggctggcaaggcncatagnnnnnnn

SEQ ID NO: 238231 - DNA, 457 bp, Homo sapiens
  misc_feature: GYAE6OF01C0SI3.33.60.F05.1.454.CMB.1.raw
  modified_base (423)..(424): a, c, t, g, unknown or other
  misc_feature (423)..(424): n is a, c, g, or t
  modified_base (426)..(457): a, c, t, g, unknown or other
  misc_feature (426)..(457): n is a, c, g, or t
tcagtacacacactcacgaccggtgctcgatttagtacgtcatcagggaaagggccacccgtcttcttgtagggccagtcagagtgttagcacgcaactacttagcctggtaccagcagacaccctggccaggctcccaggctcctcatccatgggtgcatccaccagggccactggcatcccagacaggttcagtgtcagtgggtctgggacagactcattctacaccatccagcagtactggagcctgaagattttgcagtgtattactgtcagcagtacggtgtcatctccgattcgccaagggaccaaggtggaaatcgaaacgactgtggactgcacgatctcgtctctatcctcccgctatctagtaagttgtgtagtacgtgacggcgggactggacgaagggcgacaagtaacgnngnnnnnnnnnnnnnnnnnnnnnnnnnnnnnnnn

SEQ ID NO: 238232 - DNA, 489 bp, Homo sapiens
  misc_feature: GYAE6OF01C557G.33.60.F05.1.454.CMB.1.raw
  modified_base (239)..(239): a, c, t, g, unknown or other
  misc_feature (239)..(239): n is a, c, g, or t
  modified_base (455)..(455): a, c, t, g, unknown or other
  misc_feature (455)..(455): n is a, c, g, or t
  modified_base (459)..(489): a, c, t, g, unknown or other
  misc_feature (459)..(489): n is a, c, g, or t
tcagtacacacactcacgaccggtgctcgatttagtacgtcatcagggaaaggggccaccctctcttgtagggccagtcagagtgttagcagcaactacttagcctggtaccagcagacacctggccaggctccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcaatctccgacgtttccggcctaagggaccaagggtcggaaataccgaaaacgtaacctgtggctggcaccatctacgttcttactacttcctttccccgcctactacgtgtaagttgtgtgttaacctggaacggtcgggtcttcgggacaaacgggtcgtactaagtacgnagtnnnnnnnnnnnnnnnnnnnnnnnnnnnnnnn

SEQ ID NO: 238233 - DNA, 408 bp, Homo sapiens
  misc_feature: GYAE6OF01DB9IL.33.60.F05.1.454.CMB.1.raw
  modified_base (394)..(394): a, c, t, g, unknown or other
  misc_feature (394)..(394): n is a, c, g, or t
  modified_base (399)..(408): a, c, t, g, unknown or other
  misc_feature (399)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattctgcagtgtattactgtcagcagtacggtattcatctccgacgttcggaccaagggaccaaggtggaaatcgaaacgactgtggctgcaccatctgtcttcatctcccgcatctgaagtgtgtgtactgagcgggctggcaggcncatgnnnnnnnnnn

SEQ ID NO: 238234 - DNA, 419 bp, Homo sapiens
  misc_feature: GYAE6OF01ADXFT.33.60.F05.1.454.CMB.1.raw
  modified_base (405)..(419): a, c, t, g, unknown or other
  misc_feature (405)..(419): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagcgtagcaactggtcttggacgtttcggccaagggaccaaggtggaaatcaaacgactgtggctgcaccatctgtcttcatcttcccgccatctgaagtgtgtgtactgagcgggctgggcaagggcgcatagnnnnnnnnnnnnnnn

SEQ ID NO: 238235 - DNA, 410 bp, Homo sapiens
  misc_feature: GYAE6OF01BF7P4.33.60.F05.1.454.CMB.1.raw
  modified_base (403)..(410): a, c, t, g, unknown or other
  misc_feature (403)..(410): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcactcttcccgccatctgaagtgtgtgtactgagcgggctggcaaggcgcatagnnnnnnnn

SEQ ID NO: 238236 - DNA, 417 bp, Homo sapiens
  misc_feature: GYAE6OF01CKQON.33.60.F05.1.454.CMB.1.raw
  modified_base (384)..(384): a, c, t, g, unknown or other
  misc_feature (384)..(384): n is a, c, g, or t
  modified_base (403)..(417): a, c, t, g, unknown or other
  misc_feature (403)..(417): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcgcaaggaccaaggtggaaatcaaacgaactgtggctgacacatctgtcttcacttctcccgcatctagagtgtgtgtacgtgagcggntggacgaaggcacagtagnnnnnnnnnnnnnnn

SEQ ID NO: 238237 - DNA, 408 bp, Homo sapiens
  misc_feature: GYAE6OF01EI11M.33.60.F05.1.454.CMB.1.raw
  modified_base (240)..(240): a, c, t, g, unknown or other
  misc_feature (240)..(240): n is a, c, g, or t
  modified_base (385)..(385): a, c, t, g, unknown or other
  misc_feature (385)..(385): n is a, c, g, or t
  modified_base (402)..(408): a, c, t, g, unknown or other
  misc_feature (402)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggancctgaagattttgcagtgtattactgtcagcagtacggtagttcatctccgacgttcggccaagggaccaaggtggaaatcaaacgactgtggctgcaccatctgtcttcatctcccgcatctgaagtgtgtgtactgagcgggntgggcaaggcgcatagnnnnnnn

SEQ ID NO: 238238 - DNA, 404 bp, Homo sapiens
  misc_feature: GYAE6OF01A9JBJ.33.60.F05.1.454.CMB.1.raw
  modified_base (399)..(404): a, c, t, g, unknown or other
  misc_feature (399)..(404): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtgaaatcaaacgactgtggctgcacatctgtcttcatcttcccgcatctgaagtgtgtgtactgagcgggctggcaaggcgcatagnnnnnn

SEQ ID NO: 238239 - DNA, 411 bp, Homo sapiens
  misc_feature: GYAE6OF01BO5ZO.33.60.F05.1.454.CMB.1.raw
  modified_base (386)..(386): a, c, t, g, unknown or other
  misc_feature (386)..(386): n is a, c, g, or t
  modified_base (402)..(411): a, c, t, g, unknown or other
  misc_feature (402)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgaagtgtgtgtactgagcgggntggcaaggcgcatagnnnnnnnnnn

SEQ ID NO: 238240 - DNA, 410 bp, Homo sapiens
  misc_feature: GYAE6OF01CD9E4.33.60.F05.1.454.CMB.1.raw
  modified_base (403)..(410): a, c, t, g, unknown or other
  misc_feature (403)..(410): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaaatcaaacgaactgtggctgcaccatctgtcttcatcttcccgcatctgaagtgtgtgtactgagcgggctggcaaggcgcatagnnnnnnnn

SEQ ID NO: 238241 - DNA, 406 bp, Homo sapiens
  misc_feature: GYAE6OF01E3SGU.33.60.F05.1.454.CMB.1.raw
  modified_base (399)..(406): a, c, t, g, unknown or other
  misc_feature (399)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatctccgcatctgaagtgtgtgtactgagcgggctggcaaggcgcatagnnnnnnnn

SEQ ID NO: 238242 - DNA, 407 bp, Homo sapiens
  misc_feature: GYAE6OF01A6CTP.33.60.F05.1.454.CMB.1.raw
  modified_base (348)..(348): a, c, t, g, unknown or other
  misc_feature (348)..(348): n is a, c, g, or t
  modified_base (384)..(384): a, c, t, g, unknown or other
  misc_feature (384)..(384): n is a, c, g, or t
  modified_base (394)..(394): a, c, t, g, unknown or other
  misc_feature (394)..(394): n is a, c, g, or t
  modified_base (399)..(407): a, c, t, g, unknown or other
  misc_feature (399)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcgaaacgactgtgctgcacatctgtcttnactcttccgctatctagagtgtgtgtactgagcggntggcaaggcnatagnnnnnnnnn

SEQ ID NO: 238243 - DNA, 415 bp, Homo sapiens
  misc_feature: GYAE6OF01DGGIO.33.60.F05.1.454.CMB.1.raw
  modified_base (399)..(399): a, c, t, g, unknown or other
  misc_feature (399)..(399): n is a, c, g, or t
  modified_base (405)..(415): a, c, t, g, unknown or other
  misc_feature (405)..(415): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaaacgaactgtggctgcaccatctgtcttcatcttcccgcatctgaagtgtgtgtactgaggcgggctgggcaaggcncatagnnnnnnnnnnn

SEQ ID NO: 238244 - DNA, 541 bp, Homo sapiens
  misc_feature: GYAE6OF01E5ES2.33.60.F05.1.454.CMB.1.raw
  modified_base (121)..(121): a, c, t, g, unknown or other
  misc_feature (121)..(121): n is a, c, g, or t
  modified_base (247)..(247): a, c, t, g, unknown or other
  misc_feature (247)..(247): n is a, c, g, or t
  modified_base (348)..(348): a, c, t, g, unknown or other
  misc_feature (348)..(348): n is a, c, g, or t
  modified_base (508)..(541): a, c, t, g, unknown or other
  misc_feature (508)..(541): n is a, c, g, or t
tcagtacacacactcacgaccggtgctcgatttagtacgtcatcagggaaggggctggagtgggtcgcaactattagtggcggtggaactcatacatactacgccgactccgtgaaggccncttcaccatctccagagacaattccaacaacacggttgtttctgcaaaatgaatagcctgagagtcgaggacatggacctatatattacgtgtgcgagagttagcagtggctggtacttcctttcnccagcacgtcggggccagggtaccctggtccaccgtctcctcacgcctccacgaacggcccagtccgtcctccccgtgccgccctgcctaccgaggtaccncctacccgtcgagacgccgaacgcggcccggcccgtggggcctacggccgttaggtacctaaacggtacccttaccgttccgtaaggttcggttacggtacggtaacccgtagggacggtccggggtacctaacgggaccgaacgggtccgaactagtgnnnnnnnnnnnnnnnnnnnnnnnnnnnnnnnnnn

SEQ ID NO: 238245 - DNA, 409 bp, Homo sapiens
  misc_feature: GYAE6OF01A7XRF.33.60.F05.1.454.CMB.1.raw
  modified_base (239)..(239): a, c, t, g, unknown or other
  misc_feature (239)..(239): n is a, c, g, or t
  modified_base (399)..(409): a, c, t, g, unknown or other
  misc_feature (399)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcattctccgacgttcggccaagggccaaggtgaaatcaaacgaactgtggctgcacatctgtctcatcttccgcatctgatgtgtgtactgacgcggctggctaaggcgacatacgnnnnnnnnnnn

SEQ ID NO: 238246 - DNA, 411 bp, Homo sapiens
  misc_feature: GYAE6OF01BUV98.33.60.F05.1.454.CMB.1.raw
  modified_base (405)..(411): a, c, t, g, unknown or other
  misc_feature (405)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagccaggttcagtggcagtgggtctgggacagacttcactctcaccatcagcagcctagagcctgaagattttgcagtttattactgtctgcagcgtagcaactggcctaacaccttcggccaagggacacgactggagattaaacgaactgtggctgcaccatctgtcttcatccttcccgcctatctgaagtgtgtgtactgagcgggctggcaggcgcagtagnnnnnnn

SEQ ID NO: 238247 - DNA, 410 bp, Homo sapiens
  misc_feature: GYAE6OF01EAE9H.33.60.F05.1.454.CMB.1.raw
  modified_base (239)..(239): a, c, t, g, unknown or other
  misc_feature (239)..(239): n is a, c, g, or t
  modified_base (402)..(410): a, c, t, g, unknown or other
  misc_feature (402)..(410): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggaccaaggtggaaatcaaaacgactgtggctgcaccatctgtcttcatcttcccgcatctgatgtgtgtactgacgcgggctgggcaaggcgcatagnnnnnnnnn

SEQ ID NO: 238248 - DNA, 424 bp, Homo sapiens
  misc_feature: GYAE6OF01B1CJC.33.60.F05.1.454.CMB.1.raw
  modified_base (410)..(410): a, c, t, g, unknown or other
  misc_feature (410)..(410): n is a, c, g, or t
  modified_base (416)..(424): a, c, t, g, unknown or other
  misc_feature (416)..(424): n is a, c, g, or t
tcagtacacacactcacgaccggtgctcgatttagtacgtcatcagggaaggggctggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagttagcagtggctggtatcctttctccagcactggggccagggtaccctggtcaccgtctcctcagcctccaccaagggcccatcggtcttcccctggccgccctgctccaggagcacctccgagagcacagcgccctgggctgcctggtcaaggactacttccagtgtgtgtactgagcgggctggcaaggcncatagnnnnnnnnn

SEQ ID NO: 238249 - DNA, 425 bp, Homo sapiens
  misc_feature: GYAE6OF01CHUPD.33.60.F05.1.454.CMB.1.raw
  modified_base (406)..(407): a, c, t, g, unknown or other
  misc_feature (406)..(407): n is a, c, g, or t
  modified_base (409)..(425): a, c, t, g, unknown or other
  misc_feature (409)..(425): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctcgacgttcggccaagggaccaaggtgaaattcaaacgaactgtggctgcaccatctgtcttcatcttcccgctatctgaagtgtgtgtacgtgagcgggctgggctaaggcgacagtagnngnnnnnnnnnnnnnnnnn

SEQ ID NO: 238250 - DNA, 400 bp, Homo sapiens
  misc_feature: GYAE6OF01D8INQ.33.60.F05.1.454.CMB.1.raw
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
  modified_base (393)..(400): a, c, t, g, unknown or other
  misc_feature (393)..(400): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagtcatctccgacgttcggccaagggaccaaggtgaaatcaaacgaactgtgctgcacatctgtctnatctccncatctgagtgtgtgtactgagcggntggcaaggcagtatagnnnnnnnn

SEQ ID NO: 238251 - DNA, 418 bp, Homo sapiens
  misc_feature: GYAE6OF01BC5A2.33.60.F05.1.454.CMB.1.raw
  modified_base (409)..(418): a, c, t, g, unknown or other
  misc_feature (409)..(418): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaagataggaaatcaaacgaactgtggctgcaccatctgtcttcatcttcccgccatctgaagtgtgtgtactgaggcgggtctgggcaagggcgcagtagnnnnnnnnnn

SEQ ID NO: 238252 - DNA, 406 bp, Homo sapiens
  misc_feature: GYAE6OF01BZ6CT.33.60.F05.1.454.CMB.1.raw
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (398)..(406): a, c, t, g, unknown or other
  misc_feature (398)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcaacttacttctgtcaacacagttacaatctccgtacacttttggccaggggaccaagctggagatcaggcgaactgtggctgcacatctgtcttcatcttcccgcatctgaaggtgtgtactgagcggntggcaaggcntatagnnnnnnnnn

SEQ ID NO: 238253 - DNA, 415 bp, Homo sapiens
  misc_feature: GYAE6OF01B2O8K.33.60.F05.1.454.CMB.1.raw
  modified_base (402)..(415): a, c, t, g, unknown or other
  misc_feature (402)..(415): n is a, c, g, or t
tcagtacacacactcacgaccggtgctcgatttagtacgtcatcagggaaagggccaccctctcttgtagggccagtcagagtgttagcagcaactacttagcctggtaccagcagcacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaaacgaactgtggctgcaccatctgtcttcatctcccgcatctgaagtgtgtgtactgagcgggctggcaaggcgacatagnnnnnnnnnnnnnn

SEQ ID NO: 238254 - DNA, 404 bp, Homo sapiens
  misc_feature: GYAE6OF01D4YPW.33.60.F05.1.454.CMB.1.raw
  modified_base (239)..(239): a, c, t, g, unknown or other
  misc_feature (239)..(239): n is a, c, g, or t
  modified_base (284)..(284): a, c, t, g, unknown or other
  misc_feature (284)..(284): n is a, c, g, or t
  modified_base (391)..(391): a, c, t, g, unknown or other
  misc_feature (391)..(391): n is a, c, g, or t
  modified_base (397)..(404): a, c, t, g, unknown or other
  misc_feature (397)..(404): n is a, c, g, or t
tcagtacacacactcacgaccggtgctcgatttagtacgtcatcagggaaagggccaccctctcttgtagggccagtcagagtgttagcagcaactacttagcctggtaccagcagaaacctggccaggctcccaggctcctcctctatggtgcatccaccagggccactggcatcccagacaggttcagtggcagtgggtctgggacagacttcactctcaccatcgacagactggancctgaagattttgcagtctattactgtcagcagtatactgggganacgttcggcaaggggaccaaggtggaaatcaaacgaactgtgctgcaccatctgtcttcatcttcccgctatctgaagtgtgtgtactgagcgggctggcaagggcncatagnnnnnnnn

SEQ ID NO: 238255 - DNA, 407 bp, Homo sapiens
  misc_feature: GYAE6OF01D9OQR.33.60.F05.1.454.CMB.1.raw
  modified_base (402)..(407): a, c, t, g, unknown or other
  misc_feature (402)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaaacgaactgtggctgcaccatctgtcttcatctcccgcatctgaagtgtgtgtactgagcgggctggcaaggcgcatagnnnnnn

SEQ ID NO: 238256 - DNA, 408 bp, Homo sapiens
  misc_feature: GYAE6OF01A9MIL.33.60.F05.1.454.CMB.1.raw
  modified_base (401)..(408): a, c, t, g, unknown or other
  misc_feature (401)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctccgacgttcggccaagggaccaaggtggaaatcaaacgaactgtggctgcaccatctgtcttcatcttcccgcatctgaagtgtgtgtactgagcgggctggcaaggcgcatagnnnnnnnn

SEQ ID NO: 238257 - DNA, 407 bp, Homo sapiens
  misc_feature: GYAE6OF01BE0EG.33.60.F05.1.454.CMB.1.raw
  modified_base (288)..(288): a, c, t, g, unknown or other
  misc_feature (288)..(288): n is a, c, g, or t
  modified_base (398)..(407): a, c, t, g, unknown or other
  misc_feature (398)..(407): n is a, c, g, or t
tcagtacacacactcacgaccggtgctcgatttagtacgtcatcagggaaagagccaccctctcctgcagggccagtcagagtgctggcagcaacttagcctggtaccaacaaaaacctggccagactcccaggctcctcatctatgatgcatccaccagggccactggcatcccagccaggttcagtggcagtgggtctgggacagacttcactctcaccatcagcagcctagagcctgaagattttgcagtttattactgtctgcagcgtagcaactggcctaacnccttcggccaagggacacgactggagattaaacgaactgtggctgcaccatctgtctcactcttccgcatctgagtgtgtgtactgagcgggctggcgaaggcgcatagnnnnnnnnnn

SEQ ID NO: 238258 - DNA, 413 bp, Homo sapiens
  misc_feature: GYAE6OF01ELJGJ.33.60.F05.1.454.CMB.1.raw
  modified_base (292)..(292): a, c, t, g, unknown or other
  misc_feature (292)..(292): n is a, c, g, or t
  modified_base (349)..(349): a, c, t, g, unknown or other
  misc_feature (349)..(349): n is a, c, g, or t
  modified_base (404)..(413): a, c, t, g, unknown or other
  misc_feature (404)..(413): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagcctagagcctgaagattttgctagtttattactgtctgcagcgtagcaactggcctaacnccttcggaccaagggacacgactggagtaataaacgactgtgctgcacatctgtctnactcttccgcatctgaagtgtgtgtactgacggcggctggcaaggcgacagtagnnnnnnnnnn

SEQ ID NO: 238259 - DNA, 429 bp, Homo sapiens
  misc_feature: GYAE6OF01CJHVD.33.60.F05.1.454.CMB.1.raw
  modified_base (167)..(167): a, c, t, g, unknown or other
  misc_feature (167)..(167): n is a, c, g, or t
  modified_base (425)..(429): a, c, t, g, unknown or other
  misc_feature (425)..(429): n is a, c, g, or t
tcagtacacacactcacgaccggtgctcgatttagtacgtcatcagggaaggggcgtggagtgggtcgcaactattagtgggcggtggaactcatacatactaccgccgactccgtgaagggccgcttcaccatctccagagacaattccaacaacacggtgtttcngcaaaatgaatagcctgagagtcgagacagtgccatatatactgtgcgagagttagcagtggctggtatccttttctccagcacgtggggccagggtaccctggtcaccgtctcctcagcctccaccaaagggccccaatcggtcttccccctggccgccctgctccaggagcacctccgagagcacagcggccctgggctgcctggtcaaaggctacttccagtgtgtgtactgagcgggctggcaaggcgcatagnnnnn

SEQ ID NO: 238260 - DNA, 409 bp, Homo sapiens
  misc_feature: GYAE6OF01DA977.33.60.F05.1.454.CMB.1.raw
  modified_base (395)..(395): a, c, t, g, unknown or other
  misc_feature (395)..(395): n is a, c, g, or t
  modified_base (401)..(409): a, c, t, g, unknown or other
  misc_feature (401)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgagattttgcagtgtattactgtcagcagtacggtagttcatctccgacgttcggccaagggaccaaggtggaaatcaaacgaactgtggctgcaccatctgtcttcatcttcccgctatctgagtgtgtgtactgagcggctggcaaggcgnagtagnnnnnnnnn

SEQ ID NO: 238261 - DNA, 446 bp, Homo sapiens
  misc_feature: GYAE6OF01BDME8.33.60.F05.1.454.CMB.1.raw
  modified_base (423)..(423): a, c, t, g, unknown or other
  misc_feature (423)..(423): n is a, c, g, or t
  modified_base (425)..(446): a, c, t, g, unknown or other
  misc_feature (425)..(446): n is a, c, g, or t
tcagtacacacactcacgaccggtgctcgatttagtacgtcatcagggaaagggccaccctctcctgcagggccaatcagagtgttagcagtaacttagtctggtaccaacatagacctgaccaggctcccaggctcctcatctacgatgcgtccaacagggccactggcatcccagacaggttcagtggcagtgggtctgggacagacttcattctcaccatcagcagactggagcctgaagtattttgcagtgtatactgtcagcagtacgtagtcatctcgacgttcgccaaggaccaaggtgaaatcaaacgaactgtgactgcaccatctagtcttcgacttcttcccgcctaatccgtagtaagttcgtgtacgtactggacgcgggcgttgggaccaaagggccgtacgatacggngnnnnnnnnnnnnnnnnnnnnnn

SEQ ID NO: 238262 - DNA, 402 bp, Homo sapiens
  misc_feature: GYAE6OF01DDKVF.33.60.F05.1.454.CMB.1.raw
  modified_base (380)..(380): a, c, t, g, unknown or other
  misc_feature (380)..(380): n is a, c, g, or t
  modified_base (395)..(402): a, c, t, g, unknown or other
  misc_feature (395)..(402): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgagattttgcagtgtattactgtcagcagtacgtagttcatctccgacgttcgccaagggccaaggtggaaatcaaacgactgtgctgcacatctgtcttcactcttcccgcatctgaagtgtgtgtactgagcgggntggcaggcgcatagnnnnnnnn

SEQ ID NO: 238263 - DNA, 410 bp, Homo sapiens
  misc_feature: GYAE6OF01D2EHS.33.60.F05.1.454.CMB.1.raw
  modified_base (395)..(395): a, c, t, g, unknown or other
  misc_feature (395)..(395): n is a, c, g, or t
  modified_base (401)..(410): a, c, t, g, unknown or other
  misc_feature (401)..(410): n is a, c, g, or t
tcagtacacacactcacgaccggtgctcgatttagtacgtcatcagggaaagggccaccctctcttgtagggccagtcagagtgttagcagcaacttagcctggtaccaacaaaaacctggccagactcccaggctcctcatctatgatgcatccaccagggccactggcatcccagccaggttcagtggcagtgggtctgggacagacttcactctcaccatcagcagcctagagcctgaagtattttgctagtttattactgtctgcagcgtagcaactggcctaacaccttcggccaagggaccacgactggagtacttaaacgactgtggctgcacatctgtctcatcctccgcatctagagtcgtgtgtactgagcggctggcaaggcgnagtagnnnnnnnnnn

SEQ ID NO: 238264 - DNA, 417 bp, Homo sapiens
  misc_feature: GYAE6OF01D0H1N.33.60.F05.1.454.CMB.1.raw
  modified_base (248)..(248): a, c, t, g, unknown or other
  misc_feature (248)..(248): n is a, c, g, or t
  modified_base (410)..(417): a, c, t, g, unknown or other
  misc_feature (410)..(417): n is a, c, g, or t
tcagtacacacactcacgaccggtgctcgatttagtacgtcatcagggaaagggccaccctctcttgtagggccagtcagagtgttagcagcaactacttagcctggtaccaacatagacctgaccaggctcccaggctcctcatctacgatgcgtccaacagggccactggcatcccagccaggttcagtggcagtgggtctgggacagacttcactctcaccatcagcaacctagaacttgaagtntttttcattttatactgtcaacatcacggcagctggccttctcacttttcgggcggagggacccaaggtggagctacaaaacgaactgtggctgcaccatctgtcttcatcttcccgcatctgaagtgtgtgtactgagcgggctgggcaaggcgacatagnnnnnnnn

SEQ ID NO: 238265 - DNA, 415 bp, Homo sapiens
  misc_feature: GYAE6OF01A63NI.33.60.F05.1.454.CMB.1.raw
  modified_base (404)..(415): a, c, t, g, unknown or other
  misc_feature (404)..(415): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaaacgaactgtggctgcaccatctgtcttcatcttcccgccatctgaagtgtgtgtactgagcgggctggcaaggcgcatagnnnnnnnnnnnn

SEQ ID NO: 238266 - DNA, 487 bp, Homo sapiens
  misc_feature: GYAE6OF01AZE4S.33.60.F05.1.454.CMB.1.raw
  modified_base (451)..(451): a, c, t, g, unknown or other
  misc_feature (451)..(451): n is a, c, g, or t
  modified_base (455)..(458): a, c, t, g, unknown or other
  misc_feature (455)..(458): n is a, c, g, or t
  modified_base (460)..(466): a, c, t, g, unknown or other
  misc_feature (460)..(466): n is a, c, g, or t
  modified_base (468)..(472): a, c, t, g, unknown or other
  misc_feature (468)..(472): n is a, c, g, or t
  modified_base (474)..(487): a, c, t, g, unknown or other
  misc_feature (474)..(487): n is a, c, g, or t
tcagtacacacactcacgaccggtgctcgatttagtacgtcatcagggaaagggccaccctctcgttgtagggccagtcagagtgttagcagcaactacttagcctggtaccagcagacaccctggccaggctcccaggctcctcatccatggtgcatccaccagggccactggcatcccagacaggttcagtggcagtgggtctgggacagacttcattctcaccgatcagcagactggagcctgaagattttgctagtgtattactgtcagcagtacggtagttcattctccgacgttcgccgtaaggaccgaaggtggaaatcaaacgactgtgctgcactatctgtcttgactcttccccgctacttctacgtaagtcgtacgttagtaccgtgaacgggtccgggtaccgtacggaccgtaaagggccgtaccgtaagtacggatntgtnnnnannnnnnntnnnnngnnnnnnnnnnnnnn

SEQ ID NO: 238267 - DNA, 418 bp, Homo sapiens
  misc_feature: GYAE6OF01EG4X5.33.60.F05.1.454.CMB.1.raw
  modified_base (332)..(332): a, c, t, g, unknown or other
  misc_feature (332)..(332): n is a, c, g, or t
  modified_base (406)..(418): a, c, t, g, unknown or other
  misc_feature (406)..(418): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgctagtgtattactgtcagcagtacggtagttcatctccgacgttcggaccaagggaccaaggtagaaatcaaacgactgngctgcacatctgtcttcatcctcccgcatctagagtgtgtgtactgacgtcgggcgtggcgaaggcgacatagnnnnnnnnnnnnn

SEQ ID NO: 238268 - DNA, 438 bp, Homo sapiens
  misc_feature: GYAE6OF01AZC5O.33.60.F05.1.454.CMB.1.raw
  modified_base (240)..(240): a, c, t, g, unknown or other
  misc_feature (240)..(240): n is a, c, g, or t
  modified_base (292)..(292): a, c, t, g, unknown or other
  misc_feature (292)..(292): n is a, c, g, or t
  modified_base (407)..(407): a, c, t, g, unknown or other
  misc_feature (407)..(407): n is a, c, g, or t
  modified_base (411)..(438): a, c, t, g, unknown or other
  misc_feature (411)..(438): n is a, c, g, or t
tcagtacacacactcacgaccggtgctcgatttagtacgtcatcagggaaaggggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtttattactgtctgcagcgtagcaactggcctaacnccttcggaccaagggccacgactggataattaaacgactgtggctgcacatctgtcttcactccttcccgcctatcctagagtgtgtgtacgtgaggcgggctgggcaaggcganatgnnnnnnnnnnnnnnnnnnnnnnnnnnnn

SEQ ID NO: 238269 - DNA, 403 bp, Homo sapiens
  misc_feature: GYAE6OF01C2UK3.33.60.F05.1.454.CMB.1.raw
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (394)..(403): a, c, t, g, unknown or other
  misc_feature (394)..(403): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtagaaatcaaacgactgtggctgcacatctgtctnatctccgcatcngatgtctatgagcgggntggcaaggcgacagtagnnnnnnnnnn

SEQ ID NO: 238270 - DNA, 410 bp, Homo sapiens
  misc_feature: GYAE6OF01ATWLJ.33.60.F05.1.454.CMB.1.raw
  modified_base (398)..(410): a, c, t, g, unknown or other
  misc_feature (398)..(410): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccagactcctcatccatggtgcatccaccagggccactggcatcccagacaggttcagtggcagtgggtctgggacagacttcattctcaccatcagcagactggagcctgaagattttgcagtgtattactgtcagcagtacggtagttcatctacgacgttcggccaagggaccaaggtggaaatcaaacgactgtgctgcacatctgtcttcatctcccgcatctgaagtgtgtgtactgaggcggctggacaggcgcatagnnnnnnnnnnnnn

SEQ ID NO: 238271 - DNA, 431 bp, Homo sapiens
  misc_feature: GYAE6OF01AT67R.33.60.F05.1.454.CMB.1.raw
  modified_base (423)..(431): a, c, t, g, unknown or other
  misc_feature (423)..(431): n is a, c, g, or t
tcagtacacacactcacgaccggtgctcgatttagtacgtcatcagggaaaggggctggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagttagcagtggctggtatcctttctccagcacgtggggccagggtaccctggtcaccgtctcctcagcctccaccaagggcccatcggtcttccccctggccgccctgcctccaggacgcaccctccgagacgcacagcggccctgggctgcctggtcaggactacttccagtgtgtgtactgagcgggctggcaaggcgcatagnnnnnnnnn

SEQ ID NO: 238272 - DNA, 451 bp, Homo sapiens
  misc_feature: GYAE6OF01EVF2X.33.60.F05.1.454.CMB.1.raw
  modified_base (422)..(451): a, c, t, g, unknown or other
  misc_feature (422)..(451): n is a, c, g, or t
tcagtacacacactcacgaccggtgctcgatttagtacgtcatcagggaaagggccaccctctcttgtagggccagtcagagtgttaagcagcaactacttagcctggtaccagcagacacctggccagggctcccaggctcctcatccatggtgcatccaccagggcccactggcatcccagacaggttcagtgggcaggtgggtctgggacagacgttcattctcaccatcagcagactggagcctgagtattttgcagtgtattactggtcagcaggtacggtagtttcatccgtccgacgttcgggcaagggaccaagggtggaaaatcaaaacgactgtggctgcacatctcgtctcatcctcccgcctatctgaagtgtcgtagtactgaggcggctggacaaggcgctagtagcnnnnnnnnnnnnnnnnnnnnnnnnnnnnnn

SEQ ID NO: 238273 - DNA, 563 bp, Homo sapiens
  misc_feature: GYAE6OF01C02CU.33.60.F05.1.454.CMB.1.raw
  modified_base (243)..(243): a, c, t, g, unknown or other
  misc_feature (243)..(243): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (528)..(528): a, c, t, g, unknown or other
  misc_feature (528)..(528): n is a, c, g, or t
  modified_base (532)..(532): a, c, t, g, unknown or other
  misc_feature (532)..(532): n is a, c, g, or t
  modified_base (535)..(537): a, c, t, g, unknown or other
  misc_feature (535)..(537): n is a, c, g, or t
  modified_base (539)..(539): a, c, t, g, unknown or other
  misc_feature (539)..(539): n is a, c, g, or t
  modified_base (541)..(543): a, c, t, g, unknown or other
  misc_feature (541)..(543): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (549)..(550): a, c, t, g, unknown or other
  misc_feature (549)..(550): n is a, c, g, or t
  modified_base (552)..(563): a, c, t, g, unknown or other
  misc_feature (552)..(563): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggcctcccaggctcctcatccatggtgcatccaccagggccactggcatcccagacaggttcagtggcaggtgggtctgggacagacttcattctcaccatcagcagacgtggacnccgtagaagtatttttggctaaggttgttaatttacgtgtcagcagttacggtagttcaattccgtccgtacgtttccggaccgaaagggaccctaagggtagaaaactcgaaaaccgtactggtggctgaccgaccattcctgtccttctaacttcccgttccccgctacttctaggtaacgtgttcggtacgttaccgttgggaacggtccggggtacgttacgggaccggtaaaggggtccccgggtaacctaaaggttacggagtcgagtacgagngngcngagntgnnngngnnngngngnngnnnnnnnnnnnn

SEQ ID NO: 238274 - DNA, 613 bp, Homo sapiens
  misc_feature: GYAE6OF01DKDJC.33.60.F05.1.454.CMB.1.raw
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
tcagtacacacactcacgaccggtgctcgatttagtacgtcatcagggaaaggggccaccctctcttgtagggccagtcagagtgttagcagcaactacttacgcctggtaccagcaggacacctggccaggctccgaggctcctcatccatggtgcatccaccagggccactggcactcccagaccaggttcagtggcaggtgggtctgggacagacttcattctcaccatcgagcagcctagacgcctagaagtattttgctagtttatactgtctagcacgtcgtacncactcggtacctaacnccgttcggaccaacggacacgtacgtagggaacgtaacgttaaacgacgttggtacggacgttcggacctaccgtagttccgtagtaccgttacgtaactttcccttaccccgtacctaacgttcctaggtaacgttcggttagttaccgtacgttggacggtccgggtacgtacgggtaacgtaacggtcgtacctaagttacggctagtactacgacgtctacgtacgtacgtacgtacgtacgacgacgacgacgacgacgtagacgtacgtagacgcgcgcgacgtcgactatctcgtcgtc

SEQ ID NO: 238275 - DNA, 405 bp, Homo sapiens
  misc_feature: GYAE6OF01EH5G7.33.60.F05.1.454.CMB.1.raw
  modified_base (392)..(392): a, c, t, g, unknown or other
  misc_feature (392)..(392): n is a, c, g, or t
  modified_base (398)..(405): a, c, t, g, unknown or other
  misc_feature (398)..(405): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagtcatctccgacgttcggccaagggaccaaggtggaaatcaaacgaactgtggctgcaccatctgtctcatcttccgcatctgagtgtgtgtactgagcggctggcaaggcgnagtagnnnnnnnn

SEQ ID NO: 238276 - DNA, 408 bp, Homo sapiens
  misc_feature: GYAE6OF01A4175.33.60.F05.1.454.CMB.1.raw
  modified_base (393)..(393): a, c, t, g, unknown or other
  misc_feature (393)..(393): n is a, c, g, or t
  modified_base (398)..(408): a, c, t, g, unknown or other
  misc_feature (398)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccagggaccaaggtgaaatcaaacgatgtggctgcacatctgtcttcatcttcccgctactctgagtgtgtgtactgacgcgggctggcaggcgnatagnnnnnnnnnnn

SEQ ID NO: 238277 - DNA, 420 bp, Homo sapiens
  misc_feature: GYAE6OF01BY83D.33.60.F05.1.454.CMB.1.raw
  modified_base (402)..(402): a, c, t, g, unknown or other
  misc_feature (402)..(402): n is a, c, g, or t
  modified_base (409)..(420): a, c, t, g, unknown or other
  misc_feature (409)..(420): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaaacgaactgtggctgcaccatctgtcttcacttccttcccgctactctgaagttgtgtgtactgagcgggctggcaggcncagtagnnnnnnnnnnnn

SEQ ID NO: 238278 - DNA, 415 bp, Homo sapiens
  misc_feature: GYAE6OF01D3D3F.33.60.F05.1.454.CMB.1.raw
  modified_base (406)..(415): a, c, t, g, unknown or other
  misc_feature (406)..(415): n is a, c, g, or t
tcagtacacacactcacgaccggtgctcgatttagtacgtcatcagggaaagggccaccctctcttgtagggccagtcagagtgttagcagcaactacttagcctggtaccagcagagacctggccaggctcccaggctcctcttctatgatgcatccaacagggccactggcatcccagccaggttcagtgggcggtgggtctgggacagacttcactctcaccatcagcagcctagagcctgaagattttgctagtttattactgtcagcagcgtagcaactggtcttggacgttcggccaagggaccaaggtggaaatcaaacgaactgtggctgcacatctgtcttcactcttcccgcctatctgaagtgtgtgtactgagcgggctggcaaggcgcatagnnnnnnnnnn

SEQ ID NO: 238279 - DNA, 437 bp, Homo sapiens
  misc_feature: GYAE6OF01A5J7J.33.60.F05.1.454.CMB.1.raw
  modified_base (239)..(239): a, c, t, g, unknown or other
  misc_feature (239)..(239): n is a, c, g, or t
  modified_base (410)..(411): a, c, t, g, unknown or other
  misc_feature (410)..(411): n is a, c, g, or t
  modified_base (413)..(437): a, c, t, g, unknown or other
  misc_feature (413)..(437): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacgtagttcatctccgacgttcggccaagggaccaaggtgaaatcaaacgaactgtagctgcacatctgtcttcattcctcccgctatctgtaagtgtgtcgtatgacgcgggctgggactaaggcgtacgagtagnntnnnnnnnnnnnnnnnnnnnnnnnnn

SEQ ID NO: 238280 - DNA, 402 bp, Homo sapiens
  misc_feature: GYAE6OF01CQEC9.33.60.F05.1.454.CMB.1.raw
  modified_base (392)..(392): a, c, t, g, unknown or other
  misc_feature (392)..(392): n is a, c, g, or t
  modified_base (395)..(402): a, c, t, g, unknown or other
  misc_feature (395)..(402): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagtcatctcgacgttcggccgaagggaccaaggtgaaatcaaacgaactgtggctgcacatctgtctcatcttccgcatctgaagtgtgtgtactgagcggctggcaaggcgcanagnnnnnnnn

SEQ ID NO: 238281 - DNA, 539 bp, Homo sapiens
  misc_feature: GYAE6OF01BOX9S.33.60.F05.1.454.CMB.1.raw
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
  modified_base (511)..(512): a, c, t, g, unknown or other
  misc_feature (511)..(512): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (522)..(524): a, c, t, g, unknown or other
  misc_feature (522)..(524): n is a, c, g, or t
  modified_base (526)..(539): a, c, t, g, unknown or other
  misc_feature (526)..(539): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccagaatgcattcaacagggccactggcatcccagccaggttcagtggcagtgggtctgggacagacttcactctcaccatcagcagcctagagcctgaggattctgctagtttatactgtcagcagcgtctcaactggcctccgtgcctaccgttcggacctaaagggaccacgtagtttcgggagtattaacggaacgtaaactggtacggactcggacctacccttgttcgtacctttcgactttcctttccccggcctaattccgttaggaacgtttgtacgttgtaaccgtggaacggccggggtacttcggggaccaaagggtcccgacctaaagttaccggcncgacgtcncgagtcgnncngngngngnnngnnnnnnnnnnnnnn

SEQ ID NO: 238282 - DNA, 431 bp, Homo sapiens
  misc_feature: GYAE6OF01B7JYR.33.60.F05.1.454.CMB.1.raw
  modified_base (423)..(431): a, c, t, g, unknown or other
  misc_feature (423)..(431): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagatttttgcagttgtattactgtcagcagtacggtagttcatctccgacgttcgccgaagggaccaagggtggaaatacaaaacgactggtggactgcaccatctgtcttcactcttcccgctatctagtagtgtgttgtactggtacggcgggcgtgggactagggcgtacagtagnnnnnnnnn

SEQ ID NO: 238283 - DNA, 418 bp, Homo sapiens
  misc_feature: GYAE6OF01EWPFG.33.60.F05.1.454.CMB.1.raw
  modified_base (408)..(418): a, c, t, g, unknown or other
  misc_feature (408)..(418): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgtttcggccaagggaccaaggtggaaatcaaaacgaactgtggctgcaccatctgtcttcatccttcccgccatctgaagttgtgtgtactgagcgggctggcaaggcgcatagnnnnnnnnnnn

SEQ ID NO: 238284 - DNA, 411 bp, Homo sapiens
  misc_feature: GYAE6OF01CI0O8.33.60.F05.1.454.CMB.1.raw
  modified_base (239)..(239): a, c, t, g, unknown or other
  misc_feature (239)..(239): n is a, c, g, or t
  modified_base (404)..(411): a, c, t, g, unknown or other
  misc_feature (404)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggaccaagggaccaaggtggaaatcaaacgaactgtggctgcacatctgtctcatcttcccgcatctagagtgtgtgtactgaggcggcgtggcaaggcgacagtagnnnnnnnn

SEQ ID NO: 238285 - DNA, 410 bp, Homo sapiens
  misc_feature: GYAE6OF01DGXBX.33.60.F05.1.454.CMB.1.raw
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
  modified_base (401)..(410): a, c, t, g, unknown or other
  misc_feature (401)..(410): n is a, c, g, or t
tcagtacacacactcacgaccggtgctcgatttagtacgtcatcagggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagcgtagcaactggtcttggacgttcggcaagggaccaaggtggaaatcaaacgaactgtggactgcacatctgtcttcatctccgctatctgaatgtntgtactgagngggctggcaaggcncagtgnnnnnnnnnn

SEQ ID NO: 238286 - DNA, 410 bp, Homo sapiens
  misc_feature: GYAE6OF01A2L1T.33.60.F05.1.454.CMB.1.raw
  modified_base (399)..(410): a, c, t, g, unknown or other
  misc_feature (399)..(410): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcacatctgtcttcatctcccgcatctgagtgtgtgtactgagcggtctggcgaaggcgcatagnnnnnnnnnnnn

SEQ ID NO: 238287 - DNA, 503 bp, Homo sapiens
  misc_feature: GYAE6OF01BQW2H.33.60.F05.1.454.CMB.1.raw
  modified_base (442)..(442): a, c, t, g, unknown or other
  misc_feature (442)..(442): n is a, c, g, or t
  modified_base (465)..(470): a, c, t, g, unknown or other
  misc_feature (465)..(470): n is a, c, g, or t
  modified_base (472)..(503): a, c, t, g, unknown or other
  misc_feature (472)..(503): n is a, c, g, or t
tcagtacacacactcacgaccggtgctcgattttagtacgtcatcagggaaaggggtccgaccctctcttagtagggccagtccagagtagttagccaggcaactacttagcctggccaggtgtctgctggtacccagggcttcctctatccagtggtgcatccaccagggccactggcagtcccagacaggttcagtggcgagtgggtctggggacaggaccttcgattcgtcaccgatccagccaagcctagagcctgaacgtattttggctagttttattactgtactaggcagcgtagctaacgtggtcgttggtacgttcggccgaaggggaccgaagggtggaaactcgaaaacgtacgtgtacggctagaccacatctagtcttcagtcctcccgactattacgaagttgtacgtagtaactggagtaccgggtnttacggacagggcactagtacgnnnnnngnnnnnnnnnnnnnnnnnnnnnnnnnnnnnnnn

SEQ ID NO: 238288 - DNA, 622 bp, Homo sapiens
  misc_feature: GYAE6OF01CF568.33.60.F05.1.454.CMB.1.raw
  modified_base (586)..(586): a, c, t, g, unknown or other
  misc_feature (586)..(586): n is a, c, g, or t
  modified_base (588)..(590): a, c, t, g, unknown or other
  misc_feature (588)..(590): n is a, c, g, or t
  modified_base (592)..(593): a, c, t, g, unknown or other
  misc_feature (592)..(593): n is a, c, g, or t
  modified_base (595)..(622): a, c, t, g, unknown or other
  misc_feature (595)..(622): n is a, c, g, or t
tcagtacacacactcacgaccggtgctcgatttagtacgtcatcagggaaagggccaccctctcttgtagggccagtcagagtgttagcagcaactacttagcctggtaccagcagacactggcaggcctccgaggctcctcactccagtggtgcactcccaccgacgggcctacgtggcactccccagacgtaggttcaggtggcaggtgggtcgtgggacagtacttctattctccaactatcagcaagacgtggacgtccgtagaagttattttcgactaggttgttaacttacgtgtacagacgtaaggttacggttagttcacttccgtacccggtacggttccggaccgaacggaaccgtaagggtaaggaaactaccgaaaacgtaaccgttggtcgggtctacgacctaaccgtacgtttccgttacgtttcctttactaaccgtttccccgtttacccccggaccttaacgttacccgtaaggtaacgggtttcgggttacgttacggttaacgtcgggtaacggggtcccggggtcgtacggggaaccggtaaacgggcccgtaataaggttagcngnnngnngnnnnnnnnnnnnnnnnnnnnnnnnnnnn

SEQ ID NO: 238289 - DNA, 412 bp, Homo sapiens
  misc_feature: GYAE6OF01A4VP0.33.60.F05.1.454.CMB.1.raw
  modified_base (384)..(384): a, c, t, g, unknown or other
  misc_feature (384)..(384): n is a, c, g, or t
  modified_base (401)..(412): a, c, t, g, unknown or other
  misc_feature (401)..(412): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgtacgttcggccaagggaccaaggtggaaatcaaacgatgtggctgcacatctgtcttcatcctcccgccatctgagtgtgtgtactgaggcggntggcgaggcgcgatagnnnnnnnnnnnn

SEQ ID NO: 238290 - DNA, 436 bp, Homo sapiens
  misc_feature: GYAE6OF01BNNHN.33.60.F05.1.454.CMB.1.raw
  modified_base (240)..(240): a, c, t, g, unknown or other
  misc_feature (240)..(240): n is a, c, g, or t
  modified_base (421)..(436): a, c, t, g, unknown or other
  misc_feature (421)..(436): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccacagggccactggcatcccagacaggttcagtggcagtgggtctggggacagacttcatttctcaccatcagcagactggancctgaagattttgcagtgtattactgtcagcagtacggtagttcatctccgacgttcggaccgaagggaccaaggtaggaaatcgaaacgtaactggtggctgcacatctgtcttcactcctccgcctatctagtaagttgtgtgtactggacggtcggcgtggcaacgggcgacagtagnnnnnnnnnnnnnnnn

SEQ ID NO: 238291 - DNA, 409 bp, Homo sapiens
  misc_feature: GYAE6OF01D56EG.33.60.F05.1.454.CMB.1.raw
  modified_base (390)..(390): a, c, t, g, unknown or other
  misc_feature (390)..(390): n is a, c, g, or t
  modified_base (396)..(409): a, c, t, g, unknown or other
  misc_feature (396)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgagttcggcaagggaccaagtggaaatcaaacgactgtggctgcacatctgtctcatctcccgcatctgaagtgtgtgtactgagcgggctgggcaaggcncatagnnnnnnnnnnnnnn

SEQ ID NO: 238292 - DNA, 429 bp, Homo sapiens
  misc_feature: GYAE6OF01B93SU.33.60.F05.1.454.CMB.1.raw
  modified_base (353)..(353): a, c, t, g, unknown or other
  misc_feature (353)..(353): n is a, c, g, or t
  modified_base (418)..(429): a, c, t, g, unknown or other
  misc_feature (418)..(429): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctccaggctcctcatccatggtgcatccaccagggccactggcatcccagacaggttcagtggcaggtgggtctgggacagacttcattctcaccatcagcagactggagcctgaagattttgctagtgtattactgtcagcagtacggtagttcatctccgacgttcggaccaagggaccaagggtagaatacgaaacgactgtggctgacacatctgtcttnactcttcccgcatctagagtcgtgtgtactggacggcgggtactgggactaagggcgcgataggnnnnnnnnnnnn

SEQ ID NO: 238293 - DNA, 409 bp, Homo sapiens
  misc_feature: GYAE6OF01A23V5.33.60.F05.1.454.CMB.1.raw
  modified_base (338)..(338): a, c, t, g, unknown or other
  misc_feature (338)..(338): n is a, c, g, or t
  modified_base (392)..(392): a, c, t, g, unknown or other
  misc_feature (392)..(392): n is a, c, g, or t
  modified_base (398)..(409): a, c, t, g, unknown or other
  misc_feature (398)..(409): n is a, c, g, or t
tcagtacacacactcacgaccggtgctcgatttagtacgtcatcaggggaaagggccaccctctcttgtagggccagtcagagtgttagcagcaactacttagcctggccaggtgtctgctggtaccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggaccaagggaccaaggtggaaaatcaaaacgaactgtgctgcacatcngtctcatctccgcatctgaagttgtgtcgtactgaggcgggctgggcaaggcgnagtagnnnnnnnnnnnn

SEQ ID NO: 238294 - DNA, 425 bp, Homo sapiens
  misc_feature: GYAE6OF01BY7WQ.33.60.F05.1.454.CMB.1.raw
  modified_base (240)..(240): a, c, t, g, unknown or other
  misc_feature (240)..(240): n is a, c, g, or t
  modified_base (413)..(425): a, c, t, g, unknown or other
  misc_feature (413)..(425): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctggggacagacttcattctcaccatcagcagactggancctgaagattttgctagtgtattactgtcagcagtacggtagttcatctccgacgtttcggcctaagggaccaagggtaggaaatcaaaagactgtggctgcacatctgtcttcattcctccgctatctagacgttgtgtgtactgacgcgggctgggcaaggcgacagtagnnnnnnnnnnnnn

SEQ ID NO: 238295 - DNA, 601 bp, Homo sapiens
  misc_feature: GYAE6OF01B1I35.33.60.F05.1.454.CMB.1.raw
  modified_base (238)..(238): a, c, t, g, unknown or other
  misc_feature (238)..(238): n is a, c, g, or t
  modified_base (337)..(337): a, c, t, g, unknown or other
  misc_feature (337)..(337): n is a, c, g, or t
  modified_base (492)..(492): a, c, t, g, unknown or other
  misc_feature (492)..(492): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtggtctgggacagacttcattctcaccatcagcagactggancctgaacgtattttgacagtgtatactgtacagcagtacggtagtcatctcgacgttcggaccaagggaccaaggtgaaactcaaaacgactgtacggntcgacactagtctgttcttacgaacttcgttacccggctaacgttcctaggtaacgttcgttggtacgttaacgtagtaaccgggccgggtacgttaacgggactaaacgggtccggtaaccgtaagttaacgggcaagggttcacggttaaccncggtacgtagtacggtacgtacgacgtatacgtacgtacgtagacgtacgtagtagtaggtagtacggtacgtacgtacgtacgtacgtacggacgtacgcgtacgacg

SEQ ID NO: 238296 - DNA, 544 bp, Homo sapiens
  misc_feature: GYAE6OF01C1Z9S.33.60.F05.1.454.CMB.1.raw
  modified_base (249)..(249): a, c, t, g, unknown or other
  misc_feature (249)..(249): n is a, c, g, or t
  modified_base (520)..(521): a, c, t, g, unknown or other
  misc_feature (520)..(521): n is a, c, g, or t
  modified_base (523)..(544): a, c, t, g, unknown or other
  misc_feature (523)..(544): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccagactcccaggctcctcatctatgatgcatccaccagggccactggcatcccagccaggttcagtggcagtgggtctgggacagacttcactctcaccatcagcagcctagagcctagaagtnttttgctagttttatactgtctgcagcgtagccaactcggacctaacacccgtttcgggaccgaaaggggaccaacggtaccgtagggaagtaacgttaaaacgaacgttggtacgggccttaggacctaacccgtaagttcctcggtttacttcccgtaacgtttccctttacccccgacctaacgtttctacggttaagttggtttacgtttacggtactgggaacgggtccggggtactcggggaccaaggggtcctagtaagttcgnngnnnnnnnnnnnnnnnnnnnnnn

SEQ ID NO: 238297 - DNA, 409 bp, Homo sapiens
  misc_feature: GYAE6OF01BNLGR.33.60.F05.1.454.CMB.1.raw
  modified_base (399)..(409): a, c, t, g, unknown or other
  misc_feature (399)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcacatctgtcttcatctcccgcatctgaagtgtgtgtactgagcgggctggcaaggcgcatagnnnnnnnnnnn

SEQ ID NO: 238298 - DNA, 422 bp, Homo sapiens
  misc_feature: GYAE6OF01BGRM7.33.60.F05.1.454.CMB.1.raw
  modified_base (389)..(389): a, c, t, g, unknown or other
  misc_feature (389)..(389): n is a, c, g, or t
  modified_base (407)..(407): a, c, t, g, unknown or other
  misc_feature (407)..(407): n is a, c, g, or t
  modified_base (409)..(422): a, c, t, g, unknown or other
  misc_feature (409)..(422): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgtttcggccaagggaccaaggtggaaatcaaacgaactgtggctgcacatctgtcttcatccttcccgctatctgaagtgtgtgtactggagcgggntggcgaaggcgctatcgntnnnnnnnnnnnnnn

SEQ ID NO: 238299 - DNA, 436 bp, Homo sapiens
  misc_feature: GYAE6OF01EGL1F.33.60.F05.1.454.CMB.1.raw
  modified_base (339)..(339): a, c, t, g, unknown or other
  misc_feature (339)..(339): n is a, c, g, or t
  modified_base (365)..(365): a, c, t, g, unknown or other
  misc_feature (365)..(365): n is a, c, g, or t
  modified_base (368)..(368): a, c, t, g, unknown or other
  misc_feature (368)..(368): n is a, c, g, or t
  modified_base (413)..(413): a, c, t, g, unknown or other
  misc_feature (413)..(413): n is a, c, g, or t
  modified_base (419)..(420): a, c, t, g, unknown or other
  misc_feature (419)..(420): n is a, c, g, or t
  modified_base (422)..(436): a, c, t, g, unknown or other
  misc_feature (422)..(436): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctagaagtattttgctagtgttattactgtcagtcgagtacgtgttcatctccgacgttcggacgaggaccaaggtagaaatacaaacgacgtgcgtcncgacactatctgtctctactcctccnctntcgtagtagtgtgttgtactggacgcgggcgtcggacgacggcgnagtagnngnnnnnnnnnnnnnnn

SEQ ID NO: 238300 - DNA, 420 bp, Homo sapiens
  misc_feature: GYAE6OF01EPUUN.33.60.F05.1.454.CMB.1.raw
  modified_base (407)..(420): a, c, t, g, unknown or other
  misc_feature (407)..(420): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtttattactgtctgcagcgtagcaactggcctaacaccttcggccaagggacacgactggagattaaacgactgtggctgcacatctgtctcatcttcccgcatctgaagtgtgtgtactggacgcgggctggaccgaagggcgcagtagnnnnnnnnnnnnnn

SEQ ID NO: 238301 - DNA, 579 bp, Homo sapiens
  misc_feature: GYAE6OF01DUDR1.33.60.F05.1.454.CMB.1.raw
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (554)..(555): a, c, t, g, unknown or other
  misc_feature (554)..(555): n is a, c, g, or t
  modified_base (558)..(564): a, c, t, g, unknown or other
  misc_feature (558)..(564): n is a, c, g, or t
  modified_base (566)..(579): a, c, t, g, unknown or other
  misc_feature (566)..(579): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtcgtgggacagacttcattctcacatcagcagactggagcctgaagtattttgcagtgtattactgtcagcaggtacggtatcatctcgtacggttccggaccgaagggaccgaagggtaacggaaatacaaaacggtacgtggtcggactcggaccaaccgtacttaccgtgtacccgtttacctactttacccgttccccggacccttacgttccgttagggtaaacggtttggttaggtttcgggttaaccgttacgggtacggggtacccgggggtccggttaacgggccgggtaaaacggggcccgggttaaccgtaaagtacgggtacngcgngcgcgangngngtgnngannnnnnngnnnnnnnnnnnnnn

SEQ ID NO: 238302 - DNA, 414 bp, Homo sapiens
  misc_feature: GYAE6OF01DHDBX.33.60.F05.1.454.CMB.1.raw
  modified_base (239)..(239): a, c, t, g, unknown or other
  misc_feature (239)..(239): n is a, c, g, or t
  modified_base (371)..(371): a, c, t, g, unknown or other
  misc_feature (371)..(371): n is a, c, g, or t
  modified_base (404)..(414): a, c, t, g, unknown or other
  misc_feature (404)..(414): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctcgacgttcggccaagggccaaggtggaaaatcaaacgactgtagctgcacatctgtctcatcttcccgcctatctagaagtgtntgtaactgaagcgggctggacaaggcgcatagnnnnnnnnnnn

SEQ ID NO: 238303 - DNA, 461 bp, Homo sapiens
  misc_feature: GYAE6OF01BX3RT.33.60.F05.1.454.CMB.1.raw
  modified_base (444)..(461): a, c, t, g, unknown or other
  misc_feature (444)..(461): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggacgccgtagaagtattttgctagtgttattactgtcagcgaggtacggttagttcacttccgtcccggacggttcggaccgaacgggaccaagggtaggaaatacaaaacgactggtcgctgacacatctgtcttcactcctcccgctatctagtagttgtgtcgtagtcggaggcggtcgtgggaccgaagggccgctagtagctnnnnnnnnnnnnnnnnnn

SEQ ID NO: 238304 - DNA, 410 bp, Homo sapiens
  misc_feature: GYAE6OF01DKY4J.33.60.F05.1.454.CMB.1.raw
  modified_base (314)..(314): a, c, t, g, unknown or other
  misc_feature (314)..(314): n is a, c, g, or t
  modified_base (402)..(410): a, c, t, g, unknown or other
  misc_feature (402)..(410): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatccagcagactggagcctgaagattttgctagtgtattactgtcagcagtacggtattcatctccgagttcgcaagggcaaggtgaaancaaacgatgtgctgcacgatctgtctcatcctcccgctatctagaagtcgttgtcgtaactggagcgggtctggacaaggcgcatagnnnnnnnnn

SEQ ID NO: 238305 - DNA, 428 bp, Homo sapiens
  misc_feature: GYAE6OF01EVCSA.33.60.F05.1.454.CMB.1.raw
  modified_base (415)..(428): a, c, t, g, unknown or other
  misc_feature (415)..(428): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcaggtacggtagttcatctccgacgttcggccaagggaccaaggtggaaatcgaaacgactgtggctgcacatctgtcttcattccttcccgctattctgaagttgtgtgtactggaggtcgggctggcgaagggcgacaagtcgnnnnnnnnnnnnnn

SEQ ID NO: 238306 - DNA, 409 bp, Homo sapiens
  misc_feature: GYAE6OF01ATA2A.33.60.F05.1.454.CMB.1.raw
  modified_base (389)..(389): a, c, t, g, unknown or other
  misc_feature (389)..(389): n is a, c, g, or t
  modified_base (404)..(409): a, c, t, g, unknown or other
  misc_feature (404)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctccccatccatggtgcatccaccagggccactggcatcccagccaggttcagtggcagtgggtctgggacagacttcactctcaccatcagcagcctagagcctgaagattttgctagtttattactgtctgcagcgtagcaactggcctaacaccttcggaccaagggacacgactggaagtacttaaacgaactgtggctgacacatctgtctcactcctccgctatctgagtgtgtgtactgagcggntggcaaggcacatgnnnnnn

SEQ ID NO: 238307 - DNA, 417 bp, Homo sapiens
  misc_feature: GYAE6OF01EKVCW.33.60.F05.1.454.CMB.1.raw
  modified_base (368)..(368): a, c, t, g, unknown or other
  misc_feature (368)..(368): n is a, c, g, or t
  modified_base (404)..(417): a, c, t, g, unknown or other
  misc_feature (404)..(417): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagtcatctccgacgttcggcaagggaccaaggtagaaatcaaacgaactgtaggctgcacatctgtcttcactctcccgctatctgagtntgtgtactgaggcgggctggcgaacggcgcagtagnnnnnnnnnnnnnn

SEQ ID NO: 238308 - DNA, 419 bp, Homo sapiens
  misc_feature: GYAE6OF01DI04E.33.60.F05.1.454.CMB.1.raw
  modified_base (406)..(419): a, c, t, g, unknown or other
  misc_feature (406)..(419): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagatttgcagtgtattactgtcagcagtacggtagttcatctcgacgttcggccaagggaccaaggtgaaatcaaaacgactgtgctgcacatctgtcttcactccttcccgcctatctagagtgtgtgtactgagcgggtctgggacaaggcactatacgnnnnnnnnnnnnnn

SEQ ID NO: 238309 - DNA, 418 bp, Homo sapiens
  misc_feature: GYAE6OF01B7KM7.33.60.F05.1.454.CMB.1.raw
  modified_base (406)..(418): a, c, t, g, unknown or other
  misc_feature (406)..(418): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcactctcaccatcgacagactggagcctgaagtattttgcagtctattactgtcagcagtatactggggagacgttcggccaagggaccgaagggtggaaatacgaaacgactgtggctggcacatctgtcttcatcttccgctatctagaagtgtgtagtactggagcgggtctgggcaggcgacatagnnnnnnnnnnnnn

SEQ ID NO: 238310 - DNA, 406 bp, Homo sapiens
  misc_feature: GYAE6OF01EFY64.33.60.F05.1.454.CMB.1.raw
  modified_base (366)..(366): a, c, t, g, unknown or other
  misc_feature (366)..(366): n is a, c, g, or t
  modified_base (396)..(406): a, c, t, g, unknown or other
  misc_feature (396)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtgctgcacatctgtcttcatctcccgcatctgatgtntgtactgagcgggctggcaaggcgcatagnnnnnnnnnnn

SEQ ID NO: 238311 - DNA, 433 bp, Homo sapiens
  misc_feature: GYAE6OF01CEGAL.33.60.F05.1.454.CMB.1.raw
  modified_base (413)..(433): a, c, t, g, unknown or other
  misc_feature (413)..(433): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgctagtttattactgtctgcagcgtagcaactggcctaacaccttcggaccgaagggacacgactggagtataaacgactgtgctgcacatctgtctcatcctcccgctatctgaagttgtgtgtactggaggtcgggtctgggacgaaggcgacagtagcnnnnnnnnnnnnnnnnnnnnn

SEQ ID NO: 238312 - DNA, 468 bp, Homo sapiens
  misc_feature: GYAE6OF01CANPO.33.60.F05.1.454.CMB.1.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
  modified_base (447)..(447): a, c, t, g, unknown or other
  misc_feature (447)..(447): n is a, c, g, or t
  modified_base (453)..(468): a, c, t, g, unknown or other
  misc_feature (453)..(468): n is a, c, g, or t
tcagtacacacactcacgaccggtgctcgatttagtacgtcatcagggaaaggggccgaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttnattctcaccatcagcagactggancctgaagtatttgctagtgtattactgtcagcagtacggtagttcatcgtaccgacgttccgggacctaaagggacctaagggtacgggaaaacttacgaaaacgtaacctggtacggctggcaaccagtctagtcttctaattcccttacccgctaagttcctagtaacgtgtgtagtaactgaggcggcgtcggacgaaggcnactagnnnnnnnnnnnnnnnn

SEQ ID NO: 238313 - DNA, 442 bp, Homo sapiens
  misc_feature: GYAE6OF01B0GRE.33.60.F05.1.454.CMB.1.raw
  modified_base (296)..(296): a, c, t, g, unknown or other
  misc_feature (296)..(296): n is a, c, g, or t
  modified_base (325)..(325): a, c, t, g, unknown or other
  misc_feature (325)..(325): n is a, c, g, or t
  modified_base (410)..(410): a, c, t, g, unknown or other
  misc_feature (410)..(410): n is a, c, g, or t
  modified_base (430)..(442): a, c, t, g, unknown or other
  misc_feature (430)..(442): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccgagggccactggcatcccagacaggttcagtggcagtgggtctgggacagacttcactctcaccatcagcagcctagacgcctagaagtattttgctagtttattactgtctgcagcgtagcaactggcctaacnccttcggaccaagggacacgacgtggaanaacttaaacgatggtggctacgcaccatctagtcttcactccttcccgctatcgtagtaagtgttgtgtacgtggaggtcgggtntaggacgagggctacagtgnnnnnnnnnnnnn

SEQ ID NO: 238314 - DNA, 449 bp, Homo sapiens
  misc_feature: GYAE6OF01CY0XD.33.60.F05.1.454.CMB.1.raw
  modified_base (439)..(449): a, c, t, g, unknown or other
  misc_feature (439)..(449): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggacgcctgaagtattttgcagtgttattactgtcagcgagttacggtagttcatccgtccgtacgttccggaccgaagggaccaaagggtaggaaaatacgaaaacgaacgtggtggctgcaccatctcgtcttcactccttcccgcctattctagtagtttgtcgtacgtgacggcgggctggacgaacgggcgacgatagnnnnnnnnnnn

SEQ ID NO: 238315 - DNA, 447 bp, Homo sapiens
  misc_feature: GYAE6OF01CZ1V8.33.60.F05.1.454.CMB.1.raw
  modified_base (430)..(430): a, c, t, g, unknown or other
  misc_feature (430)..(430): n is a, c, g, or t
  modified_base (436)..(447): a, c, t, g, unknown or other
  misc_feature (436)..(447): n is a, c, g, or t
tcagtacacacactcacgaccggtgctcgatttagtacgtcatcagggaaagggccaccctctcttgtagggccagtcagagtgttagcagcaactacttagcctggtaccaacaaaaaacctggccagactcccaggctcctcatctatgatgcatccaccagggccactggcatcccagccaggttcagtggcagtgggtctgggacagacttcactctcaccatcagcagcctagagcctgaagtattttgctagttttattactgtctgcagcgtagcaactcggaccttaacaccgttcggaccaaagggaccacggacgtagggaagtaacttaaacgaactggtgctgacaccatctgtcttcacttccttcccgctatctagagttgtagttgtactgtaggcgggtctgggacaagggcanagtagnnnnnnnnnnnn

SEQ ID NO: 238316 - DNA, 412 bp, Homo sapiens
  misc_feature: GYAE6OF01EAP7Y.33.60.F05.1.454.CMB.1.raw
  modified_base (265)..(265): a, c, t, g, unknown or other
  misc_feature (265)..(265): n is a, c, g, or t
  modified_base (326)..(326): a, c, t, g, unknown or other
  misc_feature (326)..(326): n is a, c, g, or t
  modified_base (399)..(412): a, c, t, g, unknown or other
  misc_feature (399)..(412): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggtcactggcatcccagacaggttcagtggcagtgggtctgggacagacttcattctcaccatcagcagactggagcctgaagattttgcagtgtattactntcagcagtacggtagttcatctccgagttcggcaagggccaaggtgaaatcaaacgactgnggctgcacatctgtctcattctcccgcatctgaacgtgtgtgtactgaggcggctgggcagggcgcagtacgnnnnnnnnnnnnnn

SEQ ID NO: 238317 - DNA, 448 bp, Homo sapiens
  misc_feature: GYAE6OF01AKL6Y.33.60.F05.1.454.CMB.1.raw
  modified_base (242)..(242): a, c, t, g, unknown or other
  misc_feature (242)..(242): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
  modified_base (415)..(448): a, c, t, g, unknown or other
  misc_feature (415)..(448): n is a, c, g, or t
tcagtacacacactcacgaccggtgctcgatttagtacgtcatcagggaaagggccaccctctcttgtagggcctacgtccagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattacngtnagcagtacggtagtttcatctccgtacgttcggccaagggaccaaggtggaaatcaaacgaactgtggctgcaccgatctgtcttcatcttcccgcatcngaatgtntgtatgagcgggtntgggacaaggccgtanaagtagcnnnnnnnnnnnnnnnnnnnnnnnnnnnnnnnnnn

SEQ ID NO: 238318 - DNA, 760 bp, Homo sapiens
  misc_feature: GYAE6OF01AO5XF.33.60.F05.1.454.CMB.1.raw
tcagtacacacactcacgaccggtgctcgatttagtacgtcatcagggaaagggccaccctctcttgtagggccagtcagagtgttagcagcaactacttagcctggtaccagcagacacctggccaggcctcccgaggtctcctcatccatcggtgcatccaccgacgggccacgtcggcactcccagactaggtttcaggtcggctaggttcgggtcgtgggacacggtaaccgtttcgattccgtaccaaccgtattcgaggcacgtaccgtgggacgtaccgtaggtaacgttacgtttttacgaccgtaggttacgttactttacgtcgtaccaaggtcgtaaggttaccggttaagtttaccaacgttccgtacccggtacggttaccggaaccggtaacgggaacccgtaagggtaacggtaaactaccgtaaaaccgtaagtacggtacggccgttacgtaccaccgttaacgttccgttcggttacctttaccgtaacgtttccccgttacccccgtacgttaccgttacgtacgggtaacgttggttacggttacggttaacgttagggaccggggttacgggtacggttacggggtaaccgtaacgggttcccgtaaccgtaagttcgggtaacgcggtacgcgtacgcgtacggtcgcgacgtacgtacgtacgtacgtacgtacgtacgtacgtacgtacgacgacgtacgacgtcgtccgtcgtcgtcgtacgtacgtctcgcgcg

SEQ ID NO: 238319 - DNA, 408 bp, Homo sapiens
  misc_feature: GYAE6OF01EGDX0.33.60.F05.1.454.CMB.1.raw
  modified_base (239)..(239): a, c, t, g, unknown or other
  misc_feature (239)..(239): n is a, c, g, or t
  modified_base (399)..(408): a, c, t, g, unknown or other
  misc_feature (399)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccgaagggaccaaggtggaaatcaaacgactgtggctgcacatctgtcttcatctcccgcatctagatgtgtgtactgagtcggctggcaaggcgcatagnnnnnnnnnn

SEQ ID NO: 238320 - DNA, 423 bp, Homo sapiens
  misc_feature: GYAE6OF01AK4WT.33.60.F05.1.454.CMB.1.raw
  modified_base (240)..(240): a, c, t, g, unknown or other
  misc_feature (240)..(240): n is a, c, g, or t
  modified_base (268)..(268): a, c, t, g, unknown or other
  misc_feature (268)..(268): n is a, c, g, or t
  modified_base (410)..(423): a, c, t, g, unknown or other
  misc_feature (410)..(423): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatccagcagactggancctgaagattttgcagtgtattactgtnagcagtacggtagtttcgactctccgacgtttcggccaaggggaccaaggtgaaatacaaacgaactgtggctggcacatctgtcttcatcttcccgcatctgaagtgtgtgtactgagcggctggcaagggcgcagtacgnnnnnnnnnnnnnn

SEQ ID NO: 238321 - DNA, 454 bp, Homo sapiens
  misc_feature: GYAE6OF01B4AL2.33.60.F05.1.454.CMB.1.raw
  modified_base (241)..(241): a, c, t, g, unknown or other
  misc_feature (241)..(241): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (426)..(427): a, c, t, g, unknown or other
  misc_feature (426)..(427): n is a, c, g, or t
  modified_base (429)..(454): a, c, t, g, unknown or other
  misc_feature (429)..(454): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctggggacagacttcattctcaccatcagcagactggancctgaagtattttgctagtgttacttacgtgtcagctagtacggtagttcatctccgtacgttcggcaagggaccaaggtgaaatcaaacgactgnggctgcacatntgtctcactctcccgctactctagtaagtgttgtagtacgtggacggtcgggtcgtgggacagggtccagtacgtagnngnnnnnnnnnnnnnnnnnnnnnnnnnn

SEQ ID NO: 238322 - DNA, 491 bp, Homo sapiens
  misc_feature: GYAE6OF01BQCL8.33.60.F05.1.454.CMB.1.raw
  modified_base (459)..(459): a, c, t, g, unknown or other
  misc_feature (459)..(459): n is a, c, g, or t
  modified_base (461)..(491): a, c, t, g, unknown or other
  misc_feature (461)..(491): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtatactgtcagcagtacgtagttcattctccgagttcggaccaagggaccaagggtagaaactcaaaacgaactggtcggctgaccaactattcctgttcttactaacgttcctttccccgctaactactcggtaagttcgtaggttgttaaccgttggaaggccgggtcgtagggacctaaagggccgtactaagtacggnannnnnnnnnnnnnnnnnnnnnnnnnnnnnnn

SEQ ID NO: 238323 - DNA, 647 bp, Homo sapiens
  misc_feature: GYAE6OF01BN8XX.33.60.F05.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccgaggccactggcatcccagacaggttcagtgctagtggtcngggacagacttcattctcacatcagcagactggacncctagaagtatttgactagtgtattactgtacagctaggtacgtagttcacgtctccgtacgtcggacgtaagggaacctaaggtaaggtaaatacgaaaacgtaacgtggtacggaccgttaggacctaacctaagttccgttacggttaccctttactaaccgtttccccgtttaaccccgggtaccttaacgttaccgttaaggtaaaccgggtttcggttaggtttaaccggtaaccggtttaggggaaccggttcccgggggaacttacgggggaaccgttaaacgggggccctaaccgggtaaacggtttaagggtacgtacgtacgtacgtacgtacgtaaccgtaacgtacgtacgtacggtacgtacgtaacgttacgtaacgtacgtacgtaacgtaca

SEQ ID NO: 238324 - DNA, 423 bp, Homo sapiens
  misc_feature: GYAE6OF01AT0HR.33.60.F05.1.454.CMB.1.raw
  modified_base (408)..(423): a, c, t, g, unknown or other
  misc_feature (408)..(423): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatccttcccgctatctgaagtgtgtgtactgacgcgggctgggacagggcgcagtagnnnnnnnnnnnnnnnn

SEQ ID NO: 238325 - DNA, 466 bp, Homo sapiens
  misc_feature: GYAE6OF01BBBJ0.33.60.F05.1.454.CMB.1.raw
  modified_base (457)..(466): a, c, t, g, unknown or other
  misc_feature (457)..(466): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggacgcctagaagtattttgctagtgttattactgtcagctaggtacggttagttctatccgtccgtacgttccggaccgaacgggaccgaagggtaggaaatacgaaaacgaactggtggctcgacacctatctacgtcttctacttcccttcccgacctatcgtagtaaggttgtgttcgtactggacggtcgggcgtacggacgaacggcgacagtagnnnnnnnnnn

SEQ ID NO: 238326 - DNA, 418 bp, Homo sapiens
  misc_feature: GYAE6OF01BL30G.33.60.F05.1.454.CMB.1.raw
  modified_base (407)..(418): a, c, t, g, unknown or other
  misc_feature (407)..(418): n is a, c, g, or t
tcagtacacacactcacgaccggtgctcgatttagtacgtcatcagggaaagggccaccctctcttgtagggccagtcagagtgttagcagcaactacttagcctggccaggtgtctgctggtaccaggctcccaggctcctcatccatggtgcatccaccagggccactggcatcccagacaggttcagtggcagtgggtctgggacagacttcactctcaccatcagcagcctagagcctgaagattttgctagtttattactgtcagcagcgtagctaacgtggtcttggacgttcggaccaagggaccaaggtgaaatcaaacgactgtgctgcacatctgtcttcatcttcccgctctgtaagtgtgtgtactgacggcgggctgggacaggcgcagtacgnnnnnnnnnnnn

SEQ ID NO: 238327 - DNA, 410 bp, Homo sapiens
  misc_feature: GYAE6OF01E4I5L.33.60.F05.1.454.CMB.1.raw
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
  modified_base (399)..(399): a, c, t, g, unknown or other
  misc_feature (399)..(399): n is a, c, g, or t
  modified_base (403)..(410): a, c, t, g, unknown or other
  misc_feature (403)..(410): n is a, c, g, or t
tcagtacacacactcacgaccggtgctcgatttagtacgtcatcagggaaagggccaccctctcttgtagggccagtcagagtgttagcagcaactacttagcctggtaccagcagaaacctggccaggctcccaggctcctcttctatgatgcatccaacagggccactggcatccccagccaggttcagtggcggtgggtctggggacagacttcactctcaccatcagcagcctagagcctgaagtatttgctagttttatactgtcagcagcgtagcaacgtggtcttggacgttcggccaagggaccaaggtgaaatcaaacgaactgtggctgcacatctgtctcntcctcccgctatntagagtgtgtagactgagtcgggctggacaggcnatgnnnnnnnn

SEQ ID NO: 238328 - DNA, 430 bp, Homo sapiens
  misc_feature: GYAE6OF01A3MTY.33.60.F05.1.454.CMB.1.raw
  modified_base (240)..(240): a, c, t, g, unknown or other
  misc_feature (240)..(240): n is a, c, g, or t
  modified_base (369)..(369): a, c, t, g, unknown or other
  misc_feature (369)..(369): n is a, c, g, or t
  modified_base (382)..(382): a, c, t, g, unknown or other
  misc_feature (382)..(382): n is a, c, g, or t
  modified_base (395)..(395): a, c, t, g, unknown or other
  misc_feature (395)..(395): n is a, c, g, or t
  modified_base (400)..(402): a, c, t, g, unknown or other
  misc_feature (400)..(402): n is a, c, g, or t
  modified_base (404)..(406): a, c, t, g, unknown or other
  misc_feature (404)..(406): n is a, c, g, or t
  modified_base (408)..(409): a, c, t, g, unknown or other
  misc_feature (408)..(409): n is a, c, g, or t
  modified_base (411)..(430): a, c, t, g, unknown or other
  misc_feature (411)..(430): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctggggacagacttcattctcaccatcagcagactgganctgaacgattttgcagtgtattactgtcagcagtacgtagtcatctccgacgttcggcaagggaccaggtgaaatcaaacgaatgtgctgcacatctgtcttcatcctcccgctatctagaagtgtgtntacgtgagcgggntgggacaaggcgnatagnnncnnnannannnnnnnnnnnnnnnnnnnn

SEQ ID NO: 238329 - DNA, 536 bp, Homo sapiens
  misc_feature: GYAE6OF01CQYHY.33.60.F05.1.454.CMB.1.raw
  modified_base (152)..(152): a, c, t, g, unknown or other
  misc_feature (152)..(152): n is a, c, g, or t
  modified_base (242)..(242): a, c, t, g, unknown or other
  misc_feature (242)..(242): n is a, c, g, or t
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
  modified_base (513)..(516): a, c, t, g, unknown or other
  misc_feature (513)..(516): n is a, c, g, or t
  modified_base (518)..(531): a, c, t, g, unknown or other
  misc_feature (518)..(531): n is a, c, g, or t
  modified_base (533)..(536): a, c, t, g, unknown or other
  misc_feature (533)..(536): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctccaggctcctcatccatggtncatccaccagggccactggcatcccagacaggttcagtggcaggtgggtctggggacagtacttcattctcacatcagcagacgtggacncctagaagtattttgctaggtgttattactgtacagcgtaggttacggtagttcattcctccgtacgttcggacgaacgggaccaagggtagaaatacgaaacgtaacgtgtacggctagaccactatctacgtcttacacttcctcccgactattctaggtaacgtggttacggtagtaccgttagggaacggggtcccgggtacgtacggggaacccgaaggggtacccgacgttaaaggtcggngagngagngcgcgtagngngtnannnngnnnnnnnnnnnnnnannnn

SEQ ID NO: 238330 - DNA, 422 bp, Homo sapiens
  misc_feature: GYAE6OF01AV44W.33.60.F05.1.454.CMB.1.raw
  modified_base (347)..(347): a, c, t, g, unknown or other
  misc_feature (347)..(347): n is a, c, g, or t
  modified_base (393)..(393): a, c, t, g, unknown or other
  misc_feature (393)..(393): n is a, c, g, or t
  modified_base (410)..(422): a, c, t, g, unknown or other
  misc_feature (410)..(422): n is a, c, g, or t
tcagtacacacactcacgaccggtgctcgatttagtacgtcatcagggaaagggccacccctctcttgtagggccagtcagagtattagcatcttcttggcctggtaccaacagaaacctggccaggctcccaggctcctcatccagaatgcattcaacagggccactggcatcccagccaggttcagtggcagtgggtctgggacagacttcactctcaccatcagcagcctagagcctgaggattctgcagtttattactgtcagcagcgtctcaactggcctccgtgccaccttcggaccaagggacacgattggagattagacgaactgtggctgccaccctntcgtcttcatccttcccgctatctgaagtgtgtgtactgagcgggntggcaaggcgcagtagnnnnnnnnnnnnn

SEQ ID NO: 238331 - DNA, 407 bp, Homo sapiens
  misc_feature: GYAE6OF01DMPSA.33.60.F05.1.454.CMB.1.raw
  modified_base (368)..(368): a, c, t, g, unknown or other
  misc_feature (368)..(368): n is a, c, g, or t
  modified_base (398)..(407): a, c, t, g, unknown or other
  misc_feature (398)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccacagggccactggcatcccagacaggttcagtggcaggtgggtctgggacagacttcattctcaccatcagcagactggagcctgaagattttgcagtgtattactgtcagcagtacgtagtcatctccgacgttcgcaagggaccaaggtgaaatcaaacgactgtggctgacacatctgtctcactcttcccgcatctagagtgtgtntactgagcggcgtggacgaaggcgcatagnnnnnnnnnn

SEQ ID NO: 238332 - DNA, 407 bp, Homo sapiens
  misc_feature: GYAE6OF01BZ2NA.33.60.F05.1.454.CMB.1.raw
  modified_base (238)..(238): a, c, t, g, unknown or other
  misc_feature (238)..(238): n is a, c, g, or t
  modified_base (391)..(391): a, c, t, g, unknown or other
  misc_feature (391)..(391): n is a, c, g, or t
  modified_base (398)..(407): a, c, t, g, unknown or other
  misc_feature (398)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtgcagtgggtctgggacagacttcattctcaccatcagcagactggancctgaagattttgcagtgtattactgtcagcagtacggtagttcatctccgacgttcggaccaaggaccaaggtggaaatcgaaacgactgtaggctgcacatctgtcttcatctccgcatctgagtgtgtgtactgagcggctggacaggcncgatagnnnnnnnnnn

SEQ ID NO: 238333 - DNA, 459 bp, Homo sapiens
  misc_feature: GYAE6OF01BJHA4.33.60.F05.1.454.CMB.1.raw
  modified_base (242)..(242): a, c, t, g, unknown or other
  misc_feature (242)..(242): n is a, c, g, or t
  modified_base (351)..(351): a, c, t, g, unknown or other
  misc_feature (351)..(351): n is a, c, g, or t
  modified_base (414)..(414): a, c, t, g, unknown or other
  misc_feature (414)..(414): n is a, c, g, or t
  modified_base (418)..(419): a, c, t, g, unknown or other
  misc_feature (418)..(419): n is a, c, g, or t
  modified_base (421)..(422): a, c, t, g, unknown or other
  misc_feature (421)..(422): n is a, c, g, or t
  modified_base (424)..(425): a, c, t, g, unknown or other
  misc_feature (424)..(425): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (435)..(436): a, c, t, g, unknown or other
  misc_feature (435)..(436): n is a, c, g, or t
  modified_base (440)..(459): a, c, t, g, unknown or other
  misc_feature (440)..(459): n is a, c, g, or t
tcagtacacacactcacgaccggtgctcgatttagtacgtcatcagggaaagggtccgaccctctcttgtagggccagtcagagtgttagcagccaactacttagcctggtaccagcagacacctggcccaggctcccaggctcctcatccatggtgcatccaccagggccactggcatcccagacaggttcagtggcagtgggtctgggacagacttcattctcaccatcagcagctggancctgaagtattttgcagtgtattacctgtcagcagtacggtagtcatctccgacgttccggaccgaagggaccctaaggtcgaaatcgaaaacgactagtggctgcacntctgtcttcatcctcccgctatcgtgaagtgtgtgtactggaagcggtcgtggacaggtcganagtnncnngnngnancatngnntagnnnnnnnnnnnnnnnnnnnn

SEQ ID NO: 238334 - DNA, 486 bp, Homo sapiens
  misc_feature: GYAE6OF01EC7BV.33.60.F05.1.454.CMB.1.raw
  modified_base (239)..(239): a, c, t, g, unknown or other
  misc_feature (239)..(239): n is a, c, g, or t
  modified_base (342)..(342): a, c, t, g, unknown or other
  misc_feature (342)..(342): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
  modified_base (462)..(473): a, c, t, g, unknown or other
  misc_feature (462)..(473): n is a, c, g, or t
  modified_base (475)..(478): a, c, t, g, unknown or other
  misc_feature (475)..(478): n is a, c, g, or t
  modified_base (480)..(484): a, c, t, g, unknown or other
  misc_feature (480)..(484): n is a, c, g, or t
  modified_base (486)..(486): a, c, t, g, unknown or other
  misc_feature (486)..(486): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgccagtgtattactgtacagcagtacggtagttcgattcgtccgacggttcggaccaagggaccaaggtaggaaactacaaaacgactagnggctgacacatctgtcttcacttcctcccgacctaattctagtaagttgtgttcgtacgtgaacggcgggtactcgggacgaacggacgacgtaatacggtnggnagcatgactnagnannnnnnnnnnnngnnnntnnnnngn

SEQ ID NO: 238335 - DNA, 578 bp, Homo sapiens
  misc_feature: GYAE6OF01CE2AH.33.60.F05.1.454.CMB.1.raw
  modified_base (525)..(525): a, c, t, g, unknown or other
  misc_feature (525)..(525): n is a, c, g, or t
  modified_base (527)..(532): a, c, t, g, unknown or other
  misc_feature (527)..(532): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (560)..(561): a, c, t, g, unknown or other
  misc_feature (560)..(561): n is a, c, g, or t
  modified_base (563)..(564): a, c, t, g, unknown or other
  misc_feature (563)..(564): n is a, c, g, or t
  modified_base (566)..(566): a, c, t, g, unknown or other
  misc_feature (566)..(566): n is a, c, g, or t
  modified_base (570)..(572): a, c, t, g, unknown or other
  misc_feature (570)..(572): n is a, c, g, or t
  modified_base (574)..(575): a, c, t, g, unknown or other
  misc_feature (574)..(575): n is a, c, g, or t
tcagtacacacactcacgaccggtgctcgatttagtacgtcatcagggaaagggccgacccggtctcttgtagggccagtcagagtgttagcagcaactacttagcctggtaccagccagacacctggccaggcctcccaggctcctcatccgatgggtgcatccacccagggcccactggccatccccagacgaggtttcagtcggcaggtgggtctgggacagacttcactctcaccatcagcagcctagagtctagaagtatttgctagtttattactgtctgcacgacgtagacaacgtggcctaacacccgttcggaccgaagggaccaacggacgttaggaagtaacgtttaaaacgaacttggtcggacctaggacaaccctattccgtacgttcctttactaccttcccgtttacccccgacttacttccgtacgggtaacgttcggttacgttaccggttaacgtcgggaacgggtcggggccttggggaacctaaggggtccgtactagtaacgntnnnnnngtgtgtgtgngngngngngngngngngnngnngnctcnnncnncgc

SEQ ID NO: 238336 - DNA, 461 bp, Homo sapiens
  misc_feature: GYAE6OF01AWV3H.33.60.F05.1.454.CMB.1.raw
  modified_base (350)..(350): a, c, t, g, unknown or other
  misc_feature (350)..(350): n is a, c, g, or t
  modified_base (416)..(416): a, c, t, g, unknown or other
  misc_feature (416)..(416): n is a, c, g, or t
  modified_base (422)..(423): a, c, t, g, unknown or other
  misc_feature (422)..(423): n is a, c, g, or t
  modified_base (425)..(425): a, c, t, g, unknown or other
  misc_feature (425)..(425): n is a, c, g, or t
  modified_base (427)..(428): a, c, t, g, unknown or other
  misc_feature (427)..(428): n is a, c, g, or t
  modified_base (431)..(461): a, c, t, g, unknown or other
  misc_feature (431)..(461): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcactctcaccatcgacagactggagcctgaagattttgcagtctattactgtcagcagtatacgtgggggagtacggttcggaccgtaaggggaccaagggtggaaactcgaaaacgaactgtggctggcaaccgntctgtcttacacttccttcccgctatctgaagtgtgtgtactggagtcgggctgggcaagggcganataggnngncnncgnnnnnnnnnnnnnnnnnnnnnnnnnnnnnnn

SEQ ID NO: 238337 - DNA, 491 bp, Homo sapiens
  misc_feature: GYAE6OF01CU7HM.33.60.F05.1.454.CMB.1.raw
  modified_base (241)..(241): a, c, t, g, unknown or other
  misc_feature (241)..(241): n is a, c, g, or t
  modified_base (471)..(471): a, c, t, g, unknown or other
  misc_feature (471)..(471): n is a, c, g, or t
  modified_base (476)..(491): a, c, t, g, unknown or other
  misc_feature (476)..(491): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggacncctagaagtattttgactaggtgttacttactgtacagtcagttacgggttagttccaattccgtaccggtaccgttccggacccgaaaggggtacccaagggttaggaaaactacgaaaacgtaactggtaggcctggaccaccattcgtgtcctctacttcccttacccgctaattccgtagtaagttcgttgtcgtagtggacgggtcggcggtcgacgaaggcgangtagnnnnnnnnnnnnnnnn

SEQ ID NO: 238338 - DNA, 411 bp, Homo sapiens
  misc_feature: GYAE6OF01DP4R2.33.60.F05.1.454.CMB.1.raw
  modified_base (355)..(355): a, c, t, g, unknown or other
  misc_feature (355)..(355): n is a, c, g, or t
  modified_base (403)..(411): a, c, t, g, unknown or other
  misc_feature (403)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctggggacagacttcattctcaccatcagcagactggagcctgaagattttgcagtgtattactgtcagcagtacggtagttcatcctcgacgttcgccaagggaccaaggtgaaatcaaacgactgtgctgcacatctgtctcactcttcccncatctagagtgtgtgtactgacggcggcgtggacgaggcgagagtagnnnnnnnnn

SEQ ID NO: 238339 - DNA, 419 bp, Homo sapiens
  misc_feature: GYAE6OF01CCGN9.33.60.F05.1.454.CMB.1.raw
  modified_base (410)..(419): a, c, t, g, unknown or other
  misc_feature (410)..(419): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagcctgaagattttgcagtgtattactgtcagcagtacggtagttcatctccgacgttcggccaagggaccaaggtggaaatcaaacgactgtggctgcaccatctgtcttcatccttcccgctactctgaagtgtgtgtactggacgcgggctgggcaagggcgacatagnnnnnnnnnn

SEQ ID NO: 238340 - DNA, 515 bp, Homo sapiens
  misc_feature: GYAE6OF01B3I9Z.33.60.F05.1.454.CMB.1.raw
  modified_base (218)..(218): a, c, t, g, unknown or other
  misc_feature (218)..(218): n is a, c, g, or t
  modified_base (243)..(243): a, c, t, g, unknown or other
  misc_feature (243)..(243): n is a, c, g, or t
  modified_base (499)..(515): a, c, t, g, unknown or other
  misc_feature (499)..(515): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctggggacagtacttnattctcaccatcagcagactggacnctagaacgtattttgactagtgtattactgtacagcagtcggtatcatcgtcgacgttccggactaagggaccaagggtacgaaactacgaaaacgtacgtggtacggctaggacctaacctaagttccgttcggttaccttaccgtaacgttccctttaccccgctaaacttcgttaggtaacggtttggttcgtacggttacgtaggaacgggttccgggacgtcgggtaacgaacgggtcgacgtagtacggnnnnnnnnnnnnnnnnn

SEQ ID NO: 238341 - DNA, 423 bp, Homo sapiens
  misc_feature: GYAE6OF01AH85T.33.60.F05.1.454.CMB.1.raw
  modified_base (413)..(423): a, c, t, g, unknown or other
  misc_feature (413)..(423): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagttacggtagtttcatctccgacgttcggaccaagggaccaaggtggaaatcaaacgaactgtggctgcacatctgtcttcatccttcccgccatctgtaagttgtgtgtactggagcgggctggcgaagggcgacagtagnnnnnnnnnnn

SEQ ID NO: 238342 - DNA, 611 bp, Homo sapiens
  misc_feature: GYAE6OF01AQZT4.33.60.F05.1.454.CMB.1.raw
  modified_base (228)..(228): a, c, t, g, unknown or other
  misc_feature (228)..(228): n is a, c, g, or t
tcagtacacacactcacgaccggtgctcgatttagtacgtcatcagggaaagggccgaccctctcttgtagggccagtcacgagtgttagcagtcaactacttagcctggtaccagcagacacctggccaggctccaggctcctcatccatggtgcagtccacctagggccactggcatcccagacaggttcagtggctaggtggtctgggacagtacgttcagttcnctaccatcgagcagacctggacgtcctagtagtacgttcgacgtagtgtacttacgtcgtcgtacgtacgtaggtacggtacgtacgacgtcgtccggtacggtcggacgtaaggtaccgtaaggtacgaacgtacgaaacgtacgtaggtacgactacgactacgtacgtcgtacgtctcgtacgtccgtaccgactacgtcgtacgtacgtcgtacgtacgtacgtgacgtcggtcgtacggtacgtacgtcgtacgtagtacgcgtagcgtcgtacgtcgacgtacgtcgtacgtacgtactacgtacgacgtacgtacgtacgtctacgtacgcgtgtacgtcgacgtagtacgtacgtacgttagtcgtacggtcgag

SEQ ID NO: 238343 - DNA, 417 bp, Homo sapiens
  misc_feature: GYAE6OF01BOK0N.33.60.F05.1.454.CMB.1.raw
  modified_base (407)..(417): a, c, t, g, unknown or other
  misc_feature (407)..(417): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacggactgtggctgcaccatctgtcttcactcctcccgcctatctgaagtgtgtgtactgacgcgggctggcaaggcgcagtagnnnnnnnnnnn

SEQ ID NO: 238344 - DNA, 602 bp, Homo sapiens
  misc_feature: GYAE6OF01CWB0P.33.60.F05.1.454.CMB.1.raw
  modified_base (560)..(560): a, c, t, g, unknown or other
  misc_feature (560)..(560): n is a, c, g, or t
  modified_base (565)..(565): a, c, t, g, unknown or other
  misc_feature (565)..(565): n is a, c, g, or t
  modified_base (567)..(570): a, c, t, g, unknown or other
  misc_feature (567)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(580): a, c, t, g, unknown or other
  misc_feature (576)..(580): n is a, c, g, or t
  modified_base (582)..(602): a, c, t, g, unknown or other
  misc_feature (582)..(602): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccacagggccactggcatcccagacaggttcagtggcaggtgggtctggggacagactttcattctcaccatcaagcagactggagccgtgaagtacttttggctagttagtattactgtcagctaggttaacggtagttcaattccgtaccgtaccggtttccgggaccgtaaagggaaccctaagggtacggtaaaacgttacgaaaaccggtaaacgttggttaacggcgttacgaccgtaacctaacgttccgtacggttcctttaccgtaacctttcccgttacccccggtacctacgttacccgtaggtaaacggttcggtttaggtttacggttacggtacgggttacggccggggttacgtacggggaaccgttaaacggggccggtacttaaggngtagnannnnancngnnnnngnnnnnnnnnnnnnnnnnnnnn

SEQ ID NO: 238345 - DNA, 417 bp, Homo sapiens
  misc_feature: GYAE6OF01CM16B.33.60.F05.1.454.CMB.1.raw
  modified_base (405)..(417): a, c, t, g, unknown or other
  misc_feature (405)..(417): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctggggacagacttcattctcaccatcagcagactggagcctgaagattttgcagtgtattactgtcagcagtacggtagttcatctccgacgttcggccaagggaccaaggtggaaatcaaacgaactgtggctgacacgatctgtctcatcttcccgcatctgacgtgtgtgtactgagcggtctgggcaaggcgacatagnnnnnnnnnnnnn

SEQ ID NO: 238346 - DNA, 452 bp, Homo sapiens
  misc_feature: GYAE6OF01ELGFD.33.60.F05.1.454.CMB.1.raw
  modified_base (241)..(241): a, c, t, g, unknown or other
  misc_feature (241)..(241): n is a, c, g, or t
  modified_base (414)..(414): a, c, t, g, unknown or other
  misc_feature (414)..(414): n is a, c, g, or t
  modified_base (439)..(452): a, c, t, g, unknown or other
  misc_feature (439)..(452): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcactcccagacaggttcagtggcagtgggtctgggacagacttcattctcaccatcagcagactggacncctgaagtattttgcagttgttattactgtcagcagtacggtattcatctccgacgttcggacaaggaccaaggtagaaatacaaacgaactggtgctgacaccatctcgtcttcacttcccttcccgactactcgtagtaagttcggtgttcgtacgtgacgggtccgggtntacgggactagggctacgatacggnnnnnnnnnnnnnn

SEQ ID NO: 238347 - DNA, 496 bp, Homo sapiens
  misc_feature: GYAE6OF01B8Z96.33.60.F05.1.454.CMB.1.raw
  modified_base (465)..(496): a, c, t, g, unknown or other
  misc_feature (465)..(496): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcaggtggcaggtgggtctgggacagacttcattctcaccatcagcagacgtggagcctagaagtattttgctagtgttattactgtcagcgaggtacggtagttcattccgtccggtacggttcggaccgaagggtatacggaagggtaggaaactacgaaaacgtacgtgtggctagccaacctatcttcgtcttactacttccttccccgctactcgtagtagtgtgtgtacgtggtacggccgggtacgtcgggacgaacgggcgactagtacgnnnnnnnnnnnnnnnnnnnnnnnnnnnnnnnn

SEQ ID NO: 238348 - DNA, 406 bp, Homo sapiens
  misc_feature: GYAE6OF01AX92O.33.60.F05.1.454.CMB.1.raw
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (400)..(406): a, c, t, g, unknown or other
  misc_feature (400)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtgaaatcaaacgaactgtggctgcacatctgtcttcatccttcccgctatctgaagtgtgtgtactgagcggntggcaggcncanagnnnnnnn

SEQ ID NO: 238349 - DNA, 444 bp, Homo sapiens
  misc_feature: GYAE6OF01ENIA4.33.60.F05.1.454.CMB.1.raw
  modified_base (338)..(338): a, c, t, g, unknown or other
  misc_feature (338)..(338): n is a, c, g, or t
  modified_base (426)..(444): a, c, t, g, unknown or other
  misc_feature (426)..(444): n is a, c, g, or t
tcagtacacacactcacgaccggtgctcgatttagtacgtcatcagggaaaggggctggagtgggtcgcaactattagtggcggtggaactcatacatactacgccgactccgtgaagggccgcttcaccatctccagagacaattccaacaacacggtgtttctgcaaaatgaaatagcctgagagtcgaggacatggccatatattactgtgcgagagttagcagtggctggtatcctttctccagcacgtggggccagggtaccctggtcaccgtctcctcagcctccaccaagggtcccatcggtccttcccccgtggcgccctgctccaggancacctccgagacgcacagcggccctgggctgcctggtcaaaggctacttcagtgtagtgtactgagcgggctggacaaggcacatagnnnnnnnnnnnnnnnnnnn

SEQ ID NO: 238350 - DNA, 466 bp, Homo sapiens
  misc_feature: GYAE6OF01BPO6M.33.60.F05.1.454.CMB.1.raw
  modified_base (443)..(466): a, c, t, g, unknown or other
  misc_feature (443)..(466): n is a, c, g, or t
tcagtacacacactcacgaccggtgctcgatttagtacgtcatcagggaaagggccacccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggacgcctgaagtattttgctagtcgtattactgtcagcaggttacgtagttcattccgtccgtacgtcggaccgaagggtaccaaggtagaaatcaaacgtacgtgaggctacgcacctatctgtcttcattcctcccgctatctaggtacgttgtcgtagtacgtggacggtcgggtctcgggacgtaagggccgtactagagnnnnnnnnnnnnnnnnnnnnnnnn

SEQ ID NO: 238351 - DNA, 419 bp, Homo sapiens
  misc_feature: GYAE6OF01CDUO1.33.60.F05.1.454.CMB.1.raw
  modified_base (403)..(404): a, c, t, g, unknown or other
  misc_feature (403)..(404): n is a, c, g, or t
  modified_base (406)..(419): a, c, t, g, unknown or other
  misc_feature (406)..(419): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagtttcatctccgacgttcggccaagggaccaaggtggaaatcaaacgaactgtggctgcaccatctgtctcatctcccgcatctgaagtgtgtgtactgaggcgggctggcaaggcgcaagtgnngnnnnnnnnnnnnnn

SEQ ID NO: 238352 - DNA, 534 bp, Homo sapiens
  misc_feature: GYAE6OF01A6S3J.33.60.F05.1.454.CMB.1.raw
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
  modified_base (506)..(511): a, c, t, g, unknown or other
  misc_feature (506)..(511): n is a, c, g, or t
  modified_base (513)..(516): a, c, t, g, unknown or other
  misc_feature (513)..(516): n is a, c, g, or t
  modified_base (518)..(534): a, c, t, g, unknown or other
  misc_feature (518)..(534): n is a, c, g, or t
tcagtacacacactcacgaccggtgctcgatttagtacgtcatcagggaaaggggccgaccctctcttgtagggccagtcagagtgttagcagccaactacttagcctggtaccagcagacacctggccaggcctcccaggctcctcatccatggtgcatcccaccagggcccactggccatcccagacaggttcaggtgggcagtgggtctgggacaggacttcgattctcacatcagcagactggagcctgaagtattttgaccagtgttacttactcgtcagcgtagtacggttagttcattccgtccgtacggttccggaccgaacgggaacccgaaggtacggaaactacgaaaaccgtaacgtcggtcggccgtagaccgaccgtagtcgtacgttcttacgtacttcccgtccccgtcctaacttcgtagtaacgttggttagtcgttacgtaggacgggtcgggcctgggacgtaacgggccgagtagtagnagtngnnnnnntnnnngnnnnnnnnnnnnnnnnn

SEQ ID NO: 238353 - DNA, 407 bp, Homo sapiens
  misc_feature: GYAE6OF01BZZHY.33.60.F05.1.454.CMB.1.raw
  modified_base (398)..(407): a, c, t, g, unknown or other
  misc_feature (398)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggttcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtgaaatcaaacgactgtgctgcacatctgtcttcatctcccgctatctgagtgtgtgtactggagcgggctggcgaaggcgcatgnnnnnnnnnn

SEQ ID NO: 238354 - DNA, 550 bp, Homo sapiens
  misc_feature: GYAE6OF01CQAFR.33.60.F05.1.454.CMB.1.raw
  modified_base (507)..(507): a, c, t, g, unknown or other
  misc_feature (507)..(507): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
  modified_base (519)..(522): a, c, t, g, unknown or other
  misc_feature (519)..(522): n is a, c, g, or t
  modified_base (526)..(526): a, c, t, g, unknown or other
  misc_feature (526)..(526): n is a, c, g, or t
  modified_base (529)..(529): a, c, t, g, unknown or other
  misc_feature (529)..(529): n is a, c, g, or t
  modified_base (531)..(544): a, c, t, g, unknown or other
  misc_feature (531)..(544): n is a, c, g, or t
  modified_base (546)..(550): a, c, t, g, unknown or other
  misc_feature (546)..(550): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgctagtgttattactgtcagctagtacggtagttcactctccgacgttcggaccgaagggaccaagggtacggaaaattcgaaaacgaaccgtgtacggtctcggaccaccacttcttcgttcttactacttcccgtttccccggtacctacgtttacttaggtaacgttcggttacggttacggttaccgttagggacgggtccggggtaccgttacgggtaaccgaacggggtccgtacgtaacgttaacgggntacgagngangnnnngtgnctngnnnnnnnnnnnnnnannnnn

SEQ ID NO: 238355 - DNA, 596 bp, Homo sapiens
  misc_feature: GYAE6OF01CSPRU.33.60.F05.1.454.CMB.1.raw
  modified_base (285)..(285): a, c, t, g, unknown or other
  misc_feature (285)..(285): n is a, c, g, or t
  modified_base (343)..(343): a, c, t, g, unknown or other
  misc_feature (343)..(343): n is a, c, g, or t
  modified_base (560)..(560): a, c, t, g, unknown or other
  misc_feature (560)..(560): n is a, c, g, or t
  modified_base (562)..(596): a, c, t, g, unknown or other
  misc_feature (562)..(596): n is a, c, g, or t
tcagtacacacactcacgaccggtgctcgatttagtacgtcatcagggaaaggggctggagtgggtcgcaactattagtggcggtggaactcatacatactacgccgactccgtgaagggccgcttcaccatctccagagacaattccaacaacacggtgtttctgcaaatgaatagcctgagagtcgaggacatggcatatattactgtgcgagagttagcagtggctggtattcctttctccagcaacgtgggccagggtaccctgggtccaccgtctccctnacggccctcccaaccgaacggggcccctacgtccggtcccctttccccccgtggcccnccccgttgcctcccgaagggaccgcctacccgtaccggacgacgaccgaaccgagggtacccgggccccgttgggggccctcgggtccccgttaggggtaaccgtaaaacggggaacccttttacccgttcccgtaaaggttcggttacggtcggtttaaccgtgggaaccggggtccggggataccggggaacaacggggtccgactaaggtggangnnnnnnnnnnnnnnnnnnnnnnnnnnnnnnnnnnn

SEQ ID NO: 238356 - DNA, 586 bp, Homo sapiens
  misc_feature: GYAE6OF01CP44M.33.60.F05.1.454.CMB.1.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (513)..(513): a, c, t, g, unknown or other
  misc_feature (513)..(513): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
  modified_base (542)..(542): a, c, t, g, unknown or other
  misc_feature (542)..(542): n is a, c, g, or t
  modified_base (550)..(551): a, c, t, g, unknown or other
  misc_feature (550)..(551): n is a, c, g, or t
  modified_base (559)..(559): a, c, t, g, unknown or other
  misc_feature (559)..(559): n is a, c, g, or t
  modified_base (566)..(566): a, c, t, g, unknown or other
  misc_feature (566)..(566): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
tcagtacacacactcacgaccggtgctcgatttagtacgtcatcagggaaagggccgaccctctcttgtagggccagtcagagtgttagcagcaactacttagcctggtaccagcagacacctggccaggctcccaggctcctcatccatggtgcatccacagggccactggcatcccagacaggttcagtggcagtgggtctgggacagtacttcattcncaccatcagcagactggancctgaacgtatttgctagtgtattactgtccagcgaacggttacgggtagttcacgttccgtaccggtaacggttccggaccggtaaagggaccgtaaaaggggttaggaaaacgtaccaaaacggtaacctcggtacggtccgtaggacctaaccaattccgtcggttccttactaactcccgtttaccccggactaattccgtaggtaacgttcgtacggttacgtaacgtggacggtccgggacttgggaaccaagggtccagtacgtgntancancagtgcngtcncgtacngtcgancgtcgacnngagtcganacgtcgngagactcagagcncgngtcg

SEQ ID NO: 238357 - DNA, 511 bp, Homo sapiens
  misc_feature: GYAE6OF01CTROD.33.60.F05.1.454.CMB.1.raw
  modified_base (363)..(363): a, c, t, g, unknown or other
  misc_feature (363)..(363): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
  modified_base (497)..(498): a, c, t, g, unknown or other
  misc_feature (497)..(498): n is a, c, g, or t
  modified_base (500)..(501): a, c, t, g, unknown or other
  misc_feature (500)..(501): n is a, c, g, or t
  modified_base (503)..(503): a, c, t, g, unknown or other
  misc_feature (503)..(503): n is a, c, g, or t
  modified_base (505)..(508): a, c, t, g, unknown or other
  misc_feature (505)..(508): n is a, c, g, or t
  modified_base (510)..(511): a, c, t, g, unknown or other
  misc_feature (510)..(511): n is a, c, g, or t
tcagtacacacactcacgaccggtgctcgatttagtacgtcatcagggtaaagggccgaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagtcagactggagacctagaagtatttttgactagttgtattactgtacagacagtacgtagtcatctccgacgttcggactaagggaccaaggtgaaactcgaaacgactgtcgactgacacatcgtgtctnactcctcccgactatcagtaacgtgtacgttagtaccgtggacgggcgggtctaggggaccgaaagggtcgtacgtaatacggtnagatnacatctactacgagtanacgtaganagagagagananagnanannannancnnnntnn

SEQ ID NO: 238358 - DNA, 434 bp, Homo sapiens
  misc_feature: GYAE6OF01AQES5.33.60.F05.1.454.CMB.1.raw
  modified_base (221)..(221): a, c, t, g, unknown or other
  misc_feature (221)..(221): n is a, c, g, or t
  modified_base (415)..(434): a, c, t, g, unknown or other
  misc_feature (415)..(434): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattcncaccatcagcagactggagcctgaagtattttgctagtgtattactgtcagcagtacggtattcatctccgacgttcgaccgaagggaccaaggtgaaatcgaaacgactgtggctgcacatctgtctcacttcgtcccgctatctagagttgtgtgtactgaggcgggtagtgggacaagggctacagtacgnnnnnnnnnnnnnnnnnnnn

SEQ ID NO: 238359 - DNA, 574 bp, Homo sapiens
  misc_feature: GYAE6OF01DGCMA.33.60.F05.1.454.CMB.1.raw
  modified_base (125)..(125): a, c, t, g, unknown or other
  misc_feature (125)..(125): n is a, c, g, or t
  modified_base (206)..(206): a, c, t, g, unknown or other
  misc_feature (206)..(206): n is a, c, g, or t
  modified_base (228)..(228): a, c, t, g, unknown or other
  misc_feature (228)..(228): n is a, c, g, or t
  modified_base (258)..(258): a, c, t, g, unknown or other
  misc_feature (258)..(258): n is a, c, g, or t
  modified_base (543)..(574): a, c, t, g, unknown or other
  misc_feature (543)..(574): n is a, c, g, or t
tcagtacacacactcacgaccggtgctcgatttagtacgtcatcagggaaagggccgaccctctcttcgtagggccagtcagagtgttagcagcaacgtacttacgcctggtaccagcaggaccncctggccagggctcccaggcctccctcatccatggtgcactccacagggccactgcatcccagcagttcagtgcagtgggntggacagctcattctacactancagcagctgactcctagaactattttcganagtacgttaatacgtagtacgaagtcgtaacgtacggttacgtaccaattcccgtaccgtaacggttccgaaccggtaaacggtaacccggtaagggtaacggaaaacgttacggaaaaaccggtaccgttagggtaccgggtacttgggaaccctaacccgtagttacggtcgttacccttaggtaacttcccttacccggtactacgttcgtacgtaagtggtctcgtaacgtcggacgggtcggacgttacggacggtaacggctacggtatacggctgtannnnnnnnnnnnnnnnnnnnnnnnnnnnnnnn

SEQ ID NO: 238360 - DNA, 614 bp, Homo sapiens
  misc_feature: GYAE6OF01ERO0Z.33.60.F05.1.454.CMB.1.raw
  modified_base (527)..(527): a, c, t, g, unknown or other
  misc_feature (527)..(527): n is a, c, g, or t
  modified_base (531)..(531): a, c, t, g, unknown or other
  misc_feature (531)..(531): n is a, c, g, or t
  modified_base (609)..(609): a, c, t, g, unknown or other
  misc_feature (609)..(609): n is a, c, g, or t
tcagtacacacactcacgaccggtgctcgatttagtacgtcatcagggaaagggtccgaccctctcttgtagggccagtcagagtgttagcagctaactacttagcctggtaccagcagacacctggccaggctcccaggctcctcatccgatggtgcagttccacctagggccacttggcatcccagacaggttcagtgcagtgggtctgggacaggacttcgattctcaccgatcagcagactggagcctgaacgtattttgctagtgttattactgtactagctagtatacgtggggacgtacggttcggaccgtaacggggaccgtaagggtaggaaactcgaaaacgtacttaggtaggctagacacgtagtcgtagtacttacacttccgttcccgactacttcgtaggtaacgttggttacgttacgttaaccgtcggtaacgggtccggggtacgtagggaaccggaaacgggtccgaacctaaggttaacgtgtacgtgagtacgtagacagaacgtnacgngtacgtacgacgacgacgtacgtacgtacgtacgtagtcgtcgtagacgtagagtacgtacgtacgacgagacgtagngtacg

SEQ ID NO: 238361 - DNA, 611 bp, Homo sapiens
  misc_feature: GYAE6OF01BB4VC.33.60.F05.1.454.CMB.1.raw
  modified_base (262)..(262): a, c, t, g, unknown or other
  misc_feature (262)..(262): n is a, c, g, or t
  modified_base (559)..(559): a, c, t, g, unknown or other
  misc_feature (559)..(559): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
  modified_base (569)..(569): a, c, t, g, unknown or other
  misc_feature (569)..(569): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (598)..(607): a, c, t, g, unknown or other
  misc_feature (598)..(607): n is a, c, g, or t
  modified_base (609)..(611): a, c, t, g, unknown or other
  misc_feature (609)..(611): n is a, c, g, or t
tcagtacacacactcacgaccggtgctcgatttagtacgtcatcagggaaagggccaccctctcttgtagggccagtcagagtgttagcagcaactacttagcctggtaccagcagaccacctggccaggcctcccaggcctcctcatccatggtgcatccaccagggcccactggcactcccagacaggttcagtggcaggtggtctgggacagtaccttcacttcgtccaccatcgaacagtacgtggagcctagaagtnttttggcagttcctaattacgtgtacagtcagtatacgtggggataaccggttcggacctaaaggggacctaagggtaggaaaacttacgaaaaacggtaacttggttaggaccgttaggaccgtaacctagtttacctgggttccttaactacgttaccgtttacccccggtacctacgttaccgttacggtaaacggtttcggttaggttaccgtaacggttgggtaaaccgggttccggggtaccgttcggggtaaacctaagggggtcccgtacctaaaggtaccgtgaccgngtagnantgngcgtgcgctagagagagananangnangnnnnnnnnnncnnn

SEQ ID NO: 238362 - DNA, 447 bp, Homo sapiens
  misc_feature: GYAE6OF01C2IP4.33.60.F05.1.454.CMB.1.raw
  modified_base (432)..(432): a, c, t, g, unknown or other
  misc_feature (432)..(432): n is a, c, g, or t
  modified_base (437)..(447): a, c, t, g, unknown or other
  misc_feature (437)..(447): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatcccaccagggccactggcatcccagacaggttcagtggcagtgggtctgggacagacttcattcctcaccatcagcagactggacgcctagaagtattttgctagtgttattactgtcagctagtacggtagttcatctccgtacgtccggaccgaacgggaccaagggtaggaaactacgaaaacgaacgtggtcggctcgacactatctgtctctactccctcccgctatcgtagtagtgtgtcgtacgtgacggcggtcgtggacgaggcganatagnnnnnnnnnnn

SEQ ID NO: 238363 - DNA, 408 bp, Homo sapiens
  misc_feature: GYAE6OF01D41R9.33.60.F05.1.454.CMB.1.raw
  modified_base (347)..(347): a, c, t, g, unknown or other
  misc_feature (347)..(347): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (398)..(408): a, c, t, g, unknown or other
  misc_feature (398)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtgctgcacatctgtctnatctcccgcatctagagtgtgtgtactgagcgggntggcaaggcncatagnnnnnnnnnnn

SEQ ID NO: 238364 - DNA, 465 bp, Homo sapiens
  misc_feature: GYAE6OF01C3WQ5.33.60.F05.1.454.CMB.1.raw
  modified_base (240)..(240): a, c, t, g, unknown or other
  misc_feature (240)..(240): n is a, c, g, or t
  modified_base (286)..(286): a, c, t, g, unknown or other
  misc_feature (286)..(286): n is a, c, g, or t
  modified_base (449)..(465): a, c, t, g, unknown or other
  misc_feature (449)..(465): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcactctcaccatcgacagacctggancctgaagattttgcagtctattactgtcagcagtatacgtgggganacggttcggccaagggaccaagggtggaaactacaaacggaactaggtcggactgacgaccaagttccttggtcctttcaacttccttcccgccattcctagaagttgtagtgttacgttgacggtacggggcttagggcctaaacgggcgacgtaatacggnnnnnnnnnnnnnnnnn

SEQ ID NO: 238365 - DNA, 481 bp, Homo sapiens
  misc_feature: GYAE6OF01CWTF8.33.60.F05.1.454.CMB.1.raw
  modified_base (274)..(274): a, c, t, g, unknown or other
  misc_feature (274)..(274): n is a, c, g, or t
  modified_base (448)..(448): a, c, t, g, unknown or other
  misc_feature (448)..(448): n is a, c, g, or t
  modified_base (451)..(481): a, c, t, g, unknown or other
  misc_feature (451)..(481): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatcccatggtgcatccaccagggcccactggcatcccagacaggttcagtggcaggtgggtctggggacagacttcattctcaccatcagcagactggagcctgaagattttgctagtgtatactgtcagnagtacggtgttcatcctccgacgttcggaccgtaagggaccaagggtcggaaatacgaaacggtaaccgtgtaggctgaccaccatcgtagtctctactccttcccgcctatccgtagtagttgtgtcgtctggaggcgggtcgtgggaccgtaagggccgacgtaagtcgatnagnnnnnnnnnnnnnnnnnnnnnnnnnnnnnnn

SEQ ID NO: 238366 - DNA, 543 bp, Homo sapiens
  misc_feature: GYAE6OF01CKT1N.33.60.F05.1.454.CMB.1.raw
  modified_base (524)..(543): a, c, t, g, unknown or other
  misc_feature (524)..(543): n is a, c, g, or t
tcagtacacacactcacgaccggtgctcgatttagtacgtcatcagggggaaagggccaccctctcttgtagggccagtcagagtgttagcagcaactacttagcctggtaccagcagacacctggccaggctcccaggctcctcatccatggtgcatcccaccagggccactggcatctcagacaggttcagtggcaggtgggtctggggacagtacttcattctcaaccatcagcagacgtggagcctagaaagttattttcgacgtagttgttaatttacgtgtcagcgtaaggttacggttagttacctattccgttacccggttaccggttaccgggaccgaaacggggtaccgtaaagggtacgaaaactaaccgaaaacgtacgtggtacggtacacgaccacctagtcgttctccttactacgttcccttccccgacttacgtccgtagtaacgttgttacgttagtaccgtagggcgggtccgggtcggtacggacggtaggacgtacagtacgnnnnnnnnnnnnnnnnnnnn

SEQ ID NO: 238367 - DNA, 409 bp, Homo sapiens
  misc_feature: GYAE6OF01DR5BS.33.60.F05.1.454.CMB.1.raw
  modified_base (368)..(368): a, c, t, g, unknown or other
  misc_feature (368)..(368): n is a, c, g, or t
  modified_base (399)..(409): a, c, t, g, unknown or other
  misc_feature (399)..(409): n is a, c, g, or t
tcagtacacacactcacgaccggtgctcgatttagtacgtcatcagggaaagggccaccctctcttgtagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagattttgctagtttattactgtcagcagcgtagcatgtcttggacgttcggcaagggaccaaggtggaaatcaaacgaactgtggctgcacatctgtctcatcttacccgctatctgagtggtacnggacgcgggtctggacaaggcgtcaagtgannnnnnnnnnn

SEQ ID NO: 238368 - DNA, 438 bp, Homo sapiens
  misc_feature: GYAE6OF01BLDBR.33.60.F05.1.454.CMB.1.raw
  modified_base (336)..(336): a, c, t, g, unknown or other
  misc_feature (336)..(336): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
  modified_base (418)..(418): a, c, t, g, unknown or other
  misc_feature (418)..(418): n is a, c, g, or t
  modified_base (423)..(424): a, c, t, g, unknown or other
  misc_feature (423)..(424): n is a, c, g, or t
  modified_base (426)..(438): a, c, t, g, unknown or other
  misc_feature (426)..(438): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagcctagaagtattttgcagtgtattactgtcagctagtacggtagttcatcgtccgtacgttcggaccgaagggacaaggtgaaatacaaacgatgngcngcacntctgtcttcacttcctcccnctatctagtaagtgtcgtgtacgtggacggtcgggtcgtggacgtaaggcgtanagtgnngnnnnnnnnnnnnn

SEQ ID NO: 238369 - DNA, 509 bp, Homo sapiens
  misc_feature: GYAE6OF01DU3L0.33.60.F05.1.454.CMB.1.raw
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
  modified_base (356)..(356): a, c, t, g, unknown or other
  misc_feature (356)..(356): n is a, c, g, or t
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
  modified_base (477)..(509): a, c, t, g, unknown or other
  misc_feature (477)..(509): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctagaagtnttttgctagtgttattacngtcagctagtacgtagttcattctccgtacgttcgaccgaagggaccaaggtagaaactacgaaaacgaactggtcgactgaccaacngttactcgtacttcgaacttccttccccgactattcctaggtaacgtgttggtacgttacggtgaacggggtccgggtacgtagggtaccggaaaggtcccgggtaanaagttacggnagnnnnnnnnnnnnnnnnnnnnnnnnnnnnnnnnn

SEQ ID NO: 238370 - DNA, 357 bp, Homo sapiens
  misc_feature: GYAE6OF01EB1J1.33.60.F05.1.454.CMB.1.raw
  modified_base (309)..(309): a, c, t, g, unknown or other
  misc_feature (309)..(309): n is a, c, g, or t
  modified_base (324)..(357): a, c, t, g, unknown or other
  misc_feature (324)..(357): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccagtggtgcatcccaccgagggccacgtggcatcccgagacgtaggttcagtgcaggtgggtcgtgggacagtacttcacctctaccaccatcgacgacgacgaccgtaagacgacctagtaaagtatttttcggacttaaggtttaacttcgtcgtcgtacncgtagtaccggtaannnnnnnnnnnnnnnnnnnnnnnnnnnnnnnnnn

SEQ ID NO: 238371 - DNA, 438 bp, Homo sapiens
  misc_feature: GYAE6OF01CFRQM.33.60.F05.1.454.CMB.1.raw
  modified_base (355)..(355): a, c, t, g, unknown or other
  misc_feature (355)..(355): n is a, c, g, or t
  modified_base (429)..(438): a, c, t, g, unknown or other
  misc_feature (429)..(438): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagcctgaagtattttgctagtgtattactgtcagcgtagtacggtagttcatctccggacgttcggaccgaagggaccgaaggtaggaaatcaaaagtgaacgtgtggctgcacctntctgtcttcatccttcccgctatcgtagtagtgtgtgtacgtggaggcgggtctgggacgacgggcgcagtagnnnnnnnnnn

SEQ ID NO: 238372 - DNA, 716 bp, Homo sapiens
  misc_feature: GYAE6OF01ARL8R.33.60.F05.1.454.CMB.1.raw
  modified_base (676)..(676): a, c, t, g, unknown or other
  misc_feature (676)..(676): n is a, c, g, or t
  modified_base (692)..(692): a, c, t, g, unknown or other
  misc_feature (692)..(692): n is a, c, g, or t
  modified_base (694)..(694): a, c, t, g, unknown or other
  misc_feature (694)..(694): n is a, c, g, or t
  modified_base (711)..(711): a, c, t, g, unknown or other
  misc_feature (711)..(711): n is a, c, g, or t
  modified_base (715)..(715): a, c, t, g, unknown or other
  misc_feature (715)..(715): n is a, c, g, or t
tcagtacacacactcacgaccggtgctcgatttagtacgtcatcagggaaagggccaccctctcttgtagggccagtcagagtgttagcagcaactacttagcctggtaccagcagaccacctggccaggcctcccgaggcctcctcactccatggtgcactcccaccgacgggcctacgtggactactcccagacgtaggttcaggtcggcgaggtcgggtcgtgggacagtacttctacttctacaccatacgagacagacgtaggacgccgtaggtaacgttagttttcgacgtaggttacgttaattacgtcgtacaaggacgtaacggtacggttacgttacctacgttaccgtaccggtaccggttaccgggaacccgtaaacgggtaaccgtaaagggtaacggtaaaactaaccgtaaaaccggtaacgttcgggtacggtacctacgtaccaacctaacgttcgttcgttacgtttacctactttaccccgttacccgaaccgtaagttccgtagggtaacggttacggttacggttagtaccccccccccccccccccccccgtaggtacgggtaccgggtacggtacgggtaaccggaacggtacgtacgtaacgtacgtagagatcactgtcgcgacgagtacactacacgagagtgactagtntcgacgtatacgtcgngngtagtactacgacacgngtgng

SEQ ID NO: 238373 - DNA, 586 bp, Homo sapiens
  misc_feature: GYAE6OF01D549W.33.60.F05.1.454.CMB.1.raw
  modified_base (304)..(304): a, c, t, g, unknown or other
  misc_feature (304)..(304): n is a, c, g, or t
  modified_base (555)..(586): a, c, t, g, unknown or other
  misc_feature (555)..(586): n is a, c, g, or t
tcagtacacacactcacgaccggtgctcgatttagtacgtcatcagggaaagggccaccctctcttgtagggccagtcagagtgttagcagcaactacttagcctggtaccagcagaaacctggccaggctcccaggcctcctcctctatggtgcatcccacccgaggggcccacgtggcactccccagacctaggttcaggtggcaggtgggtcgtgggacagtacttcactctcaccatcgacagactggacgcctagaagttattttgactagtcttattactgtcagctagtagtacggngggggtacgtacggttacggaccgaaaggggaaccgtaaagggtacgaaagtaccgaaaacggtatgggtaggcgtacgacctaacctacgtacgttacgttaccttacgtaccgttaccccttacccccggaccttaagttccgtaacggttacggtttaggtaaccggtttaacggtgggtaaccgggggttcccgggaccgggttaggaaccgggtaaccgggcgtaacgtaaggtaagcgatgcagnnnnnnnnnnnnnnnnnnnnnnnnnnnnnnnn

SEQ ID NO: 238374 - DNA, 456 bp, Homo sapiens
  misc_feature: GYAE6OF01DT9IN.33.60.F05.1.454.CMB.1.raw
  modified_base (383)..(383): a, c, t, g, unknown or other
  misc_feature (383)..(383): n is a, c, g, or t
  modified_base (422)..(456): a, c, t, g, unknown or other
  misc_feature (422)..(456): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggctgggacagacttcattctcaccatcagcagactggagcctgaagattttgcaagtgtattactgtcagcagtacggtagttcatctccgacgttcggcctaagggaccaaaggtgaaagtcaaaacggaactgtgactgacaaccatctgtctcatcttcccgctatctagtaacgtgtgtntaacgtgaagcgggtctgggacaagggtcgacaatacgnnnnnnnnnnnnnnnnnnnnnnnnnnnnnnnnnnn

SEQ ID NO: 238375 - DNA, 452 bp, Homo sapiens
  misc_feature: GYAE6OF01C4AXO.33.60.F05.1.454.CMB.1.raw
  modified_base (294)..(294): a, c, t, g, unknown or other
  misc_feature (294)..(294): n is a, c, g, or t
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
  modified_base (420)..(452): a, c, t, g, unknown or other
  misc_feature (420)..(452): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagccaggttcagtggcggtgggtctgggacagacttcactctcaccatcagcagcctagagcctgaagtattttgctagtttattactgtctgcagcgtagcaatcggacctaacnccttcggccaagggacacgactggagtaataaacgactgngctgcacatctgtctcntccttcccgctatctgaagttgtgtagtactggacgtcgggactgggaccgaagggccgactatacggnnnnnnnnnnnnnnnnnnnnnnnnnnnnnnnnn

SEQ ID NO: 238376 - DNA, 623 bp, Homo sapiens
  misc_feature: GYAE6OF01EV0YU.33.60.F05.1.454.CMB.1.raw
  modified_base (220)..(220): a, c, t, g, unknown or other
  misc_feature (220)..(220): n is a, c, g, or t
  modified_base (264)..(264): a, c, t, g, unknown or other
  misc_feature (264)..(264): n is a, c, g, or t
  modified_base (401)..(401): a, c, t, g, unknown or other
  misc_feature (401)..(401): n is a, c, g, or t
  modified_base (428)..(428): a, c, t, g, unknown or other
  misc_feature (428)..(428): n is a, c, g, or t
tcagtacacacactcacgaccggtgctcgatttagtacgtcatcaggggaagggccaccctctcttgtagggccagtcagagtgttagcagcaactacttagcctggtacccagcagacacctgggcccaggctcccaggctcctcatccatggtgcatccaccagggccactggcactcccagacaggttcagtggcagtggggtctgggacagacttnattctcaccatcagcagactggagcctgaagattttgcagtgtntactgtcagcagtacggtagttacataccgtaccgtacgtcggaccgaacggacgaacggtaggaagacaacgtaacgtagtacgtcgtcgacgacctactacgtcgtcttactactccgttcccgtacctactcgntagtagtgtgtagtacgtaggtacggncgggtacgtacggtacgtaacgggaccggtaccgtaacgtaacggtacgtacgacgtacgtacgtacgtacgacgtacgtacgtacgtacgtacgaccgtaccgtacgtaccgtaccgtaccggtacccggtacccgtacccggtacggtacccgtaccggtacggtacccggtaccgtaccggtacggtaccgg

SEQ ID NO: 238377 - DNA, 439 bp, Homo sapiens
  misc_feature: GYAE6OF01BEY4C.33.60.F05.1.454.CMB.1.raw
  modified_base (298)..(298): a, c, t, g, unknown or other
  misc_feature (298)..(298): n is a, c, g, or t
  modified_base (425)..(439): a, c, t, g, unknown or other
  misc_feature (425)..(439): n is a, c, g, or t
tcagtacacacactcacgaccggtgctcgatttagtacgtcatcagggggaaagggccaccctctcttgtagggccagtcagagtgttagcagcaactacttagcctggtaccaacaaaaacctggccagactcccaggctcctcatctatgatgcatccaccagggccactggcatcccagccaggttcagtggcagtgggtctgggacagacttcactctcaccatcagcagcctagacgcctagaagtattttgctagttttatactgtctgcagcgtagctactcgacctaacnccgttcggccgaagggacacgactgagaataacgatgtgcgtgcacatctagtctcactcctccgcctatctgtaagtcgtgtcgtactggaggtcgggcttgggacgtaaggcccgagtactaggnnnnnnnnnnnnnnn

SEQ ID NO: 238378 - DNA, 440 bp, Homo sapiens
  misc_feature: GYAE6OF01DNBDQ.33.60.F05.1.454.CMB.1.raw
  modified_base (220)..(220): a, c, t, g, unknown or other
  misc_feature (220)..(220): n is a, c, g, or t
  modified_base (412)..(440): a, c, t, g, unknown or other
  misc_feature (412)..(440): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattcncaccatcagcagactggagcctgaagtattttgactagtgtattactgtcagcagtacgtagtcatctcgacgtcgcaaggccaaggtgaaatcaaacgatgtggctgcacatctgtctcactccttcccgctatctagtagtgtgtgtaacgtgacggtcgggctgggacgaaggccgactagtagatgcnnnnnnnnnnnnnnnnnnnnnnnnnnnnn

SEQ ID NO: 238379 - DNA, 528 bp, Homo sapiens
  misc_feature: GYAE6OF01EMF0D.33.60.F05.1.454.CMB.1.raw
  modified_base (499)..(528): a, c, t, g, unknown or other
  misc_feature (499)..(528): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctggggacagacttcactctcaccatcagcaacctagaacttgaagtatttttcatttttattactgtcaacatcacggcagcctggcctctctacgtttcggcggacgggaccaagggtggagtcctacaaaacgtaacgtggtacggctacggaccaacctagtcttcgtacgtttacacttcccgtttacccccggcctacttaccgttaggtaaacgtttcggttacggttcggttaaccgtgggaacgggtccgggggtctacgggaccaaagggggtcccagtaactagtgnnnnnnnnnnnnnnnnnnnnnnnnnnnnnn

SEQ ID NO: 238380 - DNA, 557 bp, Homo sapiens
  misc_feature: GYAE6OF01BFL3U.33.60.F05.1.454.CMB.1.raw
  modified_base (531)..(557): a, c, t, g, unknown or other
  misc_feature (531)..(557): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctaggaagtattttgctagtgttattacgtgtcagctaggtacggttatttcacttccgtcccggtacggtttccggaccgaaacggggaacccaaagggtaggaaaattaccgaaaaacgtactacggtagggcctacgaccaacctacttctcgttcctttcctaactttcccttaccccgacctacgttcgttaggtaacggtttgttacggttacggttaccgtgggtaacgggtcccggggtcgttcggggaaccgaacggggcccgtacgtaacgtagtgctagnnnnnnnnnnnnnnnnnnnnnnnnnnn

SEQ ID NO: 238381 - DNA, 453 bp, Homo sapiens
  misc_feature: GYAE6OF01BFR16.33.60.F05.1.454.CMB.1.raw
  modified_base (437)..(453): a, c, t, g, unknown or other
  misc_feature (437)..(453): n is a, c, g, or t
tcagtacacacactcacgaccggtgctcgatttagtacgtcatcagggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagcctagaagattttgcagttgtattactgtcagctagtacggtattcatcctccgtacgttccggaccgaagggacccgaagggtaggaaaactacgaaaacgacgtgtggctgcacatctgtcttcactccttcccgctatctgagtgtgtcgtacgtggaggtcgggtgtcggacgaacgggcgtacgataggnnnnnnnnnnnnnnnnn

SEQ ID NO: 238382 - DNA, 473 bp, Homo sapiens
  misc_feature: GYAE6OF01CV2TB.33.60.F05.1.454.CMB.1.raw
  modified_base (210)..(210): a, c, t, g, unknown or other
  misc_feature (210)..(210): n is a, c, g, or t
  modified_base (327)..(327): a, c, t, g, unknown or other
  misc_feature (327)..(327): n is a, c, g, or t
  modified_base (424)..(424): a, c, t, g, unknown or other
  misc_feature (424)..(424): n is a, c, g, or t
  modified_base (443)..(443): a, c, t, g, unknown or other
  misc_feature (443)..(443): n is a, c, g, or t
  modified_base (446)..(447): a, c, t, g, unknown or other
  misc_feature (446)..(447): n is a, c, g, or t
  modified_base (450)..(473): a, c, t, g, unknown or other
  misc_feature (450)..(473): n is a, c, g, or t
tcagtacacacactcacgaccggtgctcgatttagtacgtcatcaggggaaaggggctggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattacngtagcgagagttagcaggtgctggtactcctttctccagcacgtgggccagggtaccctggtcaccgtctcctcagcctccaccaagggcccataccggtccttcccccgtggcccnccctcgctccgaggcgcaccctcgagagccagacgccggccctgggctcgcctggacacggactaccgttcgagtgtgtgtaacgtggacgcgggtntgggacaagggccacgtanagnngcnnnnnnnnnnnnnnnnnnnnnnnn

SEQ ID NO: 238383 - DNA, 624 bp, Homo sapiens
  misc_feature: GYAE6OF01DMEZG.33.60.F05.1.454.CMB.1.raw
  modified_base (183)..(183): a, c, t, g, unknown or other
  misc_feature (183)..(183): n is a, c, g, or t
  modified_base (262)..(262): a, c, t, g, unknown or other
  misc_feature (262)..(262): n is a, c, g, or t
  modified_base (570)..(570): a, c, t, g, unknown or other
  misc_feature (570)..(570): n is a, c, g, or t
  modified_base (573)..(573): a, c, t, g, unknown or other
  misc_feature (573)..(573): n is a, c, g, or t
  modified_base (576)..(576): a, c, t, g, unknown or other
  misc_feature (576)..(576): n is a, c, g, or t
  modified_base (582)..(582): a, c, t, g, unknown or other
  misc_feature (582)..(582): n is a, c, g, or t
  modified_base (590)..(590): a, c, t, g, unknown or other
  misc_feature (590)..(590): n is a, c, g, or t
  modified_base (593)..(593): a, c, t, g, unknown or other
  misc_feature (593)..(593): n is a, c, g, or t
  modified_base (597)..(597): a, c, t, g, unknown or other
  misc_feature (597)..(597): n is a, c, g, or t
  modified_base (599)..(602): a, c, t, g, unknown or other
  misc_feature (599)..(602): n is a, c, g, or t
  modified_base (604)..(605): a, c, t, g, unknown or other
  misc_feature (604)..(605): n is a, c, g, or t
  modified_base (610)..(610): a, c, t, g, unknown or other
  misc_feature (610)..(610): n is a, c, g, or t
  modified_base (612)..(615): a, c, t, g, unknown or other
  misc_feature (612)..(615): n is a, c, g, or t
  modified_base (617)..(621): a, c, t, g, unknown or other
  misc_feature (617)..(621): n is a, c, g, or t
  modified_base (623)..(623): a, c, t, g, unknown or other
  misc_feature (623)..(623): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatcccacagggccactggcatcccagacnggttcagtggcaggtggggtctggggacagtacttcgattcctacaccatcagccagacgtggacgcctaggaacgttntttgactagttacgttattacgtgtacagtacgtaaggttacggttagtttccgaacttccgtacccggtacggtttccgggaaccgtaaaggggaaccctaaagggtaacggtaaaactaccgaaaaccggtaacgttggtacggtactacggtaccaacccgtaattccgttaggtttcccttactaccgtttcccgttaccccgacccgttagttcgttaaggttaacggtttcgttggttacgtaaccgggttgggacgggtaccccgggtagttacgggaacgtacgggcctagtacgtaggntancgntaccgngacgtagnatncgangnnnnanngtcgncnnnntnnnnntng

SEQ ID NO: 238384 - DNA, 427 bp, Homo sapiens
  misc_feature: GYAE6OF01DPOKT.33.60.F05.1.454.CMB.1.raw
  modified_base (329)..(329): a, c, t, g, unknown or other
  misc_feature (329)..(329): n is a, c, g, or t
  modified_base (377)..(377): a, c, t, g, unknown or other
  misc_feature (377)..(377): n is a, c, g, or t
  modified_base (403)..(403): a, c, t, g, unknown or other
  misc_feature (403)..(403): n is a, c, g, or t
  modified_base (409)..(427): a, c, t, g, unknown or other
  misc_feature (409)..(427): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctagaagtattttgctagttgtattactgtcagctagtacgtagtcatctcgacgtcgcgaaggacaaggtagaaatacaaacgactgngctgacacatctagtctcactcctccgctatctagagtgtgtgttacngaggcggtcgtcgggacgacggcganagtagnnnnnnnnnnnnnnnnnnn

SEQ ID NO: 238385 - DNA, 488 bp, Homo sapiens
  misc_feature: GYAE6OF01BRFTY.33.60.F05.1.454.CMB.1.raw
  modified_base (263)..(263): a, c, t, g, unknown or other
  misc_feature (263)..(263): n is a, c, g, or t
  modified_base (461)..(488): a, c, t, g, unknown or other
  misc_feature (461)..(488): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatcccaccagggcccactggcatcccagacaggttcagtggcaggtgggtctgggacagacttcattctcaccatcagcagactggagcctagaagtattttgctagtntattactgtcaggctagtacggtagttcagtcgtccgtacgttccggaccgaagggaccgtaagggtacggtaaaataccgaaaacgtaacgtggtacggtctcgaccaccattccttgtctttcacttccttcccgctacgttcgtagtagttgtgttacgtacgtggacggcgggtcgtggacgaggcacagtagnnnnnnnnnnnnnnnnnnnnnnnnnnnn

SEQ ID NO: 238386 - DNA, 479 bp, Homo sapiens
  misc_feature: GYAE6OF01DG640.33.60.F05.1.454.CMB.1.raw
  modified_base (250)..(250): a, c, t, g, unknown or other
  misc_feature (250)..(250): n is a, c, g, or t
  modified_base (445)..(479): a, c, t, g, unknown or other
  misc_feature (445)..(479): n is a, c, g, or t
tcagtacacacactcacgaccggtgctcgatttagtacgtcatcagggaaagggccaccctctcttgtagggccagtcagagtattagcatcttcttggcctggtaccaacagaaacctggccaggctcccaggctcctcatcccagaatgcattcaacagggccactggcatcccagccaggttcagtggcagtgggtctgggacagacttcactctcaccatcagcagcctagacgcctgaggattcngcagtgtattactgtcagcagtacggtagttcatcctccgcggttccgaccgaacggaccaaggtagaaatacaaacgactgtggctgcacctatctgtcttacacttccttacccgctacttcgtaggaacgttggtcgttagtacgtggacgtcggggtactagggacgaacgggccgacgtaagtacggctnnnnnnnnnnnnnnnnnnnnnnnnnnnnnnnnnnn

SEQ ID NO: 238387 - DNA, 592 bp, Homo sapiens
  misc_feature: GYAE6OF01CPW9T.33.60.F05.1.454.CMB.1.raw
  modified_base (554)..(554): a, c, t, g, unknown or other
  misc_feature (554)..(554): n is a, c, g, or t
  modified_base (557)..(557): a, c, t, g, unknown or other
  misc_feature (557)..(557): n is a, c, g, or t
  modified_base (562)..(592): a, c, t, g, unknown or other
  misc_feature (562)..(592): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccgagggcccactggcatcccagacaggttcaggtggcaggtgggctgggacagacttcattctcacctatccagccagacgtggacgaccgtgaagtaagttttgacgtagttggttaattaacgtggtacaggacgaggttacggtagttcacgtccgtaccgtacggtttccggaccgaacgggaccgtaaagggtacggaaaacgtacgaaaacggaaccgtggtacggtaccgttcggacctaacccgacgttaccgtttacggtccttttacacgttttaccccgttccccggacctaaccgttacgtacggtaacggttcgttggttacgttcgttagggacggggtccggtacggttacggggaacgacgggacgtaccgatacggntcntacgnnnnnnnnnnnnnnnnnnnnnnnnnnnnnnn

SEQ ID NO: 238388 - DNA, 437 bp, Homo sapiens
  misc_feature: GYAE6OF01B823T.33.60.F05.1.454.CMB.1.raw
  modified_base (411)..(411): a, c, t, g, unknown or other
  misc_feature (411)..(411): n is a, c, g, or t
  modified_base (418)..(437): a, c, t, g, unknown or other
  misc_feature (418)..(437): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagctgaagtattttgcagtgtattactgtcagcagtacggtagtcatcctccgacgttcggaccgaagggaccaaggtggaaatcgaaaacgaactgtggctgacacattctgtcttcatccttcccgcattcgtagagttgtgtcgtagtggaggcggcgtggacaaggcgnagtacgnnnnnnnnnnnnnnnnnnnn

SEQ ID NO: 238389 - DNA, 609 bp, Homo sapiens
  misc_feature: GYAE6OF01BSN7L.33.60.F05.1.454.CMB.1.raw
  modified_base (251)..(251): a, c, t, g, unknown or other
  misc_feature (251)..(251): n is a, c, g, or t
  modified_base (312)..(312): a, c, t, g, unknown or other
  misc_feature (312)..(312): n is a, c, g, or t
  modified_base (581)..(581): a, c, t, g, unknown or other
  misc_feature (581)..(581): n is a, c, g, or t
  modified_base (583)..(584): a, c, t, g, unknown or other
  misc_feature (583)..(584): n is a, c, g, or t
  modified_base (586)..(609): a, c, t, g, unknown or other
  misc_feature (586)..(609): n is a, c, g, or t
tcagtacacacactcacgaccggtgctcgatttagtacgtcatcagggaaagggccaccctctcttgtagggccagtcagagtgttagcagcaactacttagcctggtaccagcagacaccgtggccaggcctcccgaggcctcctcactccagtggtcgcactcccaccgacggggcccacgtggacactccccgaaggaccgtagggttcaggtggcgtagggtgggtccgtggggaccagtacctttnactttccaccaacctatccagcgacgtacgtggacgccgtagaagttagtttgctaggttnttaattacgtgtacacgcgtaaggttacggttacgttcgtacgttcccgttacccggtaccggtttaccgggaccggtaaacggggaaccgtaaagggtaacggaaacttaacgaaaaccgtaacgtggtacggctcgaccactacttctcgttaccttctaccgttccctaccccgtctacgttccgtaaggtacgttggttacggtttacgtaacggtgggacgggtcgggtacggtacgggaacggaacggccggtacgaagtgangnncnnnnnnnnnnnnnnnnnnnnnnnn

SEQ ID NO: 238390 - DNA, 600 bp, Homo sapiens
  misc_feature: GYAE6OF01ATZI6.33.60.F05.1.454.CMB.1.raw
  modified_base (250)..(250): a, c, t, g, unknown or other
  misc_feature (250)..(250): n is a, c, g, or t
  modified_base (563)..(563): a, c, t, g, unknown or other
  misc_feature (563)..(563): n is a, c, g, or t
  modified_base (569)..(575): a, c, t, g, unknown or other
  misc_feature (569)..(575): n is a, c, g, or t
  modified_base (577)..(600): a, c, t, g, unknown or other
  misc_feature (577)..(600): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctccaggctcctcatccatggtgcatcccaccagggccactggcatccccagacaggttcagtggcagtgggtctgggacagacttcattctcaccatcagcagactggagcctgaagtnttttgcagttgtattacgtgtacagtcaggtacggttacgttcacgttccgtaccggtacggttccggaccgaaggggaccaagggtaagaaaacttaccgaaaacgtaaccgtggtacggctacggaccctaacctaacgttcgttacgttcctttaccgtaaccgtttccccgtttcccccggtaacctaacgtttacccgttacgggttaaacggtttccgggtttaggttacgggtttaacccgtgggtaaccggggtacccgggggtacgttacggggacgtaaacggggtccgaacgtagtaacggnacgtgnnnnnnnannnnnnnnnnnnnnnnnnnnnnnn

SEQ ID NO: 238391 - DNA, 577 bp, Homo sapiens
  misc_feature: GYAE6OF01DDKZ7.33.60.F05.1.454.CMB.1.raw
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
  modified_base (255)..(255): a, c, t, g, unknown or other
  misc_feature (255)..(255): n is a, c, g, or t
  modified_base (545)..(545): a, c, t, g, unknown or other
  misc_feature (545)..(545): n is a, c, g, or t
  modified_base (547)..(577): a, c, t, g, unknown or other
  misc_feature (547)..(577): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatctatgatgcatccaccgagggccactggcactcccagcctaggttcagtggcaggtgggctgggacngacttcactcncacatcagcacgcctagacgcctagaaagttntttagcttagttttatactgtctagcaggtctaggcctaaagtccggtacctaaccgtaccgttcgggacctaacggggaccacggtacgtagggaacgttaaactttaaaccggaacgttggtacgggtccttaacggaccctaaacccgtagtttacccgtggttttaacctccggttaacctccccccgtttacccggtaccctaagttccgtaacgggtaagttggttacgtttacggtaacgtcggacgggtccgggtagtcgggaacgtaggccgactaggcgnannnnnnnnnnnnnnnnnnnnnnnnnnnnnnn

SEQ ID NO: 238392 - DNA, 645 bp, Homo sapiens
  misc_feature: GYAE6OF01DV1JQ.33.60.F05.1.454.CMB.1.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (596)..(596): a, c, t, g, unknown or other
  misc_feature (596)..(596): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (613)..(613): a, c, t, g, unknown or other
  misc_feature (613)..(613): n is a, c, g, or t
  modified_base (615)..(615): a, c, t, g, unknown or other
  misc_feature (615)..(615): n is a, c, g, or t
  modified_base (619)..(622): a, c, t, g, unknown or other
  misc_feature (619)..(622): n is a, c, g, or t
  modified_base (624)..(629): a, c, t, g, unknown or other
  misc_feature (624)..(629): n is a, c, g, or t
  modified_base (631)..(631): a, c, t, g, unknown or other
  misc_feature (631)..(631): n is a, c, g, or t
  modified_base (633)..(645): a, c, t, g, unknown or other
  misc_feature (633)..(645): n is a, c, g, or t
tcagtacacacactcacgaccggtgctcgatttagtacgtcatcagggaaagggcccaccctctcttggtagggccagtcagagtgttagcagcaactacttagcctggtaccagcagacaccgtggccaggcctcccgaggcctccctcactccagtggtgccactcccaccgaggggcccacgtggccactccccgaagaccgtaggttcaggtggcgtaggtgggtctgggacagtacttnattcnccacatcgagcagacgtggacnctagaagtntttgacgtagttgttattacgtgtacgacgtacgtaacggttacggtagtttacacgttcccgtaccggtaccggttccggaaccggtaaacgggaaccgtaaagggtaagtaaaactaaccggaaaaggtaccgtggtacggactacgacctaaccgtcttccgttcgttaccgttactaccgtttccccgttacccgtattaccgttacggtacggttaagggtttcggttacggtttaccgtaacgggttacgggtcggggtaccgggtacgttaccggggaacggtaacggggtcctaacgttacggtaggngtagcgagtcgngngtngngtgnnnngnnnnnngngnnnnnnnnnnnnn

SEQ ID NO: 238393 - DNA, 621 bp, Homo sapiens
  misc_feature: GYAE6OF01BYYF2.33.60.F05.1.454.CMB.1.raw
  modified_base (157)..(157): a, c, t, g, unknown or other
  misc_feature (157)..(157): n is a, c, g, or t
  modified_base (186)..(186): a, c, t, g, unknown or other
  misc_feature (186)..(186): n is a, c, g, or t
  modified_base (588)..(588): a, c, t, g, unknown or other
  misc_feature (588)..(588): n is a, c, g, or t
  modified_base (590)..(593): a, c, t, g, unknown or other
  misc_feature (590)..(593): n is a, c, g, or t
  modified_base (595)..(595): a, c, t, g, unknown or other
  misc_feature (595)..(595): n is a, c, g, or t
  modified_base (598)..(604): a, c, t, g, unknown or other
  misc_feature (598)..(604): n is a, c, g, or t
  modified_base (606)..(621): a, c, t, g, unknown or other
  misc_feature (606)..(621): n is a, c, g, or t
tcagtacacacactcacgaccggtgctcgatttagtacgtcatcagggaaagggccaccctctcttgtagggccagtcagagtgttagcagcaactattagcctggtaccagcagacacctggccaggcctcccgaggcctcctcactccatcgggncatcccaccgagggcccacgtggcctacncccaagacctaggttcaggtggctagggtcgggtcgagggaaccgtagtaccttctacttcctaccaccatccgaaggaccaggactggggacaccgtagtaaggttattttcggataggtgttacttacgtaggtacgacgtaggtaaggtttcgttacgtccacgttcccggtaccgtacggtaccggaacgggtaacggaacggtaaggaacggaaacttaaccgaaacggtaagtcgggtacgacgtcgtaacccacgtacttcggttacttacctactaacccgttccgtcccccgaacgttacgttacggttaaacgtgggttcggttacgttacgggtcgacggtaccgggtcggtaacggacggtaccggaggtccgtaggagtaggcaggcangnnnngntgnnnnnnngnnnnnnnnnnnnnnnn

SEQ ID NO: 238394 - DNA, 478 bp, Homo sapiens
  misc_feature: GYAE6OF01COLP7.33.60.F05.1.454.CMB.1.raw
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (458)..(478): a, c, t, g, unknown or other
  misc_feature (458)..(478): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtggtctgggacagacttcattctcaccatcagcagactggacgcctagaaggtatttttcgacaaggttgtaatttactgtccagcctaggtaccggtagttctattcctccggacgtttccggaccgtaagggaccaaagggttggaaacttacgaaaacgaacgtggtacgcctagacacattctacgtcttcacttcctcccgtcacgtctacgagtgttgtgttacnggacggcggtntaggcaaggcgcagtgacgnnnnnnnnnnnnnnnnnnnnn

SEQ ID NO: 238395 - DNA, 529 bp, Homo sapiens
  misc_feature: GYAE6OF01D8G81.33.60.F05.1.454.CMB.1.raw
  modified_base (493)..(494): a, c, t, g, unknown or other
  misc_feature (493)..(494): n is a, c, g, or t
  modified_base (496)..(496): a, c, t, g, unknown or other
  misc_feature (496)..(496): n is a, c, g, or t
  modified_base (498)..(529): a, c, t, g, unknown or other
  misc_feature (498)..(529): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctagaagtattttgcagttgtattctgtcagcaggttacggtagttcattccgtccggtacggttcggaccgaacgggacctaagggtacggaaaataccgaaaacgtaacgtgtcggctcgcgactatctcgttcttcgacttaccgttcccgacctacttcgtaggtaacggttggttcgttcggttaacgtcgggtaacgggtcccggggtcgtacgggaccggtaaacgggccgtaacgtagttaacgnngngnnnnnnnnnnnnnnnnnnnnnnnnnnnnnnnn

SEQ ID NO: 238396 - DNA, 447 bp, Homo sapiens
  misc_feature: GYAE6OF01E31OJ.33.60.F05.1.454.CMB.1.raw
  modified_base (381)..(381): a, c, t, g, unknown or other
  misc_feature (381)..(381): n is a, c, g, or t
  modified_base (418)..(418): a, c, t, g, unknown or other
  misc_feature (418)..(418): n is a, c, g, or t
  modified_base (423)..(447): a, c, t, g, unknown or other
  misc_feature (423)..(447): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctagaagtattttgctagtgtattactgtcagcagtacggtagtcatctccgacgttcggacgaaggaccaaggtgaaatacgaaacgactgtggctgcactatctgtcttcatcctcccgctatcagtagtgtgtgtacnggtaggcggtacgtgggacgaagggcgacgtagtagnacgtnnnnnnnnnnnnnnnnnnnnnnnnn

SEQ ID NO: 238397 - DNA, 598 bp, Homo sapiens
  misc_feature: GYAE6OF01AQ9AL.33.60.F05.1.454.CMB.1.raw
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (569)..(571): a, c, t, g, unknown or other
  misc_feature (569)..(571): n is a, c, g, or t
  modified_base (574)..(598): a, c, t, g, unknown or other
  misc_feature (574)..(598): n is a, c, g, or t
tcagtacacacactcacgaccggtgctcgatttagtacgtcatcagggaaagggccaccctcttcttgtagggccagtcagagtgttagcagcaactacttagcctggtaccagcagaccacctggccaggcctcccaggcctcctcatccatggtcacactcccaccgaggccactggcactccccgagaccgtaggttccaggtcggctaggtgggtctgggacagacttcattccncaccatccagccagcctagacnccgtagaacgtgttttcgacttagttttacttacgttgtcgtgcgtacgtacgtacgaccgtaaccgtcggaaccccttaaccgtcccggttaccgggaacccggaacgggaccaacggtacgtaggaacgtaacgttaaacgacgtcggacggctccgaccacctactcgttccttccttactcctttccctccccgacctacttaccgttaggtagtttcggtcgttacggtacggtacgggtacgggtaccgggtacgtacgggtaaccggacgggtaccgtaacgtagtaggctagctncgngnnngtnnnnnnnnnnnnnnnnnnnnnnnnn

SEQ ID NO: 238398 - DNA, 493 bp, Homo sapiens
  misc_feature: GYAE6OF01A15Z8.33.60.F05.1.454.CMB.1.raw
  modified_base (467)..(493): a, c, t, g, unknown or other
  misc_feature (467)..(493): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagtacttcattcctcaccatcagcagactggagcctagaagattttgcagtgttattactgtcagctaagttacggtagttcattccgtaccgtacggttcggaccgaacgggaacctaagggtaggaaatacgaaaacgtagtggtaggctgactacatctgttcttactactcccttacccgactattcctaggtaacgtggttgttagtacgtggacgggtcgggtccgtggacgaacgggccgtacgagtgatnnnnnnnnnnnnnnnnnnnnnnnnnnn

SEQ ID NO: 238399 - DNA, 625 bp, Homo sapiens
  misc_feature: GYAE6OF01BWDYX.33.60.F05.1.454.CMB.1.raw
  modified_base (249)..(249): a, c, t, g, unknown or other
  misc_feature (249)..(249): n is a, c, g, or t
  modified_base (596)..(597): a, c, t, g, unknown or other
  misc_feature (596)..(597): n is a, c, g, or t
  modified_base (599)..(625): a, c, t, g, unknown or other
  misc_feature (599)..(625): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccaggggccacgtggaactcccagacagggttcaggtggcaggtgggtctggggacagacttcattctcaccatcagcagacgtggacnccgtagaagtattttcgctagttagtattactgtacagcgtaaggttaacggttcgttcctacgttccgtcccggtaccgggtttaccgggaccggaaacggggtaacccgaaaggggttaacggaaaaacgttaaccaaaaacgggtaaccgttagggtccggacgttacggaccctaaccaactttccgttacggtttacctttccgttaacctttccccgtttacccccgaccgttaacttccgttaaggtaacgggttcggtttagttaggttaccggtgggtaaccggggtccgggtcggtaacggggacggaaacggggcgtaccgaaggttacgcgtagnncnnnnnnnnnnnnnnnnnnnnnnnnnnn

SEQ ID NO: 238400 - DNA, 549 bp, Homo sapiens
  misc_feature: GYAE6OF01CUP7L.33.60.F05.1.454.CMB.1.raw
  modified_base (236)..(236): a, c, t, g, unknown or other
  misc_feature (236)..(236): n is a, c, g, or t
  modified_base (512)..(512): a, c, t, g, unknown or other
  misc_feature (512)..(512): n is a, c, g, or t
  modified_base (517)..(518): a, c, t, g, unknown or other
  misc_feature (517)..(518): n is a, c, g, or t
  modified_base (520)..(549): a, c, t, g, unknown or other
  misc_feature (520)..(549): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagacnggacgcctgaagtattttgctagtgttaattactgtcagctagttacggtagtttcattccgtaccgacggttccggaccgaacgggaccgaaagggtaggtaaaataccgaaaaacggtaacttggtgggtcctacgacctaaccctattccgtacgttccttaccgtacttccctttccccgacctattccgtaggtaacggttggtttaggttacggttaccgttagggacggggtcccgggtagtcgggtacgaacgggccgagtaataggntacgnnannnnnnnnnnnnnnnnnnnnnnnnnnnnnn

SEQ ID NO: 238401 - DNA, 731 bp, Homo sapiens
  misc_feature: GYAE6OF01C1R3Y.33.60.F05.1.454.CMB.1.raw
  modified_base (639)..(639): a, c, t, g, unknown or other
  misc_feature (639)..(639): n is a, c, g, or t
  modified_base (684)..(684): a, c, t, g, unknown or other
  misc_feature (684)..(684): n is a, c, g, or t
  modified_base (696)..(696): a, c, t, g, unknown or other
  misc_feature (696)..(696): n is a, c, g, or t
  modified_base (711)..(711): a, c, t, g, unknown or other
  misc_feature (711)..(711): n is a, c, g, or t
  modified_base (723)..(724): a, c, t, g, unknown or other
  misc_feature (723)..(724): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccacagggccactggcatcccagacaggttcagtggcaggtgggtctgggacagacttcattctcacatcagcagactggagcctgaagtattttgcgtagtgttacttacgtcgttcacgtcgtaaggttacggttaaggtttactaacgttcccgttaccggtaaccgggtttaccgggaaccgtaaacggggtaaccccgtaaaggggttacgggaaaaacttaccggaaaaaccggtaaacgttggtacggggtaccttacggaccgaacccgtacgtttaccgtttacggttaaccttttcccgtaaacgttttccccgttttacccccgtacccgtaacgtttaccgttacggtaaacgggtttggtttacggttaccgggtttaaacgttcgggtaaccggggtcccggggtttaccggttaacggggacccgggtaaacgggggtaccccggttaacgtaacggtttaaccgggngtacgtacgtgagtacgtcgtagtcgtcgtacgcgtgtcgtcgcngtacgtatacgngtcgtagactgacgntacacgacgacnngtcgtag

SEQ ID NO: 238402 - DNA, 569 bp, Homo sapiens
  misc_feature: GYAE6OF01AXHG2.33.60.F05.1.454.CMB.1.raw
  modified_base (534)..(535): a, c, t, g, unknown or other
  misc_feature (534)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (541)..(542): a, c, t, g, unknown or other
  misc_feature (541)..(542): n is a, c, g, or t
  modified_base (544)..(569): a, c, t, g, unknown or other
  misc_feature (544)..(569): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatcccaccgagggccactggcatccccagacaggttcagtggcagtgggtctgggacagacttcactctcaccatcagcagcctagagcctgaagtattttgctaagtttattactgtctgcagacgtagacaacgtcggaccctaaaccgtcccgttaccgggacctaaacggggacctaacggaacgttagggaaagtaaacgtttaaaaccggaaacgttggtacggtcgtaacgaccaaacctaattccgttacgttcctttaacctaccgtttacccgttcccccgtactaacttgtaacggtaaagtttcggtagttacgttaccgtagggacggcggggtctagggaaccgtaacgggccgtacgtaagtagnnananannannnnnnnnnnnnnnnnnnnnnnnnnn

SEQ ID NO: 238403 - DNA, 458 bp, Homo sapiens
  misc_feature: GYAE6OF01DLZIY.33.60.F05.1.454.CMB.1.raw
  modified_base (183)..(183): a, c, t, g, unknown or other
  misc_feature (183)..(183): n is a, c, g, or t
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (376)..(376): a, c, t, g, unknown or other
  misc_feature (376)..(376): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
  modified_base (433)..(458): a, c, t, g, unknown or other
  misc_feature (433)..(458): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacnggttcagtggcagtgggtctgggacagacttcattcncaccatcagcagactggacncctgaagtattttgcagttgtattctgtcagcagtacggtagttcatctccgacgttcggccaaagggaccaaaggtaggaaaatcgaaaacgactagtggctgacacgatctcgtcttcattcctcccgtcatcngtaagtgtgtgtactggacggcgggtctgggacaggctnaatagangtcatcgangnnnnnnnnnnnnnnnnnnnnnnnnnn

SEQ ID NO: 238404 - DNA, 419 bp, Homo sapiens
  misc_feature: GYAE6OF01A3N1L.33.60.F05.1.454.CMB.1.raw
  modified_base (265)..(265): a, c, t, g, unknown or other
  misc_feature (265)..(265): n is a, c, g, or t
  modified_base (407)..(419): a, c, t, g, unknown or other
  misc_feature (407)..(419): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagtattttgcagtgtattacngtcagcagtacggtagttcatcgtccgacgttcggccaagggaccaaggtgaaatcaaacgatgtggctgcacatctgtcttcactcttcccgcatctagagttgtgtgtactgaggcgggtctggcaaggcgacagtacgnnnnnnnnnnnnn

SEQ ID NO: 238405 - DNA, 477 bp, Homo sapiens
  misc_feature: GYAE6OF01C2XKM.33.60.F05.1.454.CMB.1.raw
  modified_base (290)..(290): a, c, t, g, unknown or other
  misc_feature (290)..(290): n is a, c, g, or t
  modified_base (447)..(477): a, c, t, g, unknown or other
  misc_feature (447)..(477): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagcctagaagtattttgcagtgtattactgtacagcagtacgtagtcatcncgtacgtcgaaccgtaaggaccaaggtagaaatacaaaacgactgagctgacaacatctagtcttcacttccgttcccgactaagttcgagtaagttgttacggtagttaacgtggacgggcgggtacgtagggaaccgaacgggcgactaagtagnnnnnnnnnnnnnnnnnnnnnnnnnnnnnnn

SEQ ID NO: 238406 - DNA, 568 bp, Homo sapiens
  misc_feature: GYAE6OF01AER48.33.60.F05.1.454.CMB.1.raw
  modified_base (242)..(242): a, c, t, g, unknown or other
  misc_feature (242)..(242): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (531)..(531): a, c, t, g, unknown or other
  misc_feature (531)..(531): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (546)..(568): a, c, t, g, unknown or other
  misc_feature (546)..(568): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtgcaggtgggtctgggacagtacttcattctcaccatcagtcagactggacncgtgaagattttgcagttgtacttacgtgtcagcgtaagttaccggtagtttcacttccgtccggtaccgttccggaccggtaacgggaacccgtaaagggtaggtaaaactacgaaaacggaacttaggtacggtcgtcgtaaccaccacttcgtacggttctttaccgtaacttcccttaccccggaccttacgttaccgttacgtaaggttcgttgttacggttaaccgtggtaacgggtccgggtacgtcgggacggtaaacgggcgtactaagtagngntaggntagctcgtaantncnnnnnnnnnnnnnnnnnnnnnnn

SEQ ID NO: 238407 - DNA, 516 bp, Homo sapiens
  misc_feature: GYAE6OF01EMWZD.33.60.F05.1.454.CMB.1.raw
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (335)..(335): a, c, t, g, unknown or other
  misc_feature (335)..(335): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (473)..(474): a, c, t, g, unknown or other
  misc_feature (473)..(474): n is a, c, g, or t
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
  modified_base (508)..(508): a, c, t, g, unknown or other
  misc_feature (508)..(508): n is a, c, g, or t
  modified_base (510)..(511): a, c, t, g, unknown or other
  misc_feature (510)..(511): n is a, c, g, or t
  modified_base (514)..(514): a, c, t, g, unknown or other
  misc_feature (514)..(514): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagtattttnacagtgtattactgtacagcagtacggtagtcatcgtccgacgttcggaccaagggaccaaggtgaaaatacaaacgactgngctgacacgatactgtcttcatccttacccgcctatctagtaagttgtagttacgtaacgtggaacgggtcgggtacgtacgggtacgaaacgggtccgaatacgtaggntacggntagcaggttacntnacagtacnnanagnagatagtagtacganagnacganacacanannagnga

SEQ ID NO: 238408 - DNA, 557 bp, Homo sapiens
  misc_feature: GYAE6OF01CIYVP.33.60.F05.1.454.CMB.1.raw
  modified_base (155)..(155): a, c, t, g, unknown or other
  misc_feature (155)..(155): n is a, c, g, or t
  modified_base (183)..(183): a, c, t, g, unknown or other
  misc_feature (183)..(183): n is a, c, g, or t
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (470)..(470): a, c, t, g, unknown or other
  misc_feature (470)..(470): n is a, c, g, or t
  modified_base (513)..(513): a, c, t, g, unknown or other
  misc_feature (513)..(513): n is a, c, g, or t
  modified_base (518)..(518): a, c, t, g, unknown or other
  misc_feature (518)..(518): n is a, c, g, or t
  modified_base (520)..(526): a, c, t, g, unknown or other
  misc_feature (520)..(526): n is a, c, g, or t
  modified_base (528)..(532): a, c, t, g, unknown or other
  misc_feature (528)..(532): n is a, c, g, or t
  modified_base (534)..(534): a, c, t, g, unknown or other
  misc_feature (534)..(534): n is a, c, g, or t
  modified_base (536)..(539): a, c, t, g, unknown or other
  misc_feature (536)..(539): n is a, c, g, or t
  modified_base (541)..(542): a, c, t, g, unknown or other
  misc_feature (541)..(542): n is a, c, g, or t
  modified_base (544)..(557): a, c, t, g, unknown or other
  misc_feature (544)..(557): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctccctcctctatgggtncactcccaccgagggccacgtggctacncccgaagacaggttcgagtcggcaggtgggtctagggacagtcttcacttcncaccntcagcacgcctagacgtacgtagaaggttatttggacttagttttacgtaccgttggtcttacgacgcggtacctagaccgtaaccgtccgtaaccctaacccgtacgtacccgacggaaacgggcaacgtagaggaaagtaacgtaaaagtctggtacggctacgactaactatgttctcgtacttcgtaccctccgtactacgtacgaggttaagtggttacggttanacggttacgccgggtacggtcgtagggaacgtacggacgtaanagtgntnnnnnnngnnnnngngnnnngnngnnnnnnnnnnnnnn

SEQ ID NO: 238409 - DNA, 510 bp, Homo sapiens
  misc_feature: GYAE6OF01BVM97.33.60.F05.1.454.CMB.1.raw
  modified_base (482)..(484): a, c, t, g, unknown or other
  misc_feature (482)..(484): n is a, c, g, or t
  modified_base (486)..(510): a, c, t, g, unknown or other
  misc_feature (486)..(510): n is a, c, g, or t
tcagtacacacactcacgaccggtgctcgattagtacgtcatcagggaaaggggctggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagttagcagtggctggtattcctttctccagcacgtggggccagggtaccctggtccaccgtctcctcacgcctccaccgacgggcccagtccggtccttccccctgaccgccctgcctaccgaggacgccacccgtccgacggacgaccacgacggcccgggcccgtcggggtcctcggtcccgtggtacgaacggtacttaccttcgtaggtgttgtacgtacgtaggacggcgggtcgtcgggacgaacgggcacgagtacgcnnngnnnnnnnnnnnnnnnnnnnnnnnnn

SEQ ID NO: 238410 - DNA, 520 bp, Homo sapiens
  misc_feature: GYAE6OF01C2GYI.33.60.F05.1.454.CMB.1.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (496)..(520): a, c, t, g, unknown or other
  misc_feature (496)..(520): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctccaggctcctcatccatggtgcatcccaccgagggccactggcatcccagacaggttcagtggcaggtgggtctggggacagacttcattcnaccatcagcagcgtggacncctgaagtnttttgctagttgttattactgtnagctaggtacggtagttcntcctccgtacgttcggacgaacggacgaaggtaggaaactacgaaacgtaacgtggtcggacgttacgaccaccattacttcgttaccttctactttcctccccgtctacttcgtacggtaacgttgttacggttcgttacgtagggtacgggccggggttacgtacgggtaaccgaacggggtccgacggtaacgtagtgcnnnnnnnnnnnnnnnnnnnnnnnnn

SEQ ID NO: 238411 - DNA, 525 bp, Homo sapiens
  misc_feature: GYAE6OF01B8BLM.33.60.F05.1.454.CMB.1.raw
  modified_base (499)..(499): a, c, t, g, unknown or other
  misc_feature (499)..(499): n is a, c, g, or t
  modified_base (501)..(525): a, c, t, g, unknown or other
  misc_feature (501)..(525): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatcccaccagggccactggcatcccagacaggttcagtggcaggtggggtctgggacagcttcattctcaccatcagcagactggagcctgaagtattttgctagtgttattactgtcgagactaggttacggttagttctacttccgtccgtaccggttccggaccggaaagggacctaagggtaggaaaacgtaccgaaacgtacgtaggtcggtactacggaccacctattcctttcgttaccttactacgttcccttaccccgcctactccgttagtaagttcggttagtacgtttaacgtggacgggcgggtacgtcgggacacgggtcacgagtagcgngnnnnnnnnnnnnnnnnnnnnnnnnn

SEQ ID NO: 238412 - DNA, 739 bp, Homo sapiens
  misc_feature: GYAE6OF01C6IOB.33.60.F05.1.454.CMB.1.raw
  modified_base (158)..(158): a, c, t, g, unknown or other
  misc_feature (158)..(158): n is a, c, g, or t
  modified_base (598)..(598): a, c, t, g, unknown or other
  misc_feature (598)..(598): n is a, c, g, or t
  modified_base (682)..(682): a, c, t, g, unknown or other
  misc_feature (682)..(682): n is a, c, g, or t
  modified_base (684)..(684): a, c, t, g, unknown or other
  misc_feature (684)..(684): n is a, c, g, or t
  modified_base (688)..(688): a, c, t, g, unknown or other
  misc_feature (688)..(688): n is a, c, g, or t
  modified_base (691)..(691): a, c, t, g, unknown or other
  misc_feature (691)..(691): n is a, c, g, or t
  modified_base (702)..(702): a, c, t, g, unknown or other
  misc_feature (702)..(702): n is a, c, g, or t
  modified_base (704)..(704): a, c, t, g, unknown or other
  misc_feature (704)..(704): n is a, c, g, or t
  modified_base (717)..(717): a, c, t, g, unknown or other
  misc_feature (717)..(717): n is a, c, g, or t
  modified_base (719)..(719): a, c, t, g, unknown or other
  misc_feature (719)..(719): n is a, c, g, or t
  modified_base (721)..(721): a, c, t, g, unknown or other
  misc_feature (721)..(721): n is a, c, g, or t
  modified_base (726)..(726): a, c, t, g, unknown or other
  misc_feature (726)..(726): n is a, c, g, or t
  modified_base (728)..(728): a, c, t, g, unknown or other
  misc_feature (728)..(728): n is a, c, g, or t
  modified_base (730)..(732): a, c, t, g, unknown or other
  misc_feature (730)..(732): n is a, c, g, or t
  modified_base (734)..(734): a, c, t, g, unknown or other
  misc_feature (734)..(734): n is a, c, g, or t
  modified_base (736)..(736): a, c, t, g, unknown or other
  misc_feature (736)..(736): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggcctcccgaggctccctcactccagtggtncactcccacgagggcccactggcactccccgagacgtagggttccaggtcggacagggtcgggtcgtagggacctaagtaccttctatttccaccgacccgattacacggtcaaggaccgttagggacgcctaagtaaggttattttacggactaggttaagttactttacgtcgtacgtaagtaccgtaagggttaaccggttagtttaccgtaacgttaccccgtacccggttaaccgggtttaccgggaaacccggtaaacgggaaaccggtaaacgggtaaacggtaaaaacttaacccggaaaaacggttaccggttaggtaacggtccgttaacggacccgtaactacgtttacggttaccgtttccttaaccgtaccttcccccgttacccgaccgtttacgtaccgttaagggttacgtttcgggtttaaanccgggtttaaccgtggggtaaccgtcgggttaacggtacggggaaccgtaacggccgttaaacggtactagggtcagacgtacngnctanagngtgcgagtacncntacgctctacagnanancacgngncnnncngngtg

SEQ ID NO: 238413 - DNA, 605 bp, Homo sapiens
  misc_feature: GYAE6OF01CWJGO.33.60.F05.1.454.CMB.1.raw
  modified_base (550)..(550): a, c, t, g, unknown or other
  misc_feature (550)..(550): n is a, c, g, or t
  modified_base (555)..(555): a, c, t, g, unknown or other
  misc_feature (555)..(555): n is a, c, g, or t
  modified_base (563)..(564): a, c, t, g, unknown or other
  misc_feature (563)..(564): n is a, c, g, or t
  modified_base (567)..(568): a, c, t, g, unknown or other
  misc_feature (567)..(568): n is a, c, g, or t
  modified_base (570)..(571): a, c, t, g, unknown or other
  misc_feature (570)..(571): n is a, c, g, or t
  modified_base (573)..(573): a, c, t, g, unknown or other
  misc_feature (573)..(573): n is a, c, g, or t
  modified_base (578)..(581): a, c, t, g, unknown or other
  misc_feature (578)..(581): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (594)..(596): a, c, t, g, unknown or other
  misc_feature (594)..(596): n is a, c, g, or t
  modified_base (598)..(598): a, c, t, g, unknown or other
  misc_feature (598)..(598): n is a, c, g, or t
  modified_base (600)..(601): a, c, t, g, unknown or other
  misc_feature (600)..(601): n is a, c, g, or t
  modified_base (603)..(603): a, c, t, g, unknown or other
  misc_feature (603)..(603): n is a, c, g, or t
tcagtacacacactcacgaccggtgctcgatttagtacgtcatcagggggaaagggccaccctctcttgtagggccagtcagagtgttagcagcaactacttagcctggtaccagcagacacctggccaggctcccaggctcctcatccatggtgcatccaccgagggccactggcactcccagacaggttcagtgcaggtgggtctgggacagtaccttcattcctcaccatcgagacagacgtgggacgacctaggtaacgtagttttgcgtagttgttaatttacgtgtacagtacgtacggtaacggttagttactacgtccgttccggttaccggttaccgggaccgtaaacgggacccgtaaagggtaacggaaaactaccgaaaaccgtaagtcggtacggactacgaccaacgtattcgttcgttaccttaccgtacttcccgttacccgacctacttacgtacggttacgttggttaggtttcgtacgtacgggacgggtacgggtcgtagggtaccggtaaggtccgaacgtagtacggntcganacgtgatnntanntnncngagannnnagnanananacannnananntnta

SEQ ID NO: 238414 - DNA, 540 bp, Homo sapiens
  misc_feature: GYAE6OF01CEO64.33.60.F05.1.454.CMB.1.raw
  modified_base (261)..(261): a, c, t, g, unknown or other
  misc_feature (261)..(261): n is a, c, g, or t
  modified_base (507)..(508): a, c, t, g, unknown or other
  misc_feature (507)..(508): n is a, c, g, or t
  modified_base (510)..(540): a, c, t, g, unknown or other
  misc_feature (510)..(540): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatcccaccgagggccactggcactcccagacaggttcaggtggcaggtgggtctaggggacagaccttcattctccaccatccagcagactgggacgcctagaagtnttttagctaggttgttattacgtgtacagcgtaggttacggtagttcagttccgtaccggtacggttccggaaccggaacggggaaccgaaagggtaggaaaactacaaaacggtacgtgggtacggtctcgtaccacctagttcctaggttccttctacttcccgttacccgctatcgtagtacgttgtagttacgtacgtaggtacgggcgggtcgtacggacggacggctacggtaagtacgnngnnnnnnnnnnnnnnnnnnnnnnnnnnnnnnn

SEQ ID NO: 238415 - DNA, 676 bp, Homo sapiens
  misc_feature: GYAE6OF01CU6GB.33.60.F05.1.454.CMB.1.raw
  modified_base (583)..(583): a, c, t, g, unknown or other
  misc_feature (583)..(583): n is a, c, g, or t
  modified_base (590)..(590): a, c, t, g, unknown or other
  misc_feature (590)..(590): n is a, c, g, or t
  modified_base (601)..(601): a, c, t, g, unknown or other
  misc_feature (601)..(601): n is a, c, g, or t
  modified_base (604)..(604): a, c, t, g, unknown or other
  misc_feature (604)..(604): n is a, c, g, or t
  modified_base (609)..(609): a, c, t, g, unknown or other
  misc_feature (609)..(609): n is a, c, g, or t
  modified_base (616)..(616): a, c, t, g, unknown or other
  misc_feature (616)..(616): n is a, c, g, or t
  modified_base (623)..(623): a, c, t, g, unknown or other
  misc_feature (623)..(623): n is a, c, g, or t
tcagtacacacactcacgaccggtgctcgatttagtacgtcatcagggaaagggccacccgtctcttgtagggccagtcagagtgttagcagcaactacttagcctcggtaccagcacgacacctggccaggcctccaggctcctcatcccatggtcgcactccaccgagggcccacgtcggcactccccgagaccgtaggttcaggtcggcgtagggtgggtccgtggggacctaggacttcgtacttcctcaccgataccgagaccgaaacgtaccgtaggggtacctccgttaggaacgttagtttcggaacgtaacggttaggttaccttaacgtcggttaccgacgtcgtacgggttaccggttattaccgtactcgtaacccggttcggtaccgggaacgacggaaccgtaggtaacggaccttaacggaaacggaccgttgacggtactacgacgtaactgtctacgttctacctacgttcgtaccccggacttacgtccgttaaggtcgttacgtgtttacggacgttggaaccggtcggtaccggaggtaaccgtcggacggtactacggtagngtacgcnggtcaggtccngcntagtnacgtgcncgtaacncgtatcgccgtatcggaacgtcgacgtacgtcgtctccgaagtcgtgtcgtcg

SEQ ID NO: 238416 - DNA, 502 bp, Homo sapiens
  misc_feature: GYAE6OF01D7CNV.33.60.F05.1.454.CMB.1.raw
  modified_base (142)..(142): a, c, t, g, unknown or other
  misc_feature (142)..(142): n is a, c, g, or t
  modified_base (152)..(152): a, c, t, g, unknown or other
  misc_feature (152)..(152): n is a, c, g, or t
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (472)..(502): a, c, t, g, unknown or other
  misc_feature (472)..(502): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctccaggctcctnatccatggtncatccaccagggccactggacatcccagacaggttcagtggctagtgggtctgggacagacttcattcncacntcagcagctgagctagagtattttgctagtgttattatgttcaagtctagttacggtgttcacttccgtccggtacgtttccgggacgtaacgggaaccgtaaagggtaggtaaaactcgtaaaaacgacgttggtacgcacgaccacctattcgtattcgtctacttccctacccgtctaattccgtagtaagttgtgttacgtactgacgggccggtgtaggacgacggctacgtagtagatcgnnnnnnnnnnnnnnnnnnnnnnnnnnnnnnn

SEQ ID NO: 238417 - DNA, 675 bp, Homo sapiens
  misc_feature: GYAE6OF01A4VZJ.33.60.F05.1.454.CMB.1.raw
  modified_base (567)..(567): a, c, t, g, unknown or other
  misc_feature (567)..(567): n is a, c, g, or t
  modified_base (577)..(577): a, c, t, g, unknown or other
  misc_feature (577)..(577): n is a, c, g, or t
  modified_base (589)..(589): a, c, t, g, unknown or other
  misc_feature (589)..(589): n is a, c, g, or t
tcagtacacacactcacgaccggtgctcgatttagtacgtcatcaggggaaagggccgacccgtcgtcgttgtagggccagtcagagtgttagcagcaactacttagcctggtaccagcagacacctgccaggctccaggctcctcgatccagtcggtgctatccaccaggccactggcactcccagcgaggttcaggtggcagtcggtctgggacagaccttcgacttcacaccatccgagcagtacgtcgggtacggtacccttagaaacgttatttttacggaccgtaaggttacggttaacttaaccgtagttaccaggtaccgtaacggttaacccggttacgtttaccagttcccggtaccggtacggtttacggacccgtaaagggtaacccgaagggttacggtaaactacgaaaacggtaactggtacggtactcgacgtacctagtcgtacggttactcgtacctccgttacccgacctacttccgtagtaacgttcggtagttaccggtaactaggacgcggtacgtaggttaacgaaggtccgaagtaatacggntacgcgtacngtactagactcngtactgtacacggtctacggacgacgtacgaccgacgttacgactacgtagtacgtcgacgtccgtacggagtccgtacgtcggcg

SEQ ID NO: 238418 - DNA, 533 bp, Homo sapiens
  misc_feature: GYAE6OF01BA2RW.33.60.F05.1.454.CMB.1.raw
  modified_base (231)..(231): a, c, t, g, unknown or other
  misc_feature (231)..(231): n is a, c, g, or t
  modified_base (504)..(504): a, c, t, g, unknown or other
  misc_feature (504)..(504): n is a, c, g, or t
  modified_base (506)..(507): a, c, t, g, unknown or other
  misc_feature (506)..(507): n is a, c, g, or t
  modified_base (509)..(533): a, c, t, g, unknown or other
  misc_feature (509)..(533): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggcctcccaggctcctcatccatggtgcatccaccgagggccacgtggcactcccagccaggttcagtggcaggtggtctggacagcttcactctcacatcgancagtccgtagcgctagtaacgtattttgacttagttttattacgtcgtcaagctaggtcgtaacgtcgaacgttggtcttcgggtaccgttacggaccggtaaggtaacggtaacgggtaggaaaacgtacgaaaaccggtaacggtgtcggactcggacctactagtccgtcgttactaacgtctttacccctccgtaccgtattcgttacggtaattcggttgtacgtacgtggtacggcgggtactagggacctacgggcgataacggtngnngnnnnnnnnnnnnnnnnnnnnnnnnn

SEQ ID NO: 238419 - DNA, 603 bp, Homo sapiens
  misc_feature: GYAE6OF01EA9MI.33.60.F05.1.454.CMB.1.raw
  modified_base (220)..(220): a, c, t, g, unknown or other
  misc_feature (220)..(220): n is a, c, g, or t
  modified_base (439)..(439): a, c, t, g, unknown or other
  misc_feature (439)..(439): n is a, c, g, or t
  modified_base (573)..(603): a, c, t, g, unknown or other
  misc_feature (573)..(603): n is a, c, g, or t
tcagtacacacactcacgaccggtgctcgatttagtacgtcatcagggaaagggccaccctctcttgtagggccagtcagagtgttagcagcaactacttagcctggtaccagcagaccacctggccaggctcccaggctcctcatccatggtgcatccaccagggccactggcatccccagacaggttcagtggcaggtgggtctgggacagtaccttnattcaccaccatcagcagacgtggacgcctgtaagtatttttggactaggttcgttaatttacgttcgttactaggtaccgtaacgggtttacgggttaagtttcctaacgttccggttcccggtaccgggtttacccggaaccgggaacgggtaaccgtaaagggtaacggaaaataccgaaaacgtacgtggtcggactcggacaccgtattccgtntaccttacgtacttccccgttacccactacggttcgttaacgtaaggtttgttacggttacgttaccggtaggtaccgggggtaccgggttacgtaccggggaaccggtaccgggacggtacacggttaggcannnnnnnnnnnnnnnnnnnnnnnnnnnnnnn

SEQ ID NO: 238420 - DNA, 649 bp, Homo sapiens
  misc_feature: GYAE6OF01EJJ3Z.33.60.F05.1.454.CMB.1.raw
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
  modified_base (568)..(568): a, c, t, g, unknown or other
  misc_feature (568)..(568): n is a, c, g, or t
  modified_base (639)..(639): a, c, t, g, unknown or other
  misc_feature (639)..(639): n is a, c, g, or t
tcagtacacacactcacgaccggtgctcgattttagtacgtcatcagggaaagggccaccctctcttgtagggccagtcagagtgttagcagcaactacttagcctggtaccagcagacacctggccaggctcccaggctcctcatccatggtgcactccaccagggccactggcatcccagccaggttcagtggcagtgggtctcgggacagacttcactctcgaccatcagcagcctagacncctgacggtattctgactagttttataatcgtgaacnccaagtcgtctacgaacttcgggcctccggttgacctaccgttcggaaccgaaaggggtacctaacggtagttagggataacgtttaaacggccgtaaaaccgtttggtaccgggactttaccggccctaaacccggtttctttaaccgttactttcccggaaacctttcccgtttaccccgggaccctagtttaccggtaggtaaaccgtttggtttaccgtaagttacggtacggtacgggaccggtcgttaacggacgacggggtctaaccggttagaacggtnaagtacgtagactcgtagtcgtactagtacgacgcacgctatacgtagtagacgtcagacgactacgacancgtgtcgacg

SEQ ID NO: 238421 - DNA, 614 bp, Homo sapiens
  misc_feature: GYAE6OF01B8TOD.33.60.F05.1.454.CMB.1.raw
  modified_base (570)..(570): a, c, t, g, unknown or other
  misc_feature (570)..(570): n is a, c, g, or t
  modified_base (575)..(575): a, c, t, g, unknown or other
  misc_feature (575)..(575): n is a, c, g, or t
  modified_base (583)..(584): a, c, t, g, unknown or other
  misc_feature (583)..(584): n is a, c, g, or t
  modified_base (586)..(586): a, c, t, g, unknown or other
  misc_feature (586)..(586): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (594)..(595): a, c, t, g, unknown or other
  misc_feature (594)..(595): n is a, c, g, or t
  modified_base (597)..(600): a, c, t, g, unknown or other
  misc_feature (597)..(600): n is a, c, g, or t
  modified_base (602)..(603): a, c, t, g, unknown or other
  misc_feature (602)..(603): n is a, c, g, or t
  modified_base (607)..(608): a, c, t, g, unknown or other
  misc_feature (607)..(608): n is a, c, g, or t
  modified_base (610)..(612): a, c, t, g, unknown or other
  misc_feature (610)..(612): n is a, c, g, or t
  modified_base (614)..(614): a, c, t, g, unknown or other
  misc_feature (614)..(614): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatcccaccagggccatggcatcccagacaggttcagtgcaggtgggctgggacagacttcattcctcaccatccgagcagactggacgtccgtgaagttacgttttgactaggttagttactttactcgtacgagtaccgtaaggtacggttagtctaacgttccgtaccggtaccggttccggaaccggaaagggtaccgtaaagggtacggaaaactaccgaaaacgtacgttagtacggtcctaagaccctaacgtacgttcttacgttaccttaacgaccgtttacccgttaccccgtaccttacgttacgtacgttaaacggttcgttcggtaacggttaccgttagggacgggtacccgggtggtacggaacgtaagggtaccgagtaacgtgactcgtacgactacgcngtaancgagtacnngntcngnagnngnnnncnngacnnannngn

SEQ ID NO: 238422 - DNA, 460 bp, Homo sapiens
  misc_feature: GYAE6OF01ERL40.33.60.F05.1.454.CMB.1.raw
  modified_base (249)..(249): a, c, t, g, unknown or other
  misc_feature (249)..(249): n is a, c, g, or t
  modified_base (339)..(339): a, c, t, g, unknown or other
  misc_feature (339)..(339): n is a, c, g, or t
  modified_base (431)..(431): a, c, t, g, unknown or other
  misc_feature (431)..(431): n is a, c, g, or t
  modified_base (433)..(460): a, c, t, g, unknown or other
  misc_feature (433)..(460): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagcctgaagtnttttgcagtgtattactgtacagcagtacggtattcattcgtccggacgttcggccgtaagggaccaaggtggaaatacaaacgaactgnggactgacacatcgtgtctcactcctcccgcatcgtagagtgttgtacgtacgtggacggcgggcgtacggacgaacgggcgacaacgtagngnnnnnnnnnnnnnnnnnnnnnnnnnnnn

SEQ ID NO: 238423 - DNA, 484 bp, Homo sapiens
  misc_feature: GYAE6OF01API6J.33.60.F05.1.454.CMB.1.raw
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
  modified_base (458)..(460): a, c, t, g, unknown or other
  misc_feature (458)..(460): n is a, c, g, or t
  modified_base (463)..(484): a, c, t, g, unknown or other
  misc_feature (463)..(484): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccgagggccactggcatcccagacaggttcagtggcaggtgggtctgggacagacttcactctcaccatcagcagcctagacgcctagaatacttttgacttagtttattactgtctcgcagcgtagactaaccgtgacctaacctaccgttcggaccgaagggccaacgactaggaactaacgttaaacgactggtcgctacgacacctattccgtagtcttactactccctaccgcctatcgtagtaagtgtgtcgtagtggnggtccggtntacgggcgacgggtacnctaagtgnnngtnnnnnnnnnnnnnnnnnnnnnn

SEQ ID NO: 238424 - DNA, 625 bp, Homo sapiens
  misc_feature: GYAE6OF01DNJE1.33.60.F05.1.454.CMB.1.raw
  modified_base (260)..(260): a, c, t, g, unknown or other
  misc_feature (260)..(260): n is a, c, g, or t
  modified_base (559)..(559): a, c, t, g, unknown or other
  misc_feature (559)..(559): n is a, c, g, or t
  modified_base (569)..(569): a, c, t, g, unknown or other
  misc_feature (569)..(569): n is a, c, g, or t
  modified_base (585)..(585): a, c, t, g, unknown or other
  misc_feature (585)..(585): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (604)..(604): a, c, t, g, unknown or other
  misc_feature (604)..(604): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (614)..(615): a, c, t, g, unknown or other
  misc_feature (614)..(615): n is a, c, g, or t
  modified_base (617)..(619): a, c, t, g, unknown or other
  misc_feature (617)..(619): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccgaggctcctcatccatggtgcactccaccgagggccactggcactcccagacaggttcagtggcagtgggtctgggacagtacttcattcctcaccatcagcaggtactggacgtctaggtaagtntttgctagtagttacttactggtcagcgacggtacgtagacctaacgttggttcgttagggtaccggttcggaaccggtaaacggggtaacctaaagggtacggtaaaactaacgaaaacgtaacgtaggtacggtacgtacgacccgtaactaacgtcgttacgtaccgtttacacgtttaccccgttaccccgtccgtaaacgttcgtaaggtaacggttcggttaggtttacggtaacgtcgggtacggtccggtcggttagggaaccgtaacggggcgtaaacgtacgtaacggngtgtagacgngcgactgtcgtcgtcncgtacgacgtgcncnctcngctncngntnntnnncngngn

SEQ ID NO: 238425 - DNA, 578 bp, Homo sapiens
  misc_feature: GYAE6OF01EFLXC.33.60.F05.1.454.CMB.1.raw
  modified_base (154)..(154): a, c, t, g, unknown or other
  misc_feature (154)..(154): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
  modified_base (516)..(516): a, c, t, g, unknown or other
  misc_feature (516)..(516): n is a, c, g, or t
  modified_base (538)..(538): a, c, t, g, unknown or other
  misc_feature (538)..(538): n is a, c, g, or t
  modified_base (545)..(545): a, c, t, g, unknown or other
  misc_feature (545)..(545): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
tcagtacacacactcacgaccggtgctcgattttagtacgtcatcagggaaagggccgaccctctcttgtaggccagtcagagtgttagcagccaactacttagcctggtaccagcagacacctgccaggctcccaggctcctcatccatggtncatccaccaggccactggcactcccagactaggttcagtgggacaggtcgggtctgggacagacttcgattctcacatcagcagactggagcctagaagtattttgcaggtgtacttctcgtcagctagtacgtagttcattccgtccgacgttccggaccaaacggcgaaggtacgaaactacgaaacgtagtcgtagacgtcgcgtacgtactcgtcgttacttccaacttcccttcccgacctacgttactacggtaagttcgttacgttacgtaacgtcggtacgggtacgggtaccgttagggtacgtaaccgggaccgttacgtaagttaccgngataacggtcncgtagcgacgngactgaccgacgtatacgtagngagaganacgtctagagcacgtactacacacatctntntc

SEQ ID NO: 238426 - DNA, 570 bp, Homo sapiens
  misc_feature: GYAE6OF01BUR63.33.60.F05.1.454.CMB.1.raw
  modified_base (156)..(156): a, c, t, g, unknown or other
  misc_feature (156)..(156): n is a, c, g, or t
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
  modified_base (523)..(523): a, c, t, g, unknown or other
  misc_feature (523)..(523): n is a, c, g, or t
  modified_base (532)..(532): a, c, t, g, unknown or other
  misc_feature (532)..(532): n is a, c, g, or t
  modified_base (537)..(538): a, c, t, g, unknown or other
  misc_feature (537)..(538): n is a, c, g, or t
tcagtacacacactcacgaccggtgctcgatttagtacgtcatcagggaaagggccaccctcgtcttgtagggccagtcagagtgttagcagcaactacttagcctggtaccagcagacacctggccaggcctcccaggctcctcatccaatggtncatcacaggccactggcactcccagacaggttcagtggcacggtggtctgggacaggacttcattctcaccatcaagcagactggacncctagaagtntttgcaacgtgtattactgtcagctagtacggtatcatcgtccgaacgttcggacgaagggaccaaggtacggaaactaacgaaacgaacgtgtcgcgtgaccacgtatctcgtaccttcacttaccgttccccatactcgtacggtaagttcgtggtagtaacctgggttaacggcgggtacgttagggtaacgaaacgggtccgtaacgttaacggaacgtcgganacgtanacagtagtactacgtcgtacgacgtacgactaganacacacganagcanncgtacgactacgtctacgacagtacgtcgtac

SEQ ID NO: 238427 - DNA, 479 bp, Homo sapiens
  misc_feature: GYAE6OF01DA95G.33.60.F05.1.454.CMB.1.raw
  modified_base (154)..(154): a, c, t, g, unknown or other
  misc_feature (154)..(154): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (444)..(445): a, c, t, g, unknown or other
  misc_feature (444)..(445): n is a, c, g, or t
  modified_base (448)..(457): a, c, t, g, unknown or other
  misc_feature (448)..(457): n is a, c, g, or t
  modified_base (459)..(479): a, c, t, g, unknown or other
  misc_feature (459)..(479): n is a, c, g, or t
tcagtacacacactcacgaccggtgctcgatttagtacgtcatcagggaaagggccaccctctcttgtaggccagtcagagtgttagcagcaactacttagcctggtaccagcagacacctggccaggcctcccaggcctcctcatccatggtncatcccacagggccactggcatcccagactaggttcagtggcagtgggtcctgggacagactttcatttcncaccctatcganctagactgggacncctgagattttgcctagtttattacngtcagtnagctaggccaactggtattcggacgttcggccaaagggaccaaggttggaaatcaaaacgactaggtgctgcaaccatgtcgtcttctatcctttcccgcctaattccgtagtaagtgtcgtgtaaccttggagaccggtgtacggacaaggcacgatagnnacnnnnnnnnnntnnnnnnnnnnnnnnnnnnnnn

SEQ ID NO: 238428 - DNA, 666 bp, Homo sapiens
  misc_feature: GYAE6OF01BFRH6.33.60.F05.1.454.CMB.1.raw
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
  modified_base (609)..(609): a, c, t, g, unknown or other
  misc_feature (609)..(609): n is a, c, g, or t
  modified_base (615)..(615): a, c, t, g, unknown or other
  misc_feature (615)..(615): n is a, c, g, or t
  modified_base (623)..(626): a, c, t, g, unknown or other
  misc_feature (623)..(626): n is a, c, g, or t
  modified_base (630)..(630): a, c, t, g, unknown or other
  misc_feature (630)..(630): n is a, c, g, or t
  modified_base (637)..(637): a, c, t, g, unknown or other
  misc_feature (637)..(637): n is a, c, g, or t
  modified_base (640)..(640): a, c, t, g, unknown or other
  misc_feature (640)..(640): n is a, c, g, or t
  modified_base (646)..(646): a, c, t, g, unknown or other
  misc_feature (646)..(646): n is a, c, g, or t
  modified_base (649)..(649): a, c, t, g, unknown or other
  misc_feature (649)..(649): n is a, c, g, or t
  modified_base (651)..(653): a, c, t, g, unknown or other
  misc_feature (651)..(653): n is a, c, g, or t
  modified_base (655)..(656): a, c, t, g, unknown or other
  misc_feature (655)..(656): n is a, c, g, or t
  modified_base (658)..(662): a, c, t, g, unknown or other
  misc_feature (658)..(662): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccacagggccactggcatcccagacagttcagtgcaggtcggtctggganagacttnatttctaccaccatccagcacgacctgggacgtaccgtagtaagtagtttttgaccgtaggttgttaactttcgtcgttaccaggtaccgaaggtttacggttacgtttacgacgtttcggtcccggttaaccggtttccgggaccgtaacggggaaccgtaaggggtaacgggtaaaacttaccgaaaaacggtaacctgggttacggaccgttacgactaaccgttacttccgggtttacttacctttacgttaaccgttacccgttccccggtactaaccgttacgttacggtaaccgtttggttacgtttacggtaaccgttgggaacccgggttcggggtaaccgttcgggaaaccggttacggggccctaaagggtttaccgtaaggcgngaacgngttagccnnnncgtncagcacncgngcgtgnagntnnnanncnnnnngngn

SEQ ID NO: 238429 - DNA, 508 bp, Homo sapiens
  misc_feature: GYAE6OF01B7K5X.33.60.F05.1.454.CMB.1.raw
  modified_base (365)..(365): a, c, t, g, unknown or other
  misc_feature (365)..(365): n is a, c, g, or t
  modified_base (475)..(508): a, c, t, g, unknown or other
  misc_feature (475)..(508): n is a, c, g, or t
tcagtacacacactcacgaccggtgctcgatttagtacgtcatcagggaaagggccaccctctcttgtagggccagtcagactgttagcagcggcttcttagcctggtaccagcagacacctggccaggctcccaggctcctcatccatggtgcatcccaccgagggccactggcactcccagactaggttcaggtggcaggtgggtccgtgggacagtacgttcattctacaccatcagcaagactgggacgcctagaagtattttgctagtagttattactgtacagctaaggtacggtagttcatccgtacgacgttcgaccgtaaggacaaggtacgaaaatcaaaacgtaagtggtacgntcgacacctagtctacgtcttcgacttcccgttaccgcctacgtcgtacggaagttgttacgttagtacgtgggacgccggggtcgtaggaactaaggctaacgagtagnnnnnnnnnnnnnnnnnnnnnnnnnnnnnnnnnn

SEQ ID NO: 238430 - DNA, 576 bp, Homo sapiens
  misc_feature: GYAE6OF01C5KRP.33.60.F05.1.454.CMB.1.raw
  modified_base (239)..(239): a, c, t, g, unknown or other
  misc_feature (239)..(239): n is a, c, g, or t
  modified_base (422)..(422): a, c, t, g, unknown or other
  misc_feature (422)..(422): n is a, c, g, or t
  modified_base (520)..(520): a, c, t, g, unknown or other
  misc_feature (520)..(520): n is a, c, g, or t
  modified_base (544)..(545): a, c, t, g, unknown or other
  misc_feature (544)..(545): n is a, c, g, or t
  modified_base (547)..(576): a, c, t, g, unknown or other
  misc_feature (547)..(576): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctccctcatccatggtgcatccaccgagggcccactggcactcccagaccaggttcagtggcaggttcgggtctgggacagcttccaccttctcacctatcngactacgaccctagacgccgtagaagttaactttttggacttaagttttactttactcggttctgacgcggacggtagtaccaacggttacggtacccctaaacgtaccccgtttccggggaaccgtaacggacaacggtacggtaacgggaagtaaacgttaaaaccgagttcgggtcggtntaccggtacaacctattcgttactccgtttacaccgtttcccttccccggcttaccgtgtacgtaggttcgtagttaccgtagtcggggaggtccggngtcggtacgaggtacactagacgnngnnnnnnnnnnnnnnnnnnnnnnnnnnnnnn

SEQ ID NO: 238431 - DNA, 491 bp, Homo sapiens
  misc_feature: GYAE6OF01BL0C9.33.60.F05.1.454.CMB.1.raw
  modified_base (462)..(462): a, c, t, g, unknown or other
  misc_feature (462)..(462): n is a, c, g, or t
  modified_base (465)..(491): a, c, t, g, unknown or other
  misc_feature (465)..(491): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtcgtgggacagaccttcatttctccaccatcagcagactggagcctagaagtattttgcagttgtagttactgtcaggactaggtacggtagttcatcctccgacgttcggaccgaacgggacgaaggtaggaaactacgaaaacgtacgtggtacggctagcactactcttgtacttcgacttccgttacccgctagtctaggtaagttgtgtacggtactggtacggtccgggcgtggacgaacgggactcgaagtagngtnnnnnnnnnnnnnnnnnnnnnnnnnnn

SEQ ID NO: 238432 - DNA, 467 bp, Homo sapiens
  misc_feature: GYAE6OF01CLXLT.33.60.F05.1.454.CMB.1.raw
  modified_base (442)..(467): a, c, t, g, unknown or other
  misc_feature (442)..(467): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctagaagtattttgctagtgttattactgtcagcagtacggttagtttcattctaccgacgttcgaccgaagggacaacggttgaaacttacaaaacgtaactgtacggctagacaccgtatctcgttcttcacttcgttacccgcaattccgtgtaagtgtgttgtacgtgagcgggtctaggctaagggcacgagtacgnnnnnnnnnnnnnnnnnnnnnnnnnn

SEQ ID NO: 238433 - DNA, 511 bp, Homo sapiens
  misc_feature: GYAE6OF01A6NS0.33.60.F05.1.454.CMB.1.raw
  modified_base (151)..(151): a, c, t, g, unknown or other
  misc_feature (151)..(151): n is a, c, g, or t
  modified_base (209)..(209): a, c, t, g, unknown or other
  misc_feature (209)..(209): n is a, c, g, or t
  modified_base (346)..(346): a, c, t, g, unknown or other
  misc_feature (346)..(346): n is a, c, g, or t
  modified_base (466)..(467): a, c, t, g, unknown or other
  misc_feature (466)..(467): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (476)..(478): a, c, t, g, unknown or other
  misc_feature (476)..(478): n is a, c, g, or t
  modified_base (481)..(481): a, c, t, g, unknown or other
  misc_feature (481)..(481): n is a, c, g, or t
  modified_base (483)..(488): a, c, t, g, unknown or other
  misc_feature (483)..(488): n is a, c, g, or t
  modified_base (490)..(495): a, c, t, g, unknown or other
  misc_feature (490)..(495): n is a, c, g, or t
  modified_base (497)..(508): a, c, t, g, unknown or other
  misc_feature (497)..(508): n is a, c, g, or t
  modified_base (510)..(511): a, c, t, g, unknown or other
  misc_feature (510)..(511): n is a, c, g, or t
tcagtacacacactcacgaccggtgctcgatttagtacgtcatcagggaaggggcgtggagtgggtcgcaactattagtggcggtggaactcatacatactacgccgactccgtgaagggccgcttcaccatctccagagacaattccaanaacacggtgtttctgcaaatgaatagcctgagagtcgaggacatggccatatattacnggtgcgagagttagcaggtggctggtatcctttctccagcacgttggggcctaggggtaccctggtccaccgttctcctcagccctcaccgaggcccatccggtccttccccgtggccgccctgcctccgagggacncacccgtccgagcgcacagccgacccgtggcgtcgccgtggacaacgggacttccttcccgaggttcgtcgttactacgtgacggccgggatagggtacgaacgggcgaccgattacggnngtancngcnnncangnnnnnngnnnnnngnnnnnnnnnnnngnn

SEQ ID NO: 238434 - DNA, 480 bp, Homo sapiens
  misc_feature: GYAE6OF01D7OOF.33.60.F05.1.454.CMB.1.raw
  modified_base (348)..(348): a, c, t, g, unknown or other
  misc_feature (348)..(348): n is a, c, g, or t
  modified_base (447)..(447): a, c, t, g, unknown or other
  misc_feature (447)..(447): n is a, c, g, or t
  modified_base (452)..(480): a, c, t, g, unknown or other
  misc_feature (452)..(480): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatccccagacaggttcagtggcagtggggtctggggacagacttcattctcaccatcagcagactggacgcctgaagtattttgctagtgtattactgtcagcagttacggtagtttcattccgtccgacgttcggaccgaagggaccaaggtagaaactacgaaacgaactggngctgacacatctgtccttcatccttcccgctattctagtaagttgtggtcgtacgtggacgggtcgggtcgtacggacgaacgggcgtactagtagcgntcgannnnnnnnnnnnnnnnnnnnnnnnnnnnn

SEQ ID NO: 238435 - DNA, 674 bp, Homo sapiens
  misc_feature: GYAE6OF01AXFSB.33.60.F05.1.454.CMB.1.raw
  modified_base (594)..(594): a, c, t, g, unknown or other
  misc_feature (594)..(594): n is a, c, g, or t
  modified_base (601)..(601): a, c, t, g, unknown or other
  misc_feature (601)..(601): n is a, c, g, or t
  modified_base (616)..(616): a, c, t, g, unknown or other
  misc_feature (616)..(616): n is a, c, g, or t
  modified_base (624)..(624): a, c, t, g, unknown or other
  misc_feature (624)..(624): n is a, c, g, or t
  modified_base (639)..(639): a, c, t, g, unknown or other
  misc_feature (639)..(639): n is a, c, g, or t
  modified_base (664)..(664): a, c, t, g, unknown or other
  misc_feature (664)..(664): n is a, c, g, or t
  modified_base (668)..(668): a, c, t, g, unknown or other
  misc_feature (668)..(668): n is a, c, g, or t
  modified_base (671)..(671): a, c, t, g, unknown or other
  misc_feature (671)..(671): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgccatccgaccagggccacgtggcatcccagacctaggttcagtggctaggtgggtctgggacagacttcacctctacaccatcagcagctagacgtctagaagtattttacggacttagttttattaacgtgtcctagtactacggttacgttagttcaacgttccgtaccggtacgttacggacccgtaaaggggacctaaggtacggtaaattaccggaaaacgaccgttggtacgggtctacggtaccaaccgtattccgttaggtacccgttacgtaaccgtttccccgttaccccgtaccgtaaactttccgttaacggtaaggtttaccgtttaaccggtacggtaacgggggtaccggttaccggttaccggggaccttaaaccggggtccgtaaccgtaaaggtttcgacggttcgagtcgtataggaacctnaccgggntacgtgacgacggtnacacgtanagcgtagatctacgngacgcgtcgacggacgacgtacganatcncgngcg

SEQ ID NO: 238436 - DNA, 541 bp, Homo sapiens
  misc_feature: GYAE6OF01BRA6E.33.60.F05.1.454.CMB.1.raw
  modified_base (141)..(141): a, c, t, g, unknown or other
  misc_feature (141)..(141): n is a, c, g, or t
  modified_base (151)..(151): a, c, t, g, unknown or other
  misc_feature (151)..(151): n is a, c, g, or t
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (370)..(370): a, c, t, g, unknown or other
  misc_feature (370)..(370): n is a, c, g, or t
  modified_base (439)..(439): a, c, t, g, unknown or other
  misc_feature (439)..(439): n is a, c, g, or t
  modified_base (458)..(458): a, c, t, g, unknown or other
  misc_feature (458)..(458): n is a, c, g, or t
  modified_base (492)..(492): a, c, t, g, unknown or other
  misc_feature (492)..(492): n is a, c, g, or t
  modified_base (515)..(515): a, c, t, g, unknown or other
  misc_feature (515)..(515): n is a, c, g, or t
tcagtacacacactcacgaccggtgctcgatttagtacgtcatcagggaagggccaccctctcttgtagggccagtcagagtgttagcagcaactacttagcctggtaccagcagacacctggccaggctccaggctcctnatccatggtncatccaccagggccatggcatcccagcaggttcagtgcagtgggctgggacngacttcattcncgaccatcagcagacctggactcctgaagtagttttcgcaggtgtacttacgtgtcagtcagttacggacgttcatcgtaccgacgttcggaccaaggggaccaagggttcggaaattccgaaacgtactgtcgctagaccactatccgtgtcttnactccttcccgctatcctagactgtcgtgtactggacgcgggtctacggctaacggcgagtacgtacgngaccagtcacgtgactcgntacgctacgagtcgtacgcgtacgagttacccgngtagtacgtacgtcagttaccgntacccgtagtcaacggtctacgtgtc

SEQ ID NO: 238437 - DNA, 679 bp, Homo sapiens
  misc_feature: GYAE6OF01ERUJ7.33.60.F05.1.454.CMB.1.raw
  modified_base (145)..(145): a, c, t, g, unknown or other
  misc_feature (145)..(145): n is a, c, g, or t
  modified_base (598)..(598): a, c, t, g, unknown or other
  misc_feature (598)..(598): n is a, c, g, or t
  modified_base (630)..(630): a, c, t, g, unknown or other
  misc_feature (630)..(630): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (642)..(642): a, c, t, g, unknown or other
  misc_feature (642)..(642): n is a, c, g, or t
  modified_base (651)..(651): a, c, t, g, unknown or other
  misc_feature (651)..(651): n is a, c, g, or t
  modified_base (675)..(675): a, c, t, g, unknown or other
  misc_feature (675)..(675): n is a, c, g, or t
tcagtacacacactcacgaccggtgctcgattttagtacgtcatcagggaaagggccaccctctcttgtagggccagtcagagtgttagcagcaactacttagcctggtaccagcagacaccgtggccaggcctcccaggctccncatccagtggtcgcactcccaccgacgggccacgtggcactcccgagacgtaggttcgaggtggcgtaggtgggtcgtagggacacggtaccttcattctcacctatcgacgcaaggtacgtggacgtccgttaggtaacgttacgttttcggaccgttaggtttacgttaacttacgtcgttacgacggtcgtaacgggttacggttacgttcgacgttccggtaccggttacggttaccggaccggaacgggtaccgtaagggttaacgtaaactaccgtaaacggtacgtaggtcgtacgtacgacctaccgtagttacgtcgttaccttacgtaccggtttcccctacccggtacttaacgttacgtacggtaacgtttcggttacgttacgtacggtcggaaccggggtcggtacgtacgggaaccgtacgggtactacggtagcggntacgtcgagctggacacgtgacgtcgacctgntacgntntgtgngcgtcgtanagtgtacatacgtactatatctgngtcg

SEQ ID NO: 238438 - DNA, 947 bp, Homo sapiens
  misc_feature: GYAE6OF01EZ0QT.33.60.F05.1.454.CMB.1.raw
tcagtacacacactcacgaccggtgctcgatttagtacgtcatcagggaaaggggccacccgtctcttgtagggccagtcagagtgttagcagcaactacgttagcctggccaggtgtcctgctggtaccaggctcccaggctcctcgactccagtggtcgcactccaaccgagggtcccacgtggcctacgtccccagactaggttcaggttggcgtaggtggggtcttcggggactacggtaccttcgacttaccaccacccgacgtaccgacggtccaaggttaccgttagggtaaccgtccgtaggtaacggttacgttttacggaaccgtaacggttacgtttaactttaacggtccgtttaaccaaccgggtacgttaaccgggtttaaccgggttacggtttaccgtaaccgtttcccggttaaccccgggttaccgggttttaccccggggaacccggtaaacgggggtaaccccgttaaacggggttaaccgggtaaaaccgttaacccggtaaaaaccggttaccggttacggggttaccgggtacccgttaccggaccccgtaaacccggttaccggtttacccggtttaccggttttacccgttacccgttaaccgttttacccccggtttacccccgtaaccgttaaccgtttaccggttaacgggttaacggtttacggttacgggtttaacccggttaacgggtacgggtaccgggggtccccgggtacgggttacggggtaccgggttaaacggggtcccgtaaacgggtaacggttacggcgtacggtacgtagacggtactcggacgacgacgtaccggtcgtacgtaccgtcgttaccgtaccgacggttacccgtaggttccggtcgtacccgtaggtttcgggacctaccggacgttaccgggactacggtacgtcgtccggtacg

SEQ ID NO: 238439 - DNA, 632 bp, Homo sapiens
  misc_feature: GYAE6OF01BA55P.33.60.F05.1.454.CMB.1.raw
  modified_base (153)..(153): a, c, t, g, unknown or other
  misc_feature (153)..(153): n is a, c, g, or t
  modified_base (588)..(588): a, c, t, g, unknown or other
  misc_feature (588)..(588): n is a, c, g, or t
  modified_base (608)..(612): a, c, t, g, unknown or other
  misc_feature (608)..(612): n is a, c, g, or t
  modified_base (614)..(632): a, c, t, g, unknown or other
  misc_feature (614)..(632): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtncatcccaccgagggccactggcatccccagacaggttcagtggcaggtggtctgggacagtacttcattctcacatcagcagacgtggacgcctagaagtatttttggctaggttgttattactgtacagtccgtaggttacggttagttcatttccgtacccggtacggtttccggaccgaacggggtaaccgaaagggttacggaaaacttaccgaaaaacggtaacgtacgggtaggtaccgtcggtacctaaccgtacgtttccgtcggtttaccttaccgtaacttccccgtttaccccggaccttaacgttccgtacgggttaaacggttcggttacggttacggttaaccggtcgggaacgggttccggggtaccggttaacggggaaccggtaaccgggtaccggtacgtaaacggttaacgcgtgngtcgcgcgcgacgcgcgtgnnnnngnnnnnnnnnnnnnnnnnnn

SEQ ID NO: 238440 - DNA, 722 bp, Homo sapiens
  misc_feature: GYAE6OF01AGNX7.33.60.F05.1.454.CMB.1.raw
  modified_base (261)..(261): a, c, t, g, unknown or other
  misc_feature (261)..(261): n is a, c, g, or t
  modified_base (664)..(664): a, c, t, g, unknown or other
  misc_feature (664)..(664): n is a, c, g, or t
  modified_base (676)..(676): a, c, t, g, unknown or other
  misc_feature (676)..(676): n is a, c, g, or t
  modified_base (678)..(678): a, c, t, g, unknown or other
  misc_feature (678)..(678): n is a, c, g, or t
  modified_base (680)..(680): a, c, t, g, unknown or other
  misc_feature (680)..(680): n is a, c, g, or t
  modified_base (689)..(689): a, c, t, g, unknown or other
  misc_feature (689)..(689): n is a, c, g, or t
  modified_base (691)..(691): a, c, t, g, unknown or other
  misc_feature (691)..(691): n is a, c, g, or t
  modified_base (693)..(693): a, c, t, g, unknown or other
  misc_feature (693)..(693): n is a, c, g, or t
  modified_base (697)..(699): a, c, t, g, unknown or other
  misc_feature (697)..(699): n is a, c, g, or t
  modified_base (702)..(702): a, c, t, g, unknown or other
  misc_feature (702)..(702): n is a, c, g, or t
  modified_base (704)..(704): a, c, t, g, unknown or other
  misc_feature (704)..(704): n is a, c, g, or t
  modified_base (706)..(706): a, c, t, g, unknown or other
  misc_feature (706)..(706): n is a, c, g, or t
  modified_base (708)..(708): a, c, t, g, unknown or other
  misc_feature (708)..(708): n is a, c, g, or t
  modified_base (710)..(711): a, c, t, g, unknown or other
  misc_feature (710)..(711): n is a, c, g, or t
  modified_base (713)..(714): a, c, t, g, unknown or other
  misc_feature (713)..(714): n is a, c, g, or t
  modified_base (716)..(722): a, c, t, g, unknown or other
  misc_feature (716)..(722): n is a, c, g, or t
tcagtacacacactcacgaccggtgctcgatttagtacgtcatcaggggaaaggggccaccctctcttgtagggccagtcagagtggttagcagcaactacttagcctggtaccagcagacacctgggccaggctcccaggctcctcatccatggtgcatcccaccgagggccacgtggcatcccagagacgttcagtggcagtgggtcgtaggggacagacgttcacttctcgacccattccagtcaggtacgtgggacnccgtaggaacgtattttcgatacggtacgttaactttacgtggttacaacggtgtaagggtacgggttacgttacctaacgttcccgtacccggttaccgggtttcccgggaacccggtaaacgggggaaccccgtaaaggggttacgggtaaaaaccgttaccgtaaaaccccgggtaaaccgttcggggttaacggggtaccgttaccgggaacccgtacccggtacgtttacccgtttcggttaacccgttttcgtaacccgtttcccccgttttaccccgaccttacttaacgggttacgttaacggggtttggttaccgggtttacggtaccgttaacggggtacggggttaccccgggacgttcgggaacggtaacgggtcgaacgtaatacggganacgtcaaggtcncngngcgagtcgngngngagnnntangngngncnntnntnnnnnnn

SEQ ID NO: 238441 - DNA, 438 bp, Homo sapiens
  misc_feature: GYAE6OF01AI4B4.33.60.F05.1.454.CMB.1.raw
  modified_base (222)..(222): a, c, t, g, unknown or other
  misc_feature (222)..(222): n is a, c, g, or t
  modified_base (251)..(251): a, c, t, g, unknown or other
  misc_feature (251)..(251): n is a, c, g, or t
  modified_base (351)..(351): a, c, t, g, unknown or other
  misc_feature (351)..(351): n is a, c, g, or t
  modified_base (422)..(438): a, c, t, g, unknown or other
  misc_feature (422)..(438): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatcccaccagggccactggcatcccagacaggttcagtggcaggtgggtctgggacagacttcattcncaccatccagcagactggagcctgaagtnttttgcagtgtattactgtcagtctattacggtagtcatctccgtcgtcggaccgaacggacgaaggtagaatacgaacgaacgtgtacggtctgacacntctcgtctctcgtccttcccgcactctcgtagtgtgtgtacgtggacggtcggcgtggcgaggcgtcatgnnnnnnnnnnnnnnnnn

SEQ ID NO: 238442 - DNA, 501 bp, Homo sapiens
  misc_feature: GYAE6OF01EN31H.33.60.F05.1.454.CMB.1.raw
  modified_base (153)..(153): a, c, t, g, unknown or other
  misc_feature (153)..(153): n is a, c, g, or t
  modified_base (248)..(248): a, c, t, g, unknown or other
  misc_feature (248)..(248): n is a, c, g, or t
  modified_base (453)..(453): a, c, t, g, unknown or other
  misc_feature (453)..(453): n is a, c, g, or t
  modified_base (463)..(463): a, c, t, g, unknown or other
  misc_feature (463)..(463): n is a, c, g, or t
  modified_base (470)..(486): a, c, t, g, unknown or other
  misc_feature (470)..(486): n is a, c, g, or t
  modified_base (488)..(501): a, c, t, g, unknown or other
  misc_feature (488)..(501): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtncatccaccagggccactggcatcccagacaggttcagtggcagtgggtctgggacagacttcattctcaccatcagcagactggagcctgaagtnttttgcagttgtattactgtcagcaggttacgtagttctatcgtccggtacgtttcggaccaaggggaccaaggtacggaaaataccgaaaacgaactggtaggctggaccacctatctcgttcttcacttccctcccgacctatctaggtaagttcgtgttacgtacgtggacggtcgggacgttacgggacgaaggtccgtanaacgttagancgatcgnnnnnnnnnnnnnnnnngnnnnnnnnnnnnnn

SEQ ID NO: 238443 - DNA, 633 bp, Homo sapiens
  misc_feature: GYAE6OF01AT35P.33.60.F05.1.454.CMB.1.raw
  modified_base (573)..(573): a, c, t, g, unknown or other
  misc_feature (573)..(573): n is a, c, g, or t
  modified_base (595)..(595): a, c, t, g, unknown or other
  misc_feature (595)..(595): n is a, c, g, or t
  modified_base (600)..(600): a, c, t, g, unknown or other
  misc_feature (600)..(600): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggccagtgggtctgggacagacttcgattctcaccatcagcagtacttgacgtcctagaagtacttttcgactagtgtattacgtgtcagcgtagttacggttacgttcactccgtaccgtacggttccggaccgtaacgggtaccgaagggtacgaaactaccgtaaacggtaacgtggtcggtacttacgacctaccgtacgttcgtacggttaccttaccgtaccttcccgttaccccggtacctaacgttcgtaggtaacgttcggttacgttacgtaccgtggtaaccggtccggtacggttcgggaccgtaacgggtccgacggtaacgttacgagtacacggtacaccgtgactacgtacgcgatcgacgtaacnctgtcgtagcgtcgtcgtacgngtacncgtctagtacgtcgttacgacacgtcgtgtacg

SEQ ID NO: 238444 - DNA, 513 bp, Homo sapiens
  misc_feature: GYAE6OF01DIMLK.33.60.F05.1.454.CMB.1.raw
  modified_base (183)..(183): a, c, t, g, unknown or other
  misc_feature (183)..(183): n is a, c, g, or t
  modified_base (384)..(384): a, c, t, g, unknown or other
  misc_feature (384)..(384): n is a, c, g, or t
  modified_base (437)..(437): a, c, t, g, unknown or other
  misc_feature (437)..(437): n is a, c, g, or t
  modified_base (478)..(478): a, c, t, g, unknown or other
  misc_feature (478)..(478): n is a, c, g, or t
  modified_base (482)..(513): a, c, t, g, unknown or other
  misc_feature (482)..(513): n is a, c, g, or t
tcagtacacacactcacgaccggtgctcgattagtacgtcatcagggaaaggggctggagtgggtcgcaactattagtggcggtggaactcatacatactacgccgactccgtgaagggccgcttcaccatctccagagacaattccaacaacacggtgtttctgcaaatgaatagcctgagngtcgaggacatggccatatattactggtgcgagagttagcaggtggcttggtattccttttctccagcacgtggggccgacgggtaccctggtcctaccgtcctcctcacgcctccaccgaacggcccacgtccggtccctttccccgtcggcccgccctgcctccgaggacgccaccgtcgagcgcacacgccgtcccgnggtctcggtccgtcggacgaacgtacctacgttcgagttgtggtacttacggngacgggtcgggtcgtacggacggaacggccgagaacgtgangacnnnnnnnnnnnnnnnnnnnnnnnnnnnnnnnn

SEQ ID NO: 238445 - DNA, 417 bp, Homo sapiens
  misc_feature: GYAE6OF01CQQTQ.33.60.F05.1.454.CMB.1.raw
  modified_base (230)..(230): a, c, t, g, unknown or other
  misc_feature (230)..(230): n is a, c, g, or t
  modified_base (335)..(335): a, c, t, g, unknown or other
  misc_feature (335)..(335): n is a, c, g, or t
  modified_base (364)..(364): a, c, t, g, unknown or other
  misc_feature (364)..(364): n is a, c, g, or t
  modified_base (394)..(394): a, c, t, g, unknown or other
  misc_feature (394)..(394): n is a, c, g, or t
  modified_base (402)..(417): a, c, t, g, unknown or other
  misc_feature (402)..(417): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtgcagtgggtctgggacagacttcattctcaccatcagcngactggagcctgaagattttgctagtgtatactgtcaagcagtacgtgttcatctccgacgttcggccaaggccaaaggtggaaaatcgaaaacaacgtgtcggntcgcacgatctgtctcatcttccgcatcngaagtgtgtgtatgagcggctggcaaggcngactagcnnnnnnnnnnnnnnnn

SEQ ID NO: 238446 - DNA, 597 bp, Homo sapiens
  misc_feature: GYAE6OF01DXG41.33.60.F05.1.454.CMB.1.raw
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (570)..(571): a, c, t, g, unknown or other
  misc_feature (570)..(571): n is a, c, g, or t
  modified_base (573)..(597): a, c, t, g, unknown or other
  misc_feature (573)..(597): n is a, c, g, or t
tcagtacacacactcacgaccggtgctcgatttagtacgtcatcagggaaagggccaccctctcttgtagggccagtcagagtgttagcagcaactacttagcctggccaggtgtctgctggtaccaggcctcctcatccagtggtgcatcccaccgagggccacgtggcactcccagacgtaggttcaggtggcaggtgggtcgtgggacagtacttcactctcaccatcagcagcctagcgcctagaagtattttgctagtttattactgttactgacacggcgtacgaccaacggtcggaccctaacctacccgttaccggaccgaaacggggaacctacggacgtagggtaaacgtaagttaaaaacggaaccgttaggtcggtacctacggactaacccgtacgtttcgtaccggttaccttttaccaactttccccgttaccccgtacctaacgttacccggttaaggtaaacggtttcggtttacgggtcggtttaacgtacggggtaacggtccgggggtataacggggaaccggtaacgggcggactaaggtaacgngngnngnnnnnnnnnnnnnnnnnnnnnnnnn

SEQ ID NO: 238447 - DNA, 535 bp, Homo sapiens
  misc_feature: GYAE6OF01DDTTW.33.60.F05.1.454.CMB.1.raw
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
  modified_base (508)..(535): a, c, t, g, unknown or other
  misc_feature (508)..(535): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggancctagatatttgctagtntattactgtcagcagtacggtagtcatctccgtacgttccggacgaagggaccgtaaaggtggtaaaactacgaaaacggtaacgtggtaggccttaggacctaacccgtattcgttacggttcctttacctaacttcccgtttacccccgaccttagttaccgttagggtaagttcggtttaggttacggtttaccgttagggacgggtccggggtactacgggaacggacgggcgtaccgtagtacgnnnnnnnnnnnnnnnnnnnnnnnnnnnn

SEQ ID NO: 238448 - DNA, 654 bp, Homo sapiens
  misc_feature: GYAE6OF01BSNR3.33.60.F05.1.454.CMB.1.raw
  modified_base (153)..(153): a, c, t, g, unknown or other
  misc_feature (153)..(153): n is a, c, g, or t
  modified_base (617)..(617): a, c, t, g, unknown or other
  misc_feature (617)..(617): n is a, c, g, or t
  modified_base (623)..(627): a, c, t, g, unknown or other
  misc_feature (623)..(627): n is a, c, g, or t
  modified_base (629)..(629): a, c, t, g, unknown or other
  misc_feature (629)..(629): n is a, c, g, or t
  modified_base (631)..(650): a, c, t, g, unknown or other
  misc_feature (631)..(650): n is a, c, g, or t
  modified_base (652)..(654): a, c, t, g, unknown or other
  misc_feature (652)..(654): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtncatcccaccgagggccactggcatcccagacaggttcagtggcagtgggtctggggacagcttcattctcacccatcgacgcaggacctggacgtcctagtaagtatttttggacctaggttacgttaacgtttaacgttcggttactacggtacgtaacggggtttaacggttacggttttactaacgttccggttaccccggtacgggtttcccggggaacccaaaagggggtaaccccgtaaaaggggtttaacgggaaaaacgtttaacccaaaaaccgttaacgggttacggtacggggtaccttggaaccctaaccgtaacgttccggtcgttaccctttacgaccctttaccccgtccccggaccttactaccggttagtaacgggttgttacggtacggttacgtgggtaacgggtccgggtatacggggacctaacggggccaagtacgtacgtngtacgnnnnngntnnnnnnnnnnnnnnnnnnnnannn

SEQ ID NO: 238449 - DNA, 583 bp, Homo sapiens
  misc_feature: GYAE6OF01B8MIY.33.60.F05.1.454.CMB.1.raw
  modified_base (519)..(519): a, c, t, g, unknown or other
  misc_feature (519)..(519): n is a, c, g, or t
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
  modified_base (533)..(533): a, c, t, g, unknown or other
  misc_feature (533)..(533): n is a, c, g, or t
  modified_base (535)..(536): a, c, t, g, unknown or other
  misc_feature (535)..(536): n is a, c, g, or t
  modified_base (538)..(538): a, c, t, g, unknown or other
  misc_feature (538)..(538): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (557)..(557): a, c, t, g, unknown or other
  misc_feature (557)..(557): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (568)..(571): a, c, t, g, unknown or other
  misc_feature (568)..(571): n is a, c, g, or t
  modified_base (573)..(574): a, c, t, g, unknown or other
  misc_feature (573)..(574): n is a, c, g, or t
  modified_base (576)..(582): a, c, t, g, unknown or other
  misc_feature (576)..(582): n is a, c, g, or t
tcagtacacacactcacgaccggtgctcgatttagtacgtcatcagggaagggctggagtgggtcgcaactattagtggcggtggaactcatacatactacgccgactccgtgaaggccgcttcaccatctccagagacaattccaacaacacggtgtttctgcaaaatgaatagcctgagagtgaggacagtggccatatattactgtgcgagagaagtggaggggtagttggggacaacgtcggtccctttgactcgtgggcacgggacctggtccaccgtctcctcacgtccctccaccgacgggcccacgtccggttaccttccccccgtgggacccctaccctccctacccgaaaggaccgacctacccgtcggtcgggggccaccgaccgggccggtcccggtcgggtcctggcccgttcggtaaccgaacggtccttaacccgttctacgggttgttcggttagttacgtggacgggtcgggccgtgggtacgaacggccgactagtcgtanctancagngtacgngnncncgntncgtnacncngcacncacncntgtcnnnncnngnnnnnnng

SEQ ID NO: 238450 - DNA, 578 bp, Homo sapiens
  misc_feature: GYAE6OF01A6U6L.33.60.F05.1.454.CMB.1.raw
  modified_base (159)..(159): a, c, t, g, unknown or other
  misc_feature (159)..(159): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (544)..(544): a, c, t, g, unknown or other
  misc_feature (544)..(544): n is a, c, g, or t
  modified_base (554)..(578): a, c, t, g, unknown or other
  misc_feature (554)..(578): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggcctccgaggctccctacagtcccatgggtncatcccaccgagggcccactggcactcccagcgtaggttcagtggcctaggttggggtcctgggaccagtaccgtttnactttnaccacctaagtcaggtcagtaccngganccgtgaagtacttttgactaggttcgttagttaacctgtctaagtcgagttacgggtatctacgtcgtaccgtacggttccggacgtaacggaccgtaaggtaagaaacgtacgtaaaacgacgtaggtcggacgtaggacctaccgtaatccgtttggtcctttagacctttcccttacccgaccgttactccgttaacggttacgttggttacgttacgtaccgttagggacgttcgggccgttagggaaccgaacggtcgcgtaagtccngtagcaaggnnnnnnnnnnnnnnnnnnnnnnnnn

SEQ ID NO: 238451 - DNA, 672 bp, Homo sapiens
  misc_feature: GYAE6OF01D91ZX.33.60.F05.1.454.CMB.1.raw
  modified_base (207)..(207): a, c, t, g, unknown or other
  misc_feature (207)..(207): n is a, c, g, or t
  modified_base (563)..(563): a, c, t, g, unknown or other
  misc_feature (563)..(563): n is a, c, g, or t
  modified_base (608)..(608): a, c, t, g, unknown or other
  misc_feature (608)..(608): n is a, c, g, or t
  modified_base (631)..(631): a, c, t, g, unknown or other
  misc_feature (631)..(631): n is a, c, g, or t
tcagtacacacactcacgaccggtgctcgatttagtacgtcatcagggaagggccgaccctcgtctgtagggccagtcagagtgtagcagcaactacttagcctggtaccagcagacacctggccaggctcccaggctcctcatccatggtgcatccacaggccagtgcagtcccagacaggttcagtggcagtgggtctagggacngtacttcagttctacaccattcaggccagaccttggagccgtgaagtattttggactagtgttatacgtgttcagctaccgtggtagacaacgttcgggttactttacgggtaccgtttacgggcccgtaaaacgggtaccctaaaggggttaggaaaacttccgtaaaaacggtaaccttaagggttccgacgttacggtacctaaccccgtaagtccgttcgttccttaacccgtagttacccgtttcccgaccgtactttaccgaggtaaacggttcgttcgttaagtaacccgttgggtaaaccgggcgggttcctggggaaccttaaggggccccttaagacgtttaacgngcctaggacccttagctaaggcgttcaaatcgttgaaggcccttncgtaagtcgtagtccggaagtanacgttgaccagaacgttcgtaacgctcttacgggcgtaggg

SEQ ID NO: 238452 - DNA, 583 bp, Homo sapiens
  misc_feature: GYAE6OF01AX4P1.33.60.F05.1.454.CMB.1.raw
  modified_base (242)..(242): a, c, t, g, unknown or other
  misc_feature (242)..(242): n is a, c, g, or t
  modified_base (473)..(473): a, c, t, g, unknown or other
  misc_feature (473)..(473): n is a, c, g, or t
  modified_base (537)..(537): a, c, t, g, unknown or other
  misc_feature (537)..(537): n is a, c, g, or t
  modified_base (545)..(545): a, c, t, g, unknown or other
  misc_feature (545)..(545): n is a, c, g, or t
  modified_base (548)..(548): a, c, t, g, unknown or other
  misc_feature (548)..(548): n is a, c, g, or t
  modified_base (551)..(552): a, c, t, g, unknown or other
  misc_feature (551)..(552): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (561)..(563): a, c, t, g, unknown or other
  misc_feature (561)..(563): n is a, c, g, or t
  modified_base (565)..(566): a, c, t, g, unknown or other
  misc_feature (565)..(566): n is a, c, g, or t
  modified_base (569)..(569): a, c, t, g, unknown or other
  misc_feature (569)..(569): n is a, c, g, or t
  modified_base (571)..(578): a, c, t, g, unknown or other
  misc_feature (571)..(578): n is a, c, g, or t
  modified_base (580)..(583): a, c, t, g, unknown or other
  misc_feature (580)..(583): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagtacttcattctcaaccatacagcagactggancctagaacgtattttgactagttagtacttacgtgtacagtcctagtacggtagttacattccgtaccggtacgttccggaaccgtaagggaaccctaaagggtacggtaaaataccaaaacggtacgtaggtggactcggacctaccgaattcctagttaccgttactaacttacccgtttaccccggactaactacgtacggtaaagttcggttagttacggttaacgngggttaacggggaccgggtacgttacgggaaccgaaggggtacctacggtacgttaaggcaggntagcgatnacnagnnganananannnannagnannnnnnnnannnn

SEQ ID NO: 238453 - DNA, 494 bp, Homo sapiens
  misc_feature: GYAE6OF01BDVHA.33.60.F05.1.454.CMB.1.raw
  modified_base (372)..(372): a, c, t, g, unknown or other
  misc_feature (372)..(372): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (466)..(476): a, c, t, g, unknown or other
  misc_feature (466)..(476): n is a, c, g, or t
  modified_base (478)..(494): a, c, t, g, unknown or other
  misc_feature (478)..(494): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggcaggaccttcattctcaccatcagcagatggagccctgaaggattttgctagtgtattactgtacagcctagtacggttagttcattccgtaccgtacgttccggaccgaagggaccgaaagggtggaaactaccaaaacgtaacgtgtggtctagacacatctntcgttcacttccttcccgactctactagaacgttgtagtgtacgtgaacgggtccggacgtggcgaaggtccgcggaatttacggnagntacgnnnnnnnnnnngnnnnnnnnnnnnnnnnn

SEQ ID NO: 238454 - DNA, 528 bp, Homo sapiens
  misc_feature: GYAE6OF01AZM3Q.33.60.F05.1.454.CMB.1.raw
  modified_base (251)..(251): a, c, t, g, unknown or other
  misc_feature (251)..(251): n is a, c, g, or t
  modified_base (425)..(425): a, c, t, g, unknown or other
  misc_feature (425)..(425): n is a, c, g, or t
  modified_base (448)..(448): a, c, t, g, unknown or other
  misc_feature (448)..(448): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (494)..(495): a, c, t, g, unknown or other
  misc_feature (494)..(495): n is a, c, g, or t
  modified_base (497)..(497): a, c, t, g, unknown or other
  misc_feature (497)..(497): n is a, c, g, or t
  modified_base (501)..(504): a, c, t, g, unknown or other
  misc_feature (501)..(504): n is a, c, g, or t
  modified_base (506)..(507): a, c, t, g, unknown or other
  misc_feature (506)..(507): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (513)..(516): a, c, t, g, unknown or other
  misc_feature (513)..(516): n is a, c, g, or t
  modified_base (518)..(518): a, c, t, g, unknown or other
  misc_feature (518)..(518): n is a, c, g, or t
  modified_base (520)..(522): a, c, t, g, unknown or other
  misc_feature (520)..(522): n is a, c, g, or t
  modified_base (524)..(525): a, c, t, g, unknown or other
  misc_feature (524)..(525): n is a, c, g, or t
  modified_base (528)..(528): a, c, t, g, unknown or other
  misc_feature (528)..(528): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagacgtggacgcctgaagtnttttgacctaggttgtattactgtacagtctaagttacggtattcattcctccgtacggttccggaccgaaagggtaccaaagggtacggaaaacttacgaaaacggtactggtcggtactcgccaccgtactcgtgttccttcaacttccctacccgctagtctagaaggttntgtactacgtggacggtcgggtnacgggacgtacggcgacgtaagtcgntncgactgaatcgncgtncnncngacnnnngnngnancnnnncncnnncnngtn

SEQ ID NO: 238455 - DNA, 681 bp, Homo sapiens
  misc_feature: GYAE6OF01BPDRM.33.60.F05.1.454.CMB.1.raw
  modified_base (655)..(657): a, c, t, g, unknown or other
  misc_feature (655)..(657): n is a, c, g, or t
  modified_base (659)..(681): a, c, t, g, unknown or other
  misc_feature (659)..(681): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggcctcccaggctcctcatccatggtgcatcccaccagggccactggcatcccagacgaggttcagtcggcaggtgggtcgtgggacagacttcactctcaccagtccaagcacgccgtaaggacgaccgtaggaggtaacttccgtgtacgttaaggttttacttagtacgttcgaacgtccgaaggtccgttaccgtaccgtaaaccggttcggtaccccgttcccggtccggtccgttaaccccggtttcggggaacccccgtaaaagggggtaaccctaacgggaacgttttaacggggaacggttaaacgttaaacgggtaaccggtaaaaccggttgggttaccgggtaccgttaacggtcccctaaacccgttttcgttaaccggttccccttttaaccggtaacctttacccccggtttcccggaaccctacgttccgtaagggtaaccggttgttaccgttaggtacgttcggacgggtccgggtacgtccgggacgacggtacgctaagtagctgacnnntnnnnnnnnnnnnnnnnnnnnnnn

SEQ ID NO: 238456 - DNA, 574 bp, Homo sapiens
  misc_feature: GYAE6OF01BMV9B.33.60.F05.1.454.CMB.1.raw
  modified_base (346)..(346): a, c, t, g, unknown or other
  misc_feature (346)..(346): n is a, c, g, or t
  modified_base (372)..(372): a, c, t, g, unknown or other
  misc_feature (372)..(372): n is a, c, g, or t
  modified_base (529)..(529): a, c, t, g, unknown or other
  misc_feature (529)..(529): n is a, c, g, or t
  modified_base (533)..(533): a, c, t, g, unknown or other
  misc_feature (533)..(533): n is a, c, g, or t
  modified_base (537)..(541): a, c, t, g, unknown or other
  misc_feature (537)..(541): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
  modified_base (548)..(548): a, c, t, g, unknown or other
  misc_feature (548)..(548): n is a, c, g, or t
  modified_base (551)..(557): a, c, t, g, unknown or other
  misc_feature (551)..(557): n is a, c, g, or t
  modified_base (559)..(563): a, c, t, g, unknown or other
  misc_feature (559)..(563): n is a, c, g, or t
  modified_base (565)..(574): a, c, t, g, unknown or other
  misc_feature (565)..(574): n is a, c, g, or t
tcagtacacacactcacgaccggtgctcgatttagtacgtcatcaggggaaggggctggagtgggtcgcaactattagtggcggtggaactcatacatactacgccgactccgtgaagggccgcttcaccatctccagagacaattccaacaacacggtgttttctgcaaatgaatagcctggagtagtcgaggacatcggccatatattactgtgcgagtagttagcaggtggcgtgtacttcctttctccagcacgtcggggccgacgggtaccctggtacctacccgtctccactcgtccctaccaccgaacggcccctagttccggttccctttccccccgnggcccggccctacgcctccgaggacnccgtacccgtccggagcgaccacgacggcccggtacccggtgggccttcggacccgtgggtaaccaacgggttaaccttaccgttccgacggttggttacgtacgttacgtgggaccgggccgggtcgtcgggacggtaggaccgaccgtagtacgngtcngacnnnnngngnatnagnnnnnnngnnnnncnnnnnnnnnn

SEQ ID NO: 238457 - DNA, 539 bp, Homo sapiens
  misc_feature: GYAE6OF01B123E.33.60.F05.1.454.CMB.1.raw
  modified_base (144)..(144): a, c, t, g, unknown or other
  misc_feature (144)..(144): n is a, c, g, or t
  modified_base (257)..(257): a, c, t, g, unknown or other
  misc_feature (257)..(257): n is a, c, g, or t
  modified_base (506)..(506): a, c, t, g, unknown or other
  misc_feature (506)..(506): n is a, c, g, or t
  modified_base (509)..(525): a, c, t, g, unknown or other
  misc_feature (509)..(525): n is a, c, g, or t
  modified_base (527)..(539): a, c, t, g, unknown or other
  misc_feature (527)..(539): n is a, c, g, or t
tcagtacacacactcacgaccggtgctcgatttagtacgtcatcagggaaagggtccaccctactcttgtagggccagtcagagtgttagcagcaactacttagcctggtaccagcagacacctggccaggctcccagctcctnatccatggtgcatccaccagggccactggcatcccagacaggttcagtggcaggtgggtctggggactagactttcattctcaccatccagcagacgtggacgcctgaaagtnttttgacctaggttcgttaattacctgttacgagcgaaggtacgggttatttcgagttcctcccgggtacgttccgggacccgaaaggggacctaaggggtagaaactacgaaaacgtaactgtacggctgactactatctcgtcttatactcgttccccgactcgtacctagtagttcgttcggtcgttacgttggacgggcccgggtattacgggaccgtaaacgggccgtaagtgtaacgcgagtncgnnnnnnnnnnnnnnnnngnnnnnnnnnnnnn

SEQ ID NO: 238458 - DNA, 669 bp, Homo sapiens
  misc_feature: GYAE6OF01DF4YX.33.60.F05.1.454.CMB.1.raw
  modified_base (251)..(251): a, c, t, g, unknown or other
  misc_feature (251)..(251): n is a, c, g, or t
  modified_base (284)..(284): a, c, t, g, unknown or other
  misc_feature (284)..(284): n is a, c, g, or t
  modified_base (621)..(621): a, c, t, g, unknown or other
  misc_feature (621)..(621): n is a, c, g, or t
  modified_base (623)..(624): a, c, t, g, unknown or other
  misc_feature (623)..(624): n is a, c, g, or t
  modified_base (626)..(626): a, c, t, g, unknown or other
  misc_feature (626)..(626): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (635)..(635): a, c, t, g, unknown or other
  misc_feature (635)..(635): n is a, c, g, or t
  modified_base (640)..(640): a, c, t, g, unknown or other
  misc_feature (640)..(640): n is a, c, g, or t
  modified_base (646)..(646): a, c, t, g, unknown or other
  misc_feature (646)..(646): n is a, c, g, or t
  modified_base (650)..(650): a, c, t, g, unknown or other
  misc_feature (650)..(650): n is a, c, g, or t
  modified_base (653)..(655): a, c, t, g, unknown or other
  misc_feature (653)..(655): n is a, c, g, or t
  modified_base (660)..(662): a, c, t, g, unknown or other
  misc_feature (660)..(662): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
tcagtacacacactcacgaccggtgctcgatttagtacgtcatcagggaaagggccacccgtctcttgtagggccagtcagagtgttagcagcaactacttagcctggtaccagcagacaccctggccaggcctcccaggctccctacactccagtggtgcactcccacccagggcccactcgcactcccagactaggttcgagtcggcaggttgggtctgggacagtacttctattccacacccagtacngaccgtaagactgggacgtcctaagtaaggttnttttcgacgtaggttacttattacgtgtacagaccgtaggttaacggttattccattacccggtcccggtaacggttaccggaaccggtaaagggtaacccgtaaaggggtaacgaaaacgtaccgtaaaacgttacgtggtaacggtcgtaacgaccctaaacctgttaccgtttccgttacttacccgtaccgttcccgttaccccctacgtaactttccggtaaagtcggtttacggtttaaccgtcgtttaaggtccggtaaccggggtcggttaccggtacggtaaaccgggtacggtacccgaagttaacggtaggactcgcgtatcgagnanntnagngngtancgagnagtagngcgnacnnncgtcnnngcngngc

SEQ ID NO: 238459 - DNA, 655 bp, Homo sapiens
  misc_feature: GYAE6OF01BL8AG.33.60.F05.1.454.CMB.1.raw
  modified_base (552)..(552): a, c, t, g, unknown or other
  misc_feature (552)..(552): n is a, c, g, or t
  modified_base (560)..(560): a, c, t, g, unknown or other
  misc_feature (560)..(560): n is a, c, g, or t
  modified_base (564)..(564): a, c, t, g, unknown or other
  misc_feature (564)..(564): n is a, c, g, or t
  modified_base (569)..(569): a, c, t, g, unknown or other
  misc_feature (569)..(569): n is a, c, g, or t
  modified_base (650)..(650): a, c, t, g, unknown or other
  misc_feature (650)..(650): n is a, c, g, or t
tcagtacacacactcacgaccggtgctcgatttagtacgtcatcagggaagggccgaccctctcttgtaggccagtcagagtgttagcagcaactacttagcctggtaccagcagacactggccaggctccaggctcctcatccatggtgcactccacgacgggcccacgtggaccacgtccccagaccgtaggttcaggtcggcgtaggtggtccgtagggacaggtactcactcgtacaccgtatcgacgagaccgtaggacgtcctagtaagttagttacgactacgttactacgttacgtacgtacgtacgtacgtaacgtacgtacgggtaggtaacgtaccggtaccggaaccgtaacgggtaacgtaaggtaacgtaaacgtaacgaaacgtacgtacggtacgacgtaccgacctacgtacgttacgtactaccgttacgtacccgttacccgtacccgtacgtacgtacgtaggtacgttcggtacgtacgtacggtacggtacggtacggtacgtacgacggacgtacgtacgtagagcgtnagactganacgngcganactagagtctagacgacgtagacgtacgacgtacgacgtacgacgtacgacgcgacgtacgtacgtacgacgagacgtagngtacg

SEQ ID NO: 238460 - DNA, 604 bp, Homo sapiens
  misc_feature: GYAE6OF01DP0XD.33.60.F05.1.454.CMB.1.raw
  modified_base (573)..(573): a, c, t, g, unknown or other
  misc_feature (573)..(573): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (583)..(604): a, c, t, g, unknown or other
  misc_feature (583)..(604): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctccaggctcctcatccatggtgcatccaccgagggccactggcactcccagacaggttcaggtggcaggtgggtctgggacagcttcattctcaccatcagcagacgtggacgctagaagtattttgactagttttacttactgtcgtgcagtcgtacgcaacgtcggaccctaacgcccgttcgggaccgtaagggaccacggtacgtggaacgtaacgttaaacgtaacgtggtcggtactacggaccaccgtacttcgttcggttccttacgtaccgtttccccgtttaccccggaccttacgttaccggttaggttaacggtttcggttacggtttacggttaaccggttacggggtaccgggttacccgggggtacgttaccggggaccggtaaaccggggtcccggtaacgtaacggttaagggctcgagtgacgtncgcagngngnnnnnnnnnnnnnnnnnnnnnn

SEQ ID NO: 238461 - DNA, 537 bp, Homo sapiens
  misc_feature: GYAE6OF01ELHJQ.33.60.F05.1.454.CMB.1.raw
  modified_base (143)..(143): a, c, t, g, unknown or other
  misc_feature (143)..(143): n is a, c, g, or t
  modified_base (153)..(153): a, c, t, g, unknown or other
  misc_feature (153)..(153): n is a, c, g, or t
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (263)..(263): a, c, t, g, unknown or other
  misc_feature (263)..(263): n is a, c, g, or t
  modified_base (367)..(367): a, c, t, g, unknown or other
  misc_feature (367)..(367): n is a, c, g, or t
  modified_base (506)..(537): a, c, t, g, unknown or other
  misc_feature (506)..(537): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctnatccatggtncatccacgagggccagtggcatcccagactaggttcagtggcaggtgggtctgggacagtacttcattcncaccntcagcagactggacnctagaagtatttgctagttntattactgtacagcgaaggttacgggtatctacgttaccgtccggtacggtttccggaacgaacgggaactaagggtaagtaaactaacgaaaccgtagttggngactacggaccacgtatcgtagttaccttacacttcccgtacccgacgttacgttcgtagtaacgtttggttacttacggtaagtcgggacgggtcccgggtagacgggtacgaacgggtccgaattaagcgatcgatnnnnnnnnnnnnnnnnnnnnnnnnnnnnnnnn

SEQ ID NO: 238462 - DNA, 204 bp, Homo sapiens
  misc_feature: GYAE6OF01EPUW7.33.60.F05.1.454.CMB.1.raw
  modified_base (175)..(204): a, c, t, g, unknown or other
  misc_feature (175)..(204): n is a, c, g, or t
tcagtacacacactcacgaccggtgctcgatttagtacgtcatcagggaaagggccaccctctcttgtagggccagtcagagtgttagcagcaactacttagcctggtaccagcagaccacctggccaggctcccaggctcctcatccatggtgcatccaccagggccacgtgcnnnnnnnnnnnnnnnnnnnnnnnnnnnnnn

SEQ ID NO: 238463 - DNA, 495 bp, Homo sapiens
  misc_feature: GYAE6OF01B4G0U.33.60.F05.1.454.CMB.1.raw
  modified_base (240)..(240): a, c, t, g, unknown or other
  misc_feature (240)..(240): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (465)..(469): a, c, t, g, unknown or other
  misc_feature (465)..(469): n is a, c, g, or t
  modified_base (471)..(480): a, c, t, g, unknown or other
  misc_feature (471)..(480): n is a, c, g, or t
  modified_base (482)..(495): a, c, t, g, unknown or other
  misc_feature (482)..(495): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatccccagacaggttcagtggcagtgggtctgggacagacttcactctcaccatcgacagactggancctgaagtattttgcagtctattctgtcagtcagtatacgtggggacgacggttcggaccgaaggggacctaaggtaggaaattcaaaacgaacgtggtggctgactacctatccgtagtcttcacttcccttacccgctatctaggtaagttcggtgttacgttcgtggtacgggtccgggacgtcggacgtaaggccgtactagtagntagngnatgancgtnnnnngnnnnnnnnnngnnnnnnnnnnnnnn

SEQ ID NO: 238464 - DNA, 596 bp, Homo sapiens
  misc_feature: GYAE6OF01B8A8V.33.60.F05.1.454.CMB.1.raw
  modified_base (163)..(163): a, c, t, g, unknown or other
  misc_feature (163)..(163): n is a, c, g, or t
  modified_base (193)..(193): a, c, t, g, unknown or other
  misc_feature (193)..(193): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (556)..(556): a, c, t, g, unknown or other
  misc_feature (556)..(556): n is a, c, g, or t
  modified_base (562)..(563): a, c, t, g, unknown or other
  misc_feature (562)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (570)..(571): a, c, t, g, unknown or other
  misc_feature (570)..(571): n is a, c, g, or t
  modified_base (574)..(588): a, c, t, g, unknown or other
  misc_feature (574)..(588): n is a, c, g, or t
  modified_base (590)..(590): a, c, t, g, unknown or other
  misc_feature (590)..(590): n is a, c, g, or t
  modified_base (593)..(596): a, c, t, g, unknown or other
  misc_feature (593)..(596): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatgtgcactccaccgngggccacgtggccatacccagactaggttnagtggctaggtcgggtctgggactagtactttcgactcctacaaccctatcgtaacggcctaagttaccgtacgacctaaaccgttagaaaggtttaacttttcggaactaaaaccgttttaccttacgtacgttacaaactaactagttaaaccacgtcccttaccgtacttacgtttggacccgacgggacagcgagggaatactcgaggacgtacttggtcncgnacctaacgctacttcgtacttcctacgtacccttccggaacctacttgtacggtaaacgttccgtggttaaccgtaggtacggtaccggacggggttcacggggtaaccgaacgggctaaaccgtagacggtacngagtcnngncngtnncannnnnnnnnnnnnnncncannnn

SEQ ID NO: 238465 - DNA, 577 bp, Homo sapiens
  misc_feature: GYAE6OF01AW7J1.33.60.F05.1.454.CMB.1.raw
  modified_base (103)..(103): a, c, t, g, unknown or other
  misc_feature (103)..(103): n is a, c, g, or t
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (414)..(414): a, c, t, g, unknown or other
  misc_feature (414)..(414): n is a, c, g, or t
  modified_base (432)..(432): a, c, t, g, unknown or other
  misc_feature (432)..(432): n is a, c, g, or t
  modified_base (449)..(449): a, c, t, g, unknown or other
  misc_feature (449)..(449): n is a, c, g, or t
  modified_base (511)..(511): a, c, t, g, unknown or other
  misc_feature (511)..(511): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (532)..(533): a, c, t, g, unknown or other
  misc_feature (532)..(533): n is a, c, g, or t
  modified_base (541)..(541): a, c, t, g, unknown or other
  misc_feature (541)..(541): n is a, c, g, or t
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
  modified_base (560)..(560): a, c, t, g, unknown or other
  misc_feature (560)..(560): n is a, c, g, or t
  modified_base (562)..(564): a, c, t, g, unknown or other
  misc_feature (562)..(564): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (570)..(573): a, c, t, g, unknown or other
  misc_feature (570)..(573): n is a, c, g, or t
  modified_base (575)..(575): a, c, t, g, unknown or other
  misc_feature (575)..(575): n is a, c, g, or t
tcagtacacacactcacgaccggtgctcgatttagtacgtcatcagggaaagggccgaccctctcttgtagggccagtcagagtgttagcagcaactacttancctgtaccagcagacacctcggccagacctcccaggctcctcatctatgatgcatccacgacgggccacgtcggcactcccacgccgtaggttcgaggtggcgaggtgggtcgtagggacaggaacttcctactctccaccatcnggtacacgccgtaggacnccgtaagtacgtaagttttgtacgttaacgtttaacttacgttagttcgtggtcgacgtcgtacgactacgtacgtaccctacggtacccgtgaccggaggacgcgtagacgagtaacaaacgtcncggtgcgtnactctgtaccgtntactactcttccgtaccncttacgtactaaggttntcggttaagtcggtacgtcggtaacgggtcggtacgtagggtacccggacgtcggtaaccgngtaccgtaanggtancgcncnngtcgagtncgtcatctntctngtgtanannngngngnnnngnta

SEQ ID NO: 238466 - DNA, 588 bp, Homo sapiens
  misc_feature: GYAE6OF01DLQ7B.33.60.F05.1.454.CMB.1.raw
  modified_base (154)..(154): a, c, t, g, unknown or other
  misc_feature (154)..(154): n is a, c, g, or t
  modified_base (262)..(262): a, c, t, g, unknown or other
  misc_feature (262)..(262): n is a, c, g, or t
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
  modified_base (534)..(534): a, c, t, g, unknown or other
  misc_feature (534)..(534): n is a, c, g, or t
  modified_base (539)..(539): a, c, t, g, unknown or other
  misc_feature (539)..(539): n is a, c, g, or t
  modified_base (548)..(548): a, c, t, g, unknown or other
  misc_feature (548)..(548): n is a, c, g, or t
  modified_base (557)..(557): a, c, t, g, unknown or other
  misc_feature (557)..(557): n is a, c, g, or t
  modified_base (567)..(567): a, c, t, g, unknown or other
  misc_feature (567)..(567): n is a, c, g, or t
  modified_base (584)..(584): a, c, t, g, unknown or other
  misc_feature (584)..(584): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatgggtncaatcccaccgagggccacgtggcatcccgagacgtaggttcagtggctaggtgggtctgggacaaggtacttcaattcctacaccatacaggctaggactacggacnctagaagtatttgactagttgtattacgtgtactagagtagtacggtagtctatcgtcgtaccggtcgacgtaaggacgtaaggtagaaactcgaaaacgtactggacgtcgtagccaactatcgttacgtaccttacgtacttcttaccccggtactaacgtactaacgggtaatcgggtttagtcgtttaacggtgacggggtccggggttcaacgggtaaccgaagggtccgacgtagtaacgtgntacgnagactatgagatacgtancaganagagagtcncgagactanacgatacganagtacgagagtacgtgngacg

SEQ ID NO: 238467 - DNA, 799 bp, Homo sapiens
  misc_feature: GYAE6OF01EYOYV.33.60.F05.1.454.CMB.1.raw
  modified_base (707)..(707): a, c, t, g, unknown or other
  misc_feature (707)..(707): n is a, c, g, or t
  modified_base (721)..(721): a, c, t, g, unknown or other
  misc_feature (721)..(721): n is a, c, g, or t
  modified_base (732)..(732): a, c, t, g, unknown or other
  misc_feature (732)..(732): n is a, c, g, or t
  modified_base (745)..(745): a, c, t, g, unknown or other
  misc_feature (745)..(745): n is a, c, g, or t
tcagtacacacactcacgaccggtgctcgatttagtacgtcatcagggaaagggccaccctctcttgtagggccagtcagagtgttagcagcaactacttagcctggccaggtgtctgctggtaccaggctcccgaggctcctcatccatggtgcatccacgagggaccactggacactccccgagacgtaggttcaggtcggctacggttggggtccgtaggggaactacggtactttctactttcgtaccaaccgtataccgacgtaccgaacggtacgtacgggtacgtacccgtaggttaaacgtagtttttacggacctagggtttaaccgtttaaggtttacctaggttaccgtaaacggtccgtaaagggtttaccggttacggttacctacgtttacccggtcccgggttaacccggttcccggaaaccgggtaaaccgggtaaaccggttaaacggggaacggttaaaacgttaaaccgtaaaaaccggtacggttacggttaccggggtacgtaccccggtacaacccgtttacgttaccgttacggtttaccctaccgtaacccgtttccccgttacccccgtacgtacttaaccggttaacggtacgttacgggttaccggttacgggttacgttacggggtaccggggtcccggtaggttaaccggacggtaacgggaccgtacgacgtacggntacgagtggtacanccgatcgctancgagtagatacgngttagactagcgtacgtagtatcgagacgacgtacgtacgtagcgtcgtacgtg

SEQ ID NO: 238468 - DNA, 700 bp, Homo sapiens
  misc_feature: GYAE6OF01BMCWX.33.60.F05.1.454.CMB.1.raw
  modified_base (653)..(653): a, c, t, g, unknown or other
  misc_feature (653)..(653): n is a, c, g, or t
  modified_base (663)..(663): a, c, t, g, unknown or other
  misc_feature (663)..(663): n is a, c, g, or t
  modified_base (666)..(667): a, c, t, g, unknown or other
  misc_feature (666)..(667): n is a, c, g, or t
  modified_base (669)..(669): a, c, t, g, unknown or other
  misc_feature (669)..(669): n is a, c, g, or t
  modified_base (671)..(681): a, c, t, g, unknown or other
  misc_feature (671)..(681): n is a, c, g, or t
  modified_base (683)..(689): a, c, t, g, unknown or other
  misc_feature (683)..(689): n is a, c, g, or t
  modified_base (691)..(694): a, c, t, g, unknown or other
  misc_feature (691)..(694): n is a, c, g, or t
  modified_base (696)..(696): a, c, t, g, unknown or other
  misc_feature (696)..(696): n is a, c, g, or t
  modified_base (698)..(700): a, c, t, g, unknown or other
  misc_feature (698)..(700): n is a, c, g, or t
tcagtacacacactcacgaccggtgctcgatttagtacgtcatcagggaaaggggctggagtgggtcgcaactattagtggcggtggaactcatacatactacgccgactccgtgaagggccgcttcaccatctccagagacaattccaaacaacacggtgtttctgcaaatgaatagcctgagagtcgaggacatggccatatattactgtgcgagtagttagcgtagtggcttggtacttccttttcttccagcctacgtcggggaccacgggtacccttggtaccgaccggttccttcccgtcacggtcccctaccgacccgaacggggtaccccacggtttcccggttccccgtttccccccgtcggggtcccggtcccccttcggtaccccgttcccgggaaagggtccgtaccccgtacccgttaccccggaaggaaccggtaccgaaccgtaacggggtccccggtaccccggttggggcctccggtccggttcggtaaccggaaaccggtaaccctttaccgtttaccccggtaggtttacgggtttaccgggttacgggttaacccgtcggggtagggggtacccccgggggtcgttaccgggggaacggttaaaccgggggccctacggtaagtgggaccctncgacgcttanagnngngnnnnnnnnnnngnnnnnnngnnnnancnnn

SEQ ID NO: 238469 - DNA, 640 bp, Homo sapiens
  misc_feature: GYAE6OF01DL3EQ.33.60.F05.1.454.CMB.1.raw
  modified_base (432)..(432): a, c, t, g, unknown or other
  misc_feature (432)..(432): n is a, c, g, or t
  modified_base (530)..(530): a, c, t, g, unknown or other
  misc_feature (530)..(530): n is a, c, g, or t
  modified_base (543)..(543): a, c, t, g, unknown or other
  misc_feature (543)..(543): n is a, c, g, or t
  modified_base (551)..(551): a, c, t, g, unknown or other
  misc_feature (551)..(551): n is a, c, g, or t
tcagtacacacactcacgaccggtgctcgatttagtacgtcatcagggaaagggccaccctctcttgtagggccagtcagagtgttagcaggcaactacttagcctggtaccagcagacacctggccaggctcccgaggctcctcatccatggtgcatccaccgagggccactggcactcccagactaggttcaggtggcaggtcgggtcgtgggacagacttcgattcctcactatccagcagacgtggactcctagaagtatttgactagtgttattactgtcagcaggtacggtagttcattccgtcggtacggttccggaccgaacgggaccgtaagggtacgaaaactaccgtaaaaccggaacttggtcggtactacggacctaccctagttcgttagttaccttcgtaccgttcccgttaccccncctagttcgtaaggtacggtttcggttaggttaccgttacgtgggaaccgggtcgggtcgtacgggacggtaacgggcctacgtaacggtacgcgtancgtagccgtacgngtcgtacngtacgctacgacgtcgaactcgtcacgtaccgtacgtacgtacgtacgtacgtcgtacgtaacgtactacgtacgtactacgtcgtacg

SEQ ID NO: 238470 - DNA, 596 bp, Homo sapiens
  misc_feature: GYAE6OF01BBTIK.33.60.F05.1.454.CMB.1.raw
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
  modified_base (533)..(533): a, c, t, g, unknown or other
  misc_feature (533)..(533): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccagtggtgcatccaccgagggccacgtggcatcccagactaggttcagtggcaggtggtctgggacagtacttcattctcaccatcagcagactgganctagaatnttgcagtntattactgtcagaccgtagtacggttattcatcgtaccgtacgttcggaccgaagggaccaagggtacgaaacacgaaaacggtactggtaggctagaccgaacctaagtccttacggttcttacctaacgttccctttacccgacctattacgttaggtaacgtttcgttcggttacgttaacgtcgggagtcccggggacgttaacggaccggtaagggccgtaacgtaagtaggctaacgngtangatcgtagacgtgtacgctagacgngagtagtacgacgtacgtacgtacgctacgtcgacgtacaacgtatacgagtacacgtagaac

SEQ ID NO: 238471 - DNA, 502 bp, Homo sapiens
  misc_feature: GYAE6OF01D16JC.33.60.F05.1.454.CMB.1.raw
  modified_base (193)..(193): a, c, t, g, unknown or other
  misc_feature (193)..(193): n is a, c, g, or t
  modified_base (226)..(226): a, c, t, g, unknown or other
  misc_feature (226)..(226): n is a, c, g, or t
  modified_base (432)..(432): a, c, t, g, unknown or other
  misc_feature (432)..(432): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
  modified_base (471)..(471): a, c, t, g, unknown or other
  misc_feature (471)..(471): n is a, c, g, or t
  modified_base (475)..(502): a, c, t, g, unknown or other
  misc_feature (475)..(502): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctccaggctcctcatcccatggtgcatccaccgagggccatggcatcccagacaggttcagtgnaggtggtgtagggactagacttcactctcacancacgcaaacctagaactgaagttatttctaattttatctgtacaactatcgacggcagactcggtacctctctaccgtttcgggcgggtacgggaacgacgggttaggacgtacctacgaaaacggacgttcggtacggacttcaccgtaactacttcgtcgttccttacgcttaccgttccccacgtcctacgttgaagttcgtntacgtgtagggcgtcgggtcnggacgcggaccngtaagnagcnnnnnnnnnnnnnnnnnnnnnnnnnnnn

SEQ ID NO: 238472 - DNA, 891 bp, Homo sapiens
  misc_feature: GYAE6OF01EGSRU.33.60.F05.1.454.CMB.1.raw
  modified_base (853)..(853): a, c, t, g, unknown or other
  misc_feature (853)..(853): n is a, c, g, or t
  modified_base (859)..(859): a, c, t, g, unknown or other
  misc_feature (859)..(859): n is a, c, g, or t
  modified_base (861)..(862): a, c, t, g, unknown or other
  misc_feature (861)..(862): n is a, c, g, or t
  modified_base (864)..(864): a, c, t, g, unknown or other
  misc_feature (864)..(864): n is a, c, g, or t
  modified_base (868)..(871): a, c, t, g, unknown or other
  misc_feature (868)..(871): n is a, c, g, or t
  modified_base (873)..(889): a, c, t, g, unknown or other
  misc_feature (873)..(889): n is a, c, g, or t
  modified_base (891)..(891): a, c, t, g, unknown or other
  misc_feature (891)..(891): n is a, c, g, or t
tcagtacacacactcacgaccggtgctcgatttagtacgtcatcagggaaagggccaccctctcttgtagggccagtcagagtgttagcagcaactacttagcctggtaccagcagaccacctggccaggcctcccaggctcctcatccagtggtgcactcccaccgacgggccacgtggcactcccagacgtaggttcaggtggctaggttcggggtacgtaggggactacgtacctttacgtactttcctaccaacctactccgaacgaccgaacggtaccggtaggggaccgtaccggttaggtaaaggtttacgttttttacggacccgttaaggtttaccggtttaaacgttttaaccggttacgggttaccgaacggtaccggtaaggggtacccggttaaaccgggtaacccgttaaaccggggtttccggggttttaccggggtttaaccgggggttaacccccggggtttacccgggggaaacccggttaaaaccgggggaaaccccgggttaaaaagggggttaaaccgggtaaaaaccgtaaaccgggtaaaaacccggtaaccggttacggggttaacggtacccgttacgggaacccctaacccggttaccgttttaccggtttaccggttttaccctttaacccgttaaccccgtttccccccggttttacccccgtaccccgtttaacccgtttaaccggggtttaacggtttaacggtttacggggtttaacgggtttaacgggtttaccggggttaacggggtccggggtccggggttaaccgggtaccggggtaaaccgggtacgggacggtaccggtaaggttacggagtcganacgtgngnngngtgnnnncnnnnnnnnnnnnnnnnngn

SEQ ID NO: 238473 - DNA, 555 bp, Homo sapiens
  misc_feature: GYAE6OF01EVTD0.33.60.F05.1.454.CMB.1.raw
  modified_base (213)..(213): a, c, t, g, unknown or other
  misc_feature (213)..(213): n is a, c, g, or t
  modified_base (518)..(518): a, c, t, g, unknown or other
  misc_feature (518)..(518): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(527): a, c, t, g, unknown or other
  misc_feature (526)..(527): n is a, c, g, or t
  modified_base (529)..(530): a, c, t, g, unknown or other
  misc_feature (529)..(530): n is a, c, g, or t
  modified_base (532)..(532): a, c, t, g, unknown or other
  misc_feature (532)..(532): n is a, c, g, or t
  modified_base (534)..(555): a, c, t, g, unknown or other
  misc_feature (534)..(555): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccagactcccaggcctcctcatctatgatgcactcccaccgagggcccacgtggcactccccagccaggttcaggtggcaggtgggtcngggacagtacttcactctcaccatcagcagcctagcgcctagaagtattttgcttagtttattactgtcagcagcgtagactaacgttggtcgttcgggtaccgttccggaccgtaaacgggaccgtaagggtaggaaaactaccgaaaacgtaacgtggtaggctacgaccaacctagttctacgtccgttactacttcccttcccgacctacgttcgtacggtaacgttggtttacgtaggttaccgttgggaccggtcggggttctacggggaacgtaacggggccgtaacggtactacggncgangncnngnncncnnnnnnnnnnnnnnnnnnnnnn

SEQ ID NO: 238474 - DNA, 620 bp, Homo sapiens
  misc_feature: GYAE6OF01BHODF.33.60.F05.1.454.CMB.1.raw
  modified_base (272)..(272): a, c, t, g, unknown or other
  misc_feature (272)..(272): n is a, c, g, or t
  modified_base (488)..(488): a, c, t, g, unknown or other
  misc_feature (488)..(488): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (522)..(522): a, c, t, g, unknown or other
  misc_feature (522)..(522): n is a, c, g, or t
  modified_base (525)..(525): a, c, t, g, unknown or other
  misc_feature (525)..(525): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggcctcccaggctcctcatccatggtgcatccaccgaggccactggcatcccagacaggttcagtcggcaggtgggtcgtagggacagacgttcattctacactatcagcagacgtggagcctagtaagtattttagcgtaggtnttagttactcgtacacgtacgtaacggtacggtagtttacacgttacgtaccggtacggttacggaaccgaacggggtaaccgtaagggtaagtaaacgtacgaaaacgtacgtggacgtcgtagacctaacgtactacgtcgtacttacgacgttccgtacccgtactacgtcgtaagtacgtcgttaggtcgtacgtacggtacggcggtacgngggtaacgacggcgtacgtaagtacgancgnagnagntagcgagtacgtcgtacgacaggtactacgagttacggagtacgtacgacgtaggtaccaggtctaacttacccgggatctagtacgcgttaacg

SEQ ID NO: 238475 - DNA, 595 bp, Homo sapiens
  misc_feature: GYAE6OF01E2IJX.33.60.F05.1.454.CMB.1.raw
  modified_base (214)..(214): a, c, t, g, unknown or other
  misc_feature (214)..(214): n is a, c, g, or t
  modified_base (247)..(247): a, c, t, g, unknown or other
  misc_feature (247)..(247): n is a, c, g, or t
  modified_base (558)..(558): a, c, t, g, unknown or other
  misc_feature (558)..(558): n is a, c, g, or t
  modified_base (562)..(566): a, c, t, g, unknown or other
  misc_feature (562)..(566): n is a, c, g, or t
  modified_base (568)..(569): a, c, t, g, unknown or other
  misc_feature (568)..(569): n is a, c, g, or t
  modified_base (571)..(595): a, c, t, g, unknown or other
  misc_feature (571)..(595): n is a, c, g, or t
tcagtacacacactcacgaccggtgctcgatttagtacgtcatcagggaaagggccaccctctcttgtagggccagtcagagtgttagcagcaactacttagcctggtaccagcagaccaccctgggcccaggcctcccaggcctcctcatccatggtgcatcccaccgacggggccacgtggcactccccgagacgtaggttcaggtggacgnggtgggttcgtggggacagtaccttcacttccncaccatcagcagacgtgggacgtcgtagaattagttttgcgtagtagttattacgtgtacagacgtaggttacggtattcatcccgtacggttacggtcggaccgtaacgggacctaagggtacaaacgtaccgtaaaacgtacgtacggtcggtcgtaccgaccgtactacgtttcgtccgtttaccttacgttacctttaccccgttaccccgacttccgttacgtaggttacggttcgtaggttacgtaaccgtggggacggtccgggtacggtacggaccggaaggtcccgaagtaacggttccggngacnnnnngnngnnnnnnnnnnnnnnnnnnnnnnnnn

SEQ ID NO: 238476 - DNA, 525 bp, Homo sapiens
  misc_feature: GYAE6OF01BNR21.33.60.F05.1.454.CMB.1.raw
  modified_base (489)..(489): a, c, t, g, unknown or other
  misc_feature (489)..(489): n is a, c, g, or t
  modified_base (495)..(496): a, c, t, g, unknown or other
  misc_feature (495)..(496): n is a, c, g, or t
  modified_base (498)..(498): a, c, t, g, unknown or other
  misc_feature (498)..(498): n is a, c, g, or t
  modified_base (500)..(525): a, c, t, g, unknown or other
  misc_feature (500)..(525): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccaggggccactggcatccccagacaggttcagtggcaggtgggtctgggacagacttcattctcaccatcagcagacgtggacgcctaggaacgtattttgctagttgttattactgtcagcgagttacggtagtcatccgtccggtaccggttcgaccgaacggaaccgtaagggtacgaaactacgaaaacgtacgtggtggctacgaccacctatccgttgtccttactaccttcccgtcccgcctacgtcttaggtacgttgtcgttcggtaccgtaggacgggtccgggtcggttagggaccggagggccgacgtagtacgcgngatcgnngngnnnnnnnnnnnnnnnnnnnnnnnnnn

SEQ ID NO: 238477 - DNA, 555 bp, Homo sapiens
  misc_feature: GYAE6OF01EHLQZ.33.60.F05.1.454.CMB.1.raw
  modified_base (520)..(521): a, c, t, g, unknown or other
  misc_feature (520)..(521): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (529)..(530): a, c, t, g, unknown or other
  misc_feature (529)..(530): n is a, c, g, or t
  modified_base (532)..(541): a, c, t, g, unknown or other
  misc_feature (532)..(541): n is a, c, g, or t
  modified_base (543)..(555): a, c, t, g, unknown or other
  misc_feature (543)..(555): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggacgcctgaagtattttgctagttgttattactgtcagctaaggttacggttagttcacgttccgtacccggtacggtttccgggaccgaacggggaccgtaagggtacggaaactacgaaaacggtaacgtcggtacggctacggaccaactacgttcttcgttcctttacctactttcccgttccccgacctacttaccgttaggtaacgttggttacggttacgttacgtagggacggggtcgggtacggtagggaccgtaacgggccgtacgacgtagnngntngcanngnnnnnnnnnnannnnnnnnnnnnn

SEQ ID NO: 238478 - DNA, 720 bp, Homo sapiens
  misc_feature: GYAE6OF01DUXTX.33.60.F05.1.454.CMB.1.raw
  modified_base (267)..(267): a, c, t, g, unknown or other
  misc_feature (267)..(267): n is a, c, g, or t
  modified_base (670)..(670): a, c, t, g, unknown or other
  misc_feature (670)..(670): n is a, c, g, or t
  modified_base (687)..(687): a, c, t, g, unknown or other
  misc_feature (687)..(687): n is a, c, g, or t
  modified_base (691)..(691): a, c, t, g, unknown or other
  misc_feature (691)..(691): n is a, c, g, or t
  modified_base (693)..(693): a, c, t, g, unknown or other
  misc_feature (693)..(693): n is a, c, g, or t
  modified_base (695)..(696): a, c, t, g, unknown or other
  misc_feature (695)..(696): n is a, c, g, or t
  modified_base (699)..(715): a, c, t, g, unknown or other
  misc_feature (699)..(715): n is a, c, g, or t
  modified_base (717)..(720): a, c, t, g, unknown or other
  misc_feature (717)..(720): n is a, c, g, or t
tcagtacacacactcacgaccggtgctcgatttagtacgtcatcagggaaagggccaccctctcttgtagggccagtcagagtgttagcagcaactacttagcctggtaccagcagacaccctggccaggctcccgaggctcctcatccatggtgcactcccaccgtagggcccacgtggacacgtcccagaccgaggtttcgagtggcagggttgggtcgtgggacagtacttctagttctaccactagtccagcagacgtggacncgtagaacgttagttttgacgtagttagttaacttacgtgtacgagacgtaacggttaacgggttactttaccgtacgtttacccgttaccccggtaaccggtttacccgggaaccggtaaacgggggtaaaccgtaaacgggtaaacgggtaaaacctaacccgaaaacggtacggttaggtacggtaccgtaccgtaccgtaacccgtacgtttccggtttacgtttcccgtttaacccgtacccgtttcccccgttaaccccgtaccgtttaccttacggtttaacgggttacggtttacgggttaccggtttacggtttaaccggtacggggtaaccgggtccggggttaccggtaacgggaaccggtaaccggggtccggtaaccgttaaggtacggngacgtcgacgtgacgtnacgngngnntcnnnnnnnnnnnnnnnnnannnn

SEQ ID NO: 238479 - DNA, 641 bp, Homo sapiens
  misc_feature: GYAE6OF01CISKP.33.60.F05.1.454.CMB.1.raw
  modified_base (623)..(641): a, c, t, g, unknown or other
  misc_feature (623)..(641): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccagctcctcatccatggtgcactccaccgagggccactggcatcccagacaggttcagtggcaggtgggtctgggacagtacttcattctcacgatcagcagactaggcgcctaggaacgttattttgactagtcgttattacgtcgtacaggcctaggttacggttagttcctactccgttacccggtaccggtttccgggaacccgaaagggggtaacccgtaaaggggtaacgggtaaaactaaccggaaaaaacggtacccgtttagggtacggtaccgtcggaaccctaacccggtaatttcccgtttcggtttaccctttaccgtaacccttttcccccgtttacccccggtacccttaacgttaccgttaaccgggggttaaaggtttcgggtttaacggttacccgggtttaagggtttccgggaaccgggggttaccggggtaccggcgggttaaacgggacgggtaccggagtacgaagnnnnnnnnnnnnnnnnnnn

SEQ ID NO: 238480 - DNA, 408 bp, Homo sapiens
  misc_feature: GYAE6OF02JBF6T.33.60.F05.1.454.CMB.1.raw
  modified_base (401)..(408): a, c, t, g, unknown or other
  misc_feature (401)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtcttcatcttcccgcatctgaagtgtgtgtactgagcgggctggcaaggcgcatagnnnnnnnn

SEQ ID NO: 238481 - DNA, 409 bp, Homo sapiens
  misc_feature: GYAE6OF02F1K27.33.60.F05.1.454.CMB.1.raw
  modified_base (401)..(409): a, c, t, g, unknown or other
  misc_feature (401)..(409): n is a, c, g, or t
tcagtacacacactcacgaccggtgctcgatttagtacgtcatcagggaaagggtcaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcacatctgtcttcatcttcccgccatctgaagtgtgtgtactgagcgggctggcaaggcgcatagnnnnnnnnn

SEQ ID NO: 238482 - DNA, 403 bp, Homo sapiens
  misc_feature: GYAE6OF02F4LRI.33.60.F05.1.454.CMB.1.raw
  modified_base (400)..(403): a, c, t, g, unknown or other
  misc_feature (400)..(403): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggaacctgaagatttgcagtgtattactgtcagcagtacggtagttcatctccgacgttcggccaagggaccaaggtggaaatcaaacgaactgtggctgcaccatctgtcttcatctccgccatctgaagtgtgtgtactgagcgggctggcaaggcgcatagnnnn

SEQ ID NO: 238483 - DNA, 408 bp, Homo sapiens
  misc_feature: GYAE6OF02HUXN4.33.60.F05.1.454.CMB.1.raw
  modified_base (403)..(408): a, c, t, g, unknown or other
  misc_feature (403)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgaagtgtgtgtactgagcgggctggcaaggcgcatagnnnnnn

SEQ ID NO: 238484 - DNA, 407 bp, Homo sapiens
  misc_feature: GYAE6OF02F7OK6.33.60.F05.1.454.CMB.1.raw
  modified_base (401)..(407): a, c, t, g, unknown or other
  misc_feature (401)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttccgccatctgaagtgtgtgtactgagcgggctggcaaggcgcatagnnnnnnn

SEQ ID NO: 238485 - DNA, 439 bp, Homo sapiens
  misc_feature: GYAE6OF02IX12E.33.60.F05.1.454.CMB.1.raw
  modified_base (248)..(248): a, c, t, g, unknown or other
  misc_feature (248)..(248): n is a, c, g, or t
  modified_base (397)..(397): a, c, t, g, unknown or other
  misc_feature (397)..(397): n is a, c, g, or t
  modified_base (406)..(406): a, c, t, g, unknown or other
  misc_feature (406)..(406): n is a, c, g, or t
  modified_base (410)..(439): a, c, t, g, unknown or other
  misc_feature (410)..(439): n is a, c, g, or t
tcagtacacacactcacgaccggtgctcgatttagtacgtcatcagggaaagggtccgaccctctcttgtagggccagtcaggagtgttagcagcaactacttagcctcggtaccagcagtacacctggccaggctcccaggctcctcatccagtggtgcatccaccagggccactggcatcccagacaggttcagtggcagtgggtctgggacagacttcattctcaccatcagtctagactggacncctagaagtattttgctagtgtattacctgtcagcaggtacgtagttcatctccgacgttcggccaagggtccaaggtgaaatcgaaacgactggtcgctgcacatctgtcttcatcttcccgctatctgagtgtgtgtactgagcggntggcaggcnatgnnnnnnnnnnnnnnnnnnnnnnnnnnnnnn

SEQ ID NO: 238486 - DNA, 413 bp, Homo sapiens
  misc_feature: GYAE6OF02IWVKX.33.60.F05.1.454.CMB.1.raw
  modified_base (401)..(413): a, c, t, g, unknown or other
  misc_feature (401)..(413): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcaccatctgtcttcatcttccgccatctgagtgtgtgtactgagcgggctgggcaaggcgcatagnnnnnnnnnnnnn

SEQ ID NO: 238487 - DNA, 406 bp, Homo sapiens
  misc_feature: GYAE6OF02H4COM.33.60.F05.1.454.CMB.1.raw
  modified_base (402)..(406): a, c, t, g, unknown or other
  misc_feature (402)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtcttcatcttcccgccatctgaagtgtgtgtactgagcgggctggcaaggcgcatagnnnnn

SEQ ID NO: 238488 - DNA, 443 bp, Homo sapiens
  misc_feature: GYAE6OF02GZHHI.33.60.F05.1.454.CMB.1.raw
  modified_base (249)..(249): a, c, t, g, unknown or other
  misc_feature (249)..(249): n is a, c, g, or t
  modified_base (286)..(286): a, c, t, g, unknown or other
  misc_feature (286)..(286): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (416)..(443): a, c, t, g, unknown or other
  misc_feature (416)..(443): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcgattctcaccatcagcagactggagcctgaagnttttgcagtctattactgtcagcagtatactgggganacgttcggccaagggaccaagggtggaaatcaaacgaactgtggactgcacatctgtcttcatcttcccgctatctgaagtgtgtgtactgagcgggctggctaagggcgctagttaggntcatngngcnnnnnnnnnnnnnnnnnnnnnnnnnnnn

SEQ ID NO: 238489 - DNA, 406 bp, Homo sapiens
  misc_feature: GYAE6OF02G36PU.33.60.F05.1.454.CMB.1.raw
  modified_base (402)..(406): a, c, t, g, unknown or other
  misc_feature (402)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcttctatgatgcatccaacagggccactggcatcccagccaggttcagtggcggtgggtctgggacagacttcactctcaccatcagcagcctagagcctgaagattttgcagtttattactgtcagcagcgtagcaactggtcttggacgttcggccaagggaccaaggtggaaatcaaacgaactgtggctgcaccatctgtcttcatcttcccgcatctgaagtgtgtgtactgagcgggctggcaaggcgcatagnnnnn

SEQ ID NO: 238490 - DNA, 404 bp, Homo sapiens
  misc_feature: GYAE6OF02GU0JA.33.60.F05.1.454.CMB.1.raw
  modified_base (396)..(404): a, c, t, g, unknown or other
  misc_feature (396)..(404): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtctattactgtcagcagtatactggggagacgttcggccaagggaccaaggtggaaatcaaacgaactgtggctgcaccatctgtcttcatttcccgcatctgaagtgtgtgtactgagcgggctggcaagggcgcatagnnnnnnnnn

SEQ ID NO: 238491 - DNA, 455 bp, Homo sapiens
  misc_feature: GYAE6OF02IFUBT.33.60.F05.1.454.CMB.1.raw
  modified_base (415)..(415): a, c, t, g, unknown or other
  misc_feature (415)..(415): n is a, c, g, or t
  modified_base (418)..(419): a, c, t, g, unknown or other
  misc_feature (418)..(419): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (429)..(430): a, c, t, g, unknown or other
  misc_feature (429)..(430): n is a, c, g, or t
  modified_base (432)..(444): a, c, t, g, unknown or other
  misc_feature (432)..(444): n is a, c, g, or t
  modified_base (446)..(451): a, c, t, g, unknown or other
  misc_feature (446)..(451): n is a, c, g, or t
  modified_base (453)..(455): a, c, t, g, unknown or other
  misc_feature (453)..(455): n is a, c, g, or t
tcagtacacacactcacgaccggtgctcgatttagtacgtcatcagggaaaggggccgaccctctcttgtagggccagtcagagtgttagcagcaactacttagcctggtaccagcacgacacctggccaggctcccaggctcctcatccatggtgcatccaccagggccactggcatcccagacaggttcagtggcagtgggtctgggacagacttcattctcaccatcagcagactggtagcctgaagattttgcagtgtacttactgtcagcagttacggtagttcatctccgacgttcggaccaagggacaaggtggaaatcaaacgaactgtgctgcacatctgtctcatcttcccgcatctgaactgtgtgtactggagcggggtctgggctaagggtcgactaatagncanntatngtgngnngnnnnnnnnnnnnncnnnnnncnnn

SEQ ID NO: 238492 - DNA, 414 bp, Homo sapiens
  misc_feature: GYAE6OF02IYQ87.33.60.F05.1.454.CMB.1.raw
  modified_base (403)..(414): a, c, t, g, unknown or other
  misc_feature (403)..(414): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgagtgtgtgtactgagcgggctggcaaggcgacatagnnnnnnnnnnnn

SEQ ID NO: 238493 - DNA, 408 bp, Homo sapiens
  misc_feature: GYAE6OF02GON9I.33.60.F05.1.454.CMB.1.raw
  modified_base (291)..(291): a, c, t, g, unknown or other
  misc_feature (291)..(291): n is a, c, g, or t
  modified_base (401)..(408): a, c, t, g, unknown or other
  misc_feature (401)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtttattactgtctgcagcgtagcaactggcctaacncctccggccaagggacacgactggagattaaacgactgtggctgcaccatctgtcttcatcttcccgcatctgaagtgtgtgtactgagcgggctggcaaggcgcatagnnnnnnnn

SEQ ID NO: 238494 - DNA, 411 bp, Homo sapiens
  misc_feature: GYAE6OF02H9IL7.33.60.F05.1.454.CMB.1.raw
  modified_base (403)..(411): a, c, t, g, unknown or other
  misc_feature (403)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcattctccgacgttcggccaagggaccaaggtggaaatcaaacgaactgtggctgcaccatctgtcttcatcttcccgccatctgagtgtgtgtactgagcgggctggcaaggcgcatagnnnnnnnnn

SEQ ID NO: 238495 - DNA, 412 bp, Homo sapiens
  misc_feature: GYAE6OF02I1MVG.33.60.F05.1.454.CMB.1.raw
  modified_base (398)..(412): a, c, t, g, unknown or other
  misc_feature (398)..(412): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtatactgtcagcagtacgtagttcatctcgacgttcgccaagggaccaaggtggaaatcaaacgactgtggctgcacatactgtacttcatcttcccgcatctgaatgtgtgtactgagcgggctggcaaggcgctatagnnnnnnnnnnnnnnn

SEQ ID NO: 238496 - DNA, 410 bp, Homo sapiens
  misc_feature: GYAE6OF02H4J5X.33.60.F05.1.454.CMB.1.raw
  modified_base (400)..(400): a, c, t, g, unknown or other
  misc_feature (400)..(400): n is a, c, g, or t
  modified_base (405)..(410): a, c, t, g, unknown or other
  misc_feature (405)..(410): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgtttcggccaagggaccaaggtggaaatcaaaacgaactgtggctgcaccatctgtcttcatcttcccgccatctgaagtgtgtgtactgagcgggctggcaaggcgnatagnnnnnn

SEQ ID NO: 238497 - DNA, 455 bp, Homo sapiens
  misc_feature: GYAE6OF02GZJRN.33.60.F05.1.454.CMB.1.raw
  modified_base (416)..(416): a, c, t, g, unknown or other
  misc_feature (416)..(416): n is a, c, g, or t
  modified_base (422)..(455): a, c, t, g, unknown or other
  misc_feature (422)..(455): n is a, c, g, or t
tcagtacacacactcacgaccggtgctcgatttagtacgtcatcagggaaagggccacccgtctcttgtacgggcccaggttccagagtgttagctagcaactacttagcctggtaccagcagacacctggccaggctcccaggctcctcatccattggtgcatcctaccagggccactggcatcccagacaggttcagtggcaggtgggtctggggacagacttcgattctcaccatccagcagactggagcctgaagattttgctagtgtattactgtcagcaggtacggtagttcatctccggacgttcggccaagggaccaaggtggaaatcgaaacgaactgtggctgacaccatctgtcttcatcttcccgcatctgaagtgtgtgtactgacggcgggctggcaaggcncatagnnnnnnnnnnnnnnnnnnnnnnnnnnnnnnnnnn

SEQ ID NO: 238498 - DNA, 409 bp, Homo sapiens
  misc_feature: GYAE6OF02IRVBQ.33.60.F05.1.454.CMB.1.raw
  modified_base (331)..(331): a, c, t, g, unknown or other
  misc_feature (331)..(331): n is a, c, g, or t
  modified_base (401)..(409): a, c, t, g, unknown or other
  misc_feature (401)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaacatcagcagactggagcctgaagattttgcagtgtattactgtcagcagtacggtagttcatctccgacgttcggccaagggaccaaggtggaaatcaaacgaactgnggctgcaccatctgtcttcatcttcccgcatctgagtgtgtgtactgagcgggctggcaaggcgcatagnnnnnnnnn

SEQ ID NO: 238499 - DNA, 401 bp, Homo sapiens
  misc_feature: GYAE6OF02G3HEK.33.60.F05.1.454.CMB.1.raw
  modified_base (398)..(401): a, c, t, g, unknown or other
  misc_feature (398)..(401): n is a, c, g, or t
tcagtacacacactcacgaccggtgctcgatttagtacgtcatcagggaaagggccaccctctcttgtagggccagtcagagtgctggcagcaacttagcctggtaccaacaaaaacctggccagactcccaggctcctcatctatgatgcatccaccagggccactggcatcccagccaggttcagtggcagtgggtctgggacagacttcactctcaccatcagcagcctagagcctgaagattttgcagtttattactgtctgcagcgtagcaactggcctaacaccttcggccaagggacacgactggagattaaacgaactgtggctgcacatctgtcttcatcttcccgcatctgaagtgtgtgtactgagcgggctggcaaggcgcatagnnnn

SEQ ID NO: 238500 - DNA, 407 bp, Homo sapiens
  misc_feature: GYAE6OF02GQNZG.33.60.F05.1.454.CMB.1.raw
  modified_base (395)..(395): a, c, t, g, unknown or other
  misc_feature (395)..(395): n is a, c, g, or t
  modified_base (401)..(407): a, c, t, g, unknown or other
  misc_feature (401)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtttattactgtcagcagcgtagcaactggtcttggacgttcggccaagggaccaaggtggaaatcaaacgactgtggctgcacatctgtcttcatcttcccgcatctgaagtgtgtgtactgagcgggctgggcaaggcncatagnnnnnnn

SEQ ID NO: 238501 - DNA, 411 bp, Homo sapiens
  misc_feature: GYAE6OF02G78KU.33.60.F05.1.454.CMB.1.raw
  modified_base (385)..(385): a, c, t, g, unknown or other
  misc_feature (385)..(385): n is a, c, g, or t
  modified_base (402)..(411): a, c, t, g, unknown or other
  misc_feature (402)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccagtctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtgaaatcaaacgaactgtggctgcaccatctgtcttcatcttcccgcatctgaagtgtgtgtactgagcgggntgggcaaggcgcatagnnnnnnnnnn

SEQ ID NO: 238502 - DNA, 408 bp, Homo sapiens
  misc_feature: GYAE6OF02HSNFE.33.60.F05.1.454.CMB.1.raw
  modified_base (400)..(408): a, c, t, g, unknown or other
  misc_feature (400)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcacatctgtcttcatcttcccgcatctgaagtgtgtgtactgagcgggctggcaaggcgcatagnnnnnnnnn

SEQ ID NO: 238503 - DNA, 403 bp, Homo sapiens
  misc_feature: GYAE6OF02IQGRL.33.60.F05.1.454.CMB.1.raw
  modified_base (398)..(403): a, c, t, g, unknown or other
  misc_feature (398)..(403): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcaacttacttctgtcaacacagttacaatctccgtacacttttggccaggggaccaagctgagatcaggcgaactgtgctgcaccatctgtcttcatcttcccgcatctgaagtgtgtgtactgagcggctggcaaggcgcatagnnnnnn

SEQ ID NO: 238504 - DNA, 408 bp, Homo sapiens
  misc_feature: GYAE6OF02IHN24.33.60.F05.1.454.CMB.1.raw
  modified_base (401)..(408): a, c, t, g, unknown or other
  misc_feature (401)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtcttcatcttcccgccatctgaagtgtgtgtactgagcgggctggcaggcgcatagnnnnnnnn

SEQ ID NO: 238505 - DNA, 406 bp, Homo sapiens
  misc_feature: GYAE6OF02GVGUO.33.60.F05.1.454.CMB.1.raw
  modified_base (399)..(406): a, c, t, g, unknown or other
  misc_feature (399)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgactgtggctgcacatctgtcttcatcttcccgcatctgaagtgtgtgtactgagcgggctggcaaggcgcatagnnnnnnnn

SEQ ID NO: 238506 - DNA, 406 bp, Homo sapiens
  misc_feature: GYAE6OF02HLH7Q.33.60.F05.1.454.CMB.1.raw
  modified_base (391)..(391): a, c, t, g, unknown or other
  misc_feature (391)..(391): n is a, c, g, or t
  modified_base (397)..(406): a, c, t, g, unknown or other
  misc_feature (397)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctccgacgttcgccaagggaccaaggtgaaatcaaacgactgtggctgcacatctgtcttcatcttcccgcatctgaagtgtgtgtactgagcgggctggcaaggcncatagnnnnnnnnnn

SEQ ID NO: 238507 - DNA, 408 bp, Homo sapiens
  misc_feature: GYAE6OF02I1DOW.33.60.F05.1.454.CMB.1.raw
  modified_base (239)..(239): a, c, t, g, unknown or other
  misc_feature (239)..(239): n is a, c, g, or t
  modified_base (393)..(393): a, c, t, g, unknown or other
  misc_feature (393)..(393): n is a, c, g, or t
  modified_base (398)..(408): a, c, t, g, unknown or other
  misc_feature (398)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacgtagttcatctccgacgttcgccaagggaccaaggtggaaatcaaacgaactgtggctgcacatctgtcttcatcttcccgctatctgaagtgtgtgtactgagcgggctggcaggcnatagnnnnnnnnnnn

SEQ ID NO: 238508 - DNA, 410 bp, Homo sapiens
  misc_feature: GYAE6OF02JEXVD.33.60.F05.1.454.CMB.1.raw
  modified_base (239)..(239): a, c, t, g, unknown or other
  misc_feature (239)..(239): n is a, c, g, or t
  modified_base (399)..(410): a, c, t, g, unknown or other
  misc_feature (399)..(410): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacgtagttcatctccgacgttcggccaagggaccaaggtgaaatcaaacgactgtggctgcaccatctgtcttcatcttcccgcatctgaagtgtgtgtactgagcgggctggcaaggcgcatagnnnnnnnnnnnn

SEQ ID NO: 238509 - DNA, 414 bp, Homo sapiens
  misc_feature: GYAE6OF02F11DB.33.60.F05.1.454.CMB.1.raw
  modified_base (405)..(414): a, c, t, g, unknown or other
  misc_feature (405)..(414): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcggcctccagtctgaagattttgcagtttattactgtcagcagtatactaactggcctcccatgtacacttttggccaggggaccaagctggagatcaaacgactgtggctgcacatctgtcttcatcttcccgcatctgagtgtgtgtactgagcgggctggcaaggcgcatagnnnnnnnnnn

SEQ ID NO: 238510 - DNA, 405 bp, Homo sapiens
  misc_feature: GYAE6OF02HRGYL.33.60.F05.1.454.CMB.1.raw
  modified_base (391)..(391): a, c, t, g, unknown or other
  misc_feature (391)..(391): n is a, c, g, or t
  modified_base (397)..(405): a, c, t, g, unknown or other
  misc_feature (397)..(405): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctccgacgttcggccaagggaccaaggtggaaatcaaacgaactgtgctgcacatctgtctcatcttcccgcatctgaagtgtgtgtactgagcggctggcaaggcncatagnnnnnnnnn

SEQ ID NO: 238511 - DNA, 412 bp, Homo sapiens
  misc_feature: GYAE6OF02IIGE9.33.60.F05.1.454.CMB.1.raw
  modified_base (404)..(412): a, c, t, g, unknown or other
  misc_feature (404)..(412): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgaagtgtgtgtactgagcgggctgggcaaggcgcatagnnnnnnnnn

SEQ ID NO: 238512 - DNA, 413 bp, Homo sapiens
  misc_feature: GYAE6OF02JX1OF.33.60.F05.1.454.CMB.1.raw
  modified_base (239)..(239): a, c, t, g, unknown or other
  misc_feature (239)..(239): n is a, c, g, or t
  modified_base (378)..(378): a, c, t, g, unknown or other
  misc_feature (378)..(378): n is a, c, g, or t
  modified_base (401)..(403): a, c, t, g, unknown or other
  misc_feature (401)..(403): n is a, c, g, or t
  modified_base (405)..(413): a, c, t, g, unknown or other
  misc_feature (405)..(413): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggaccaaggtgaaatcaaacgactgtgctgcacatctgtcttcatcttccgccatctgaagtgtgtgtactgagngggctggccaaggcgacgatagnnnannnnnnnnn

SEQ ID NO: 238513 - DNA, 408 bp, Homo sapiens
  misc_feature: GYAE6OF02G76UW.33.60.F05.1.454.CMB.1.raw
  modified_base (396)..(396): a, c, t, g, unknown or other
  misc_feature (396)..(396): n is a, c, g, or t
  modified_base (402)..(408): a, c, t, g, unknown or other
  misc_feature (402)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtcttcatcttcccgccatctgaagtgtgtgtactgagcgggctggcaaggcncatagnnnnnnn

SEQ ID NO: 238514 - DNA, 411 bp, Homo sapiens
  misc_feature: GYAE6OF02JQ0US.33.60.F05.1.454.CMB.1.raw
  modified_base (402)..(411): a, c, t, g, unknown or other
  misc_feature (402)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgaagtgtgtgtactgagcgggctggcaaggcgcatagnnnnnnnnnn

SEQ ID NO: 238515 - DNA, 409 bp, Homo sapiens
  misc_feature: GYAE6OF02F6MFJ.33.60.F05.1.454.CMB.1.raw
  modified_base (401)..(409): a, c, t, g, unknown or other
  misc_feature (401)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtcttcatcttcccgcatctgaagtgtgtgtactgagcgggctggcaaggcgcatagnnnnnnnnn

SEQ ID NO: 238516 - DNA, 401 bp, Homo sapiens
  misc_feature: GYAE6OF02GEOXT.33.60.F05.1.454.CMB.1.raw
  modified_base (395)..(401): a, c, t, g, unknown or other
  misc_feature (395)..(401): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcctctatggtgcatccaccagggccactggcatcccagacaggttcagtggcagtgggtctgggacagacttcactctcaccatcgacagactggagcctgaagattttgcagtctattactgtcagcagtatactggggagacgttcggccaagggaccaaggtggaaatcaaacgaactgtggctgcaccatctgtcttcatcttcccgcatctgaagtgtgtgtactgagcgggctggcaaggcgcatgnnnnnnn

SEQ ID NO: 238517 - DNA, 407 bp, Homo sapiens
  misc_feature: GYAE6OF02HP09D.33.60.F05.1.454.CMB.1.raw
  modified_base (401)..(407): a, c, t, g, unknown or other
  misc_feature (401)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttaatctccgacgttcggccaagggccaaggtggaaatcaaacgaactgtggctgcaccatctgtcttcatcttcccgcatctgaagtgtgtgtactgagcgggctggcaaggcgcatagnnnnnnn

SEQ ID NO: 238518 - DNA, 413 bp, Homo sapiens
  misc_feature: GYAE6OF02H75HJ.33.60.F05.1.454.CMB.1.raw
  modified_base (350)..(350): a, c, t, g, unknown or other
  misc_feature (350)..(350): n is a, c, g, or t
  modified_base (402)..(413): a, c, t, g, unknown or other
  misc_feature (402)..(413): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgagttcggccaagggaccaaggtggaaatcaaacgaactgtggctgcacatctgtcttcntcttcccgcatctgaagtgtgtgtactgagcgggctggcaaggcgcagtagnnnnnnnnnnnn

SEQ ID NO: 238519 - DNA, 405 bp, Homo sapiens
  misc_feature: GYAE6OF02FVSBZ.33.60.F05.1.454.CMB.1.raw
  modified_base (284)..(284): a, c, t, g, unknown or other
  misc_feature (284)..(284): n is a, c, g, or t
  modified_base (395)..(405): a, c, t, g, unknown or other
  misc_feature (395)..(405): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtctattactgtcagcagtatactgggganacgttcggccaagggaccaaggtggaaatcaaacgactgtggctgcaccatctgtcttcatcttcccgcatctgaagtgtgtgtactgagcgggctggcaaggcgcatagnnnnnnnnnnn

SEQ ID NO: 238520 - DNA, 411 bp, Homo sapiens
  misc_feature: GYAE6OF02I3W04.33.60.F05.1.454.CMB.1.raw
  modified_base (380)..(380): a, c, t, g, unknown or other
  misc_feature (380)..(380): n is a, c, g, or t
  modified_base (393)..(393): a, c, t, g, unknown or other
  misc_feature (393)..(393): n is a, c, g, or t
  modified_base (398)..(411): a, c, t, g, unknown or other
  misc_feature (398)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgagattttgcagtgtattactgtcagtcagtacgtagttcatctcgacgttcggccaaggaccaaggtggaaatcaaacgaactgtaggctgcacatactgtctcatcttccgcctatctgaagtgtgtgtactgagnggctggcaaggcnatagnnnnnnnnnnnnnn

SEQ ID NO: 238521 - DNA, 416 bp, Homo sapiens
  misc_feature: GYAE6OF02GE0XY.33.60.F05.1.454.CMB.1.raw
  modified_base (405)..(416): a, c, t, g, unknown or other
  misc_feature (405)..(416): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgaagtgtgtgtactggagcgggctgggcaaggcgcatagnnnnnnnnnnnn

SEQ ID NO: 238522 - DNA, 410 bp, Homo sapiens
  misc_feature: GYAE6OF02GDP42.33.60.F05.1.454.CMB.1.raw
  modified_base (402)..(410): a, c, t, g, unknown or other
  misc_feature (402)..(410): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgaagtgtgtgtactgagcgggctggcaaggcgcatagnnnnnnnnn

SEQ ID NO: 238523 - DNA, 408 bp, Homo sapiens
  misc_feature: GYAE6OF02HE6MX.33.60.F05.1.454.CMB.1.raw
  modified_base (396)..(396): a, c, t, g, unknown or other
  misc_feature (396)..(396): n is a, c, g, or t
  modified_base (401)..(408): a, c, t, g, unknown or other
  misc_feature (401)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtgaaatcaaacgaactgtggctgcaccatctgtcttcatcttcccgctatctgaagtgtgtgtactgagcggctggcaaggcgnatagnnnnnnnn

SEQ ID NO: 238524 - DNA, 425 bp, Homo sapiens
  misc_feature: GYAE6OF02HEUBA.33.60.F05.1.454.CMB.1.raw
  modified_base (402)..(402): a, c, t, g, unknown or other
  misc_feature (402)..(402): n is a, c, g, or t
  modified_base (409)..(425): a, c, t, g, unknown or other
  misc_feature (409)..(425): n is a, c, g, or t
tcagtacacacactcacgaccggtgctcgatttagtacgtcatcaggggaaaggggccgaccctcgtcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgaagttcggccaagggaccaaaggtcggaaatcaaacgaactgtggctgcacatctgtctcatcttccgccatctagagtgtgtgtactgaagcgggctggcaagggcncgatagnnnnnnnnnnnnnnnnn

SEQ ID NO: 238525 - DNA, 426 bp, Homo sapiens
  misc_feature: GYAE6OF02IZMTG.33.60.F05.1.454.CMB.1.raw
  modified_base (408)..(426): a, c, t, g, unknown or other
  misc_feature (408)..(426): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctccgacgttcggcctaagggacccaagggtggaaaatcgaaaacgaactgtaggctgacacatctgtcttcatcttccgcatctgatgtgtgtactgagcgggctggcaaggcgacagtacgnnnnnnnnnnnnnnnnnnn

SEQ ID NO: 238526 - DNA, 419 bp, Homo sapiens
  misc_feature: GYAE6OF02I00BY.33.60.F05.1.454.CMB.1.raw
  modified_base (398)..(399): a, c, t, g, unknown or other
  misc_feature (398)..(399): n is a, c, g, or t
  modified_base (401)..(419): a, c, t, g, unknown or other
  misc_feature (401)..(419): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcgacagactggagcctgaagattttgcagtctattactgtcagcagtatactggggagacgttcggccaagggaccaagggtggaaatcaaaacgaactgtggctgcacatctgtcttcatcttccgcatctgagtgtgtgtactgagcgggctgggccaaggcgacatagnncnnnnnnnnnnnnnnnnnnn

SEQ ID NO: 238527 - DNA, 407 bp, Homo sapiens
  misc_feature: GYAE6OF02FGJEC.33.60.F05.1.454.CMB.1.raw
  modified_base (343)..(343): a, c, t, g, unknown or other
  misc_feature (343)..(343): n is a, c, g, or t
  modified_base (402)..(407): a, c, t, g, unknown or other
  misc_feature (402)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgtttcggccaagggccaaggtggaaatcaaacgaatgtggctgcaccatcngtcttcatcttcccgcatctgaagtgtgtgtactgagcgggctgggcaaggcgcatagnnnnnn

SEQ ID NO: 238528 - DNA, 439 bp, Homo sapiens
  misc_feature: GYAE6OF02JS4NI.33.60.F05.1.454.CMB.1.raw
  modified_base (241)..(241): a, c, t, g, unknown or other
  misc_feature (241)..(241): n is a, c, g, or t
  modified_base (268)..(268): a, c, t, g, unknown or other
  misc_feature (268)..(268): n is a, c, g, or t
  modified_base (417)..(439): a, c, t, g, unknown or other
  misc_feature (417)..(439): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcgagccagactggancctagaagtattttgcagtgtattacngtcagcagtacgtagttcagtctccgacgttcgccaagggacctaaggtcggaaatcaaaacgtaactggtggactgctaccatctgtcttcatcttcccgcatctgtaatgtgtgtactggagcgggtctggcgaaggcgacagtagnnnnnnnnnnnnnnnnnnnnnnn

SEQ ID NO: 238529 - DNA, 409 bp, Homo sapiens
  misc_feature: GYAE6OF02HXUW6.33.60.F05.1.454.CMB.1.raw
  modified_base (385)..(385): a, c, t, g, unknown or other
  misc_feature (385)..(385): n is a, c, g, or t
  modified_base (400)..(409): a, c, t, g, unknown or other
  misc_feature (400)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcaccatctgtctcatcttcccgccatctgaagtgtgtgtactgagcgggntggcaggcgcatagnnnnnnnnnn

SEQ ID NO: 238530 - DNA, 432 bp, Homo sapiens
  misc_feature: GYAE6OF02H3RXT.33.60.F05.1.454.CMB.1.raw
  modified_base (202)..(202): a, c, t, g, unknown or other
  misc_feature (202)..(202): n is a, c, g, or t
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (401)..(432): a, c, t, g, unknown or other
  misc_feature (401)..(432): n is a, c, g, or t
tcagtacacacactcacgaccggtgctcgatttagtacgtcatcaggggaaagggccaccctctcttgtagggccagtcagagtgttagcagcaactacttagcctggccaggtgtctgctggtaccaggctcctcatccatggtgcatccaccagggccactggcatcccagacaggttcagtggcagtgggtctgggacngacttcattctcaccatcagcagactggagcctgaagattttgcagtgtattactgtcagcagtcggtagttcatcctccgactttcggccaagggccaaggtggaaatcaaacgactgngctgcacatctgtnttcatcttcccgctatctagagtgtgtgtactgagcgggctgggcaaggtcgcaattagntnagnnnnnnnnnnnnnnnnnnnnnnnnnnnnnnnn

SEQ ID NO: 238531 - DNA, 414 bp, Homo sapiens
  misc_feature: GYAE6OF02FPM7A.33.60.F05.1.454.CMB.1.raw
  modified_base (403)..(404): a, c, t, g, unknown or other
  misc_feature (403)..(404): n is a, c, g, or t
  modified_base (406)..(414): a, c, t, g, unknown or other
  misc_feature (406)..(414): n is a, c, g, or t
tcagtacacacactcacgaccggtgctcgatttagtacgtcatcagggaaagggccaccctctcttgtagggccagtcagactgttagcagcggcttcttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtgaaatcaaacgaactgtggctgcaccatctgtcttcatcttcccgccatctgaagtgtgtgtactgagcgggctgggcaaggcgcatagnngnnnnnnnnn

SEQ ID NO: 238532 - DNA, 414 bp, Homo sapiens
  misc_feature: GYAE6OF02F2VZW.33.60.F05.1.454.CMB.1.raw
  modified_base (403)..(414): a, c, t, g, unknown or other
  misc_feature (403)..(414): n is a, c, g, or t
tcagtacacacactcacgaccggtgctcgatttagtacgtcatcagggaaagggccaccctctcttgtagggccagtcagagtgttagcagaaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctagtcttcatcttcccgcatctgaagtgtgtgtactgagcgggctggcaaggcgcatagnnnnnnnnnnnn

SEQ ID NO: 238533 - DNA, 416 bp, Homo sapiens
  misc_feature: GYAE6OF02JK1DL.33.60.F05.1.454.CMB.1.raw
  modified_base (239)..(239): a, c, t, g, unknown or other
  misc_feature (239)..(239): n is a, c, g, or t
  modified_base (286)..(286): a, c, t, g, unknown or other
  misc_feature (286)..(286): n is a, c, g, or t
  modified_base (382)..(382): a, c, t, g, unknown or other
  misc_feature (382)..(382): n is a, c, g, or t
  modified_base (398)..(416): a, c, t, g, unknown or other
  misc_feature (398)..(416): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagatttgcagtgtattactgtcagcagtacggtagttcatcnccgacgttcggcaagggaccaaggtggaaatcaaacgatgtggctgcacatctgtcttcatcttcccgccatctgaagtgtgtgtactgagcgggntggcaaggcgcatagnnnnnnnnnnnnnnnnnnn

SEQ ID NO: 238534 - DNA, 427 bp, Homo sapiens
  misc_feature: GYAE6OF02JGML4.33.60.F05.1.454.CMB.1.raw
  modified_base (240)..(240): a, c, t, g, unknown or other
  misc_feature (240)..(240): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
  modified_base (410)..(411): a, c, t, g, unknown or other
  misc_feature (410)..(411): n is a, c, g, or t
  modified_base (413)..(427): a, c, t, g, unknown or other
  misc_feature (413)..(427): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggancctgaagattttgcagtgtattactggtcagcagtacggtagttcatctccgacgttcggccaagggaccaaggtggaaatcaaacgaactgtggactggcaccatctgtcttcatcttcccnccatctnaagtgtgtgtactggacncgggctgggcaaggcgcatagnngnnnnnnnnnnnnnnn

SEQ ID NO: 238535 - DNA, 406 bp, Homo sapiens
  misc_feature: GYAE6OF02IS1Z0.33.60.F05.1.454.CMB.1.raw
  modified_base (395)..(395): a, c, t, g, unknown or other
  misc_feature (395)..(395): n is a, c, g, or t
  modified_base (400)..(406): a, c, t, g, unknown or other
  misc_feature (400)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctcgacgttcgaccaagggaccaaggtggaaatcaaacgaactgtggctgcaccatctgtctcatcttccgccatctgaagtgtgtgtactgagtcgggctggcaggcgnatagnnnnnnn

SEQ ID NO: 238536 - DNA, 407 bp, Homo sapiens
  misc_feature: GYAE6OF02GDM42.33.60.F05.1.454.CMB.1.raw
  modified_base (400)..(407): a, c, t, g, unknown or other
  misc_feature (400)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgactgtggctgcaccatctgtcttcatcttcccgcatctgaagtgtgtgtactgagcgggctggcaaggcgcatagnnnnnnnn

SEQ ID NO: 238537 - DNA, 407 bp, Homo sapiens
  misc_feature: GYAE6OF02GOXQQ.33.60.F05.1.454.CMB.1.raw
  modified_base (397)..(397): a, c, t, g, unknown or other
  misc_feature (397)..(397): n is a, c, g, or t
  modified_base (401)..(407): a, c, t, g, unknown or other
  misc_feature (401)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttcccgccatctgaagtgtgtgtactgagcgggctggcaaggcgnatgnnnnnnn

SEQ ID NO: 238538 - DNA, 407 bp, Homo sapiens
  misc_feature: GYAE6OF02HYI7M.33.60.F05.1.454.CMB.1.raw
  modified_base (401)..(407): a, c, t, g, unknown or other
  misc_feature (401)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcaccatctgtcttcatcttcccgccatctgagtgtgtgtactgagcgggctgggcaaggcgcatgnnnnnnn

SEQ ID NO: 238539 - DNA, 428 bp, Homo sapiens
  misc_feature: GYAE6OF02H9KAT.33.60.F05.1.454.CMB.1.raw
  modified_base (241)..(241): a, c, t, g, unknown or other
  misc_feature (241)..(241): n is a, c, g, or t
  modified_base (413)..(413): a, c, t, g, unknown or other
  misc_feature (413)..(413): n is a, c, g, or t
  modified_base (419)..(428): a, c, t, g, unknown or other
  misc_feature (419)..(428): n is a, c, g, or t
tcagtacacacactcacgaccggtgctcgatttagtacgtcatcagggaaaggggctggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagttagcagtggctggtatcctttnttccagcactggggccagggtaccctggtcaccgtctcctcagcctccaccaagggcccatcggtcttccccctggccgccctgctccaggagcacctccgagagcacagcggccctgggctgcctggtcaaggctacttccagtgtgtgtactgagcgggctggcaaggcncatagnnnnnnnnnn

SEQ ID NO: 238540 - DNA, 409 bp, Homo sapiens
  misc_feature: GYAE6OF02IOC4Z.33.60.F05.1.454.CMB.1.raw
  modified_base (397)..(409): a, c, t, g, unknown or other
  misc_feature (397)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgactgtgctgacacatctgtcttcatctcccgcatctagagtgtgtgtactgagcggctggacgaggcgcatgnnnnnnnnnnnnn

SEQ ID NO: 238541 - DNA, 577 bp, Homo sapiens
  misc_feature: GYAE6OF02H42EL.33.60.F05.1.454.CMB.1.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (243)..(243): a, c, t, g, unknown or other
  misc_feature (243)..(243): n is a, c, g, or t
  modified_base (531)..(531): a, c, t, g, unknown or other
  misc_feature (531)..(531): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (548)..(548): a, c, t, g, unknown or other
  misc_feature (548)..(548): n is a, c, g, or t
  modified_base (550)..(551): a, c, t, g, unknown or other
  misc_feature (550)..(551): n is a, c, g, or t
  modified_base (553)..(553): a, c, t, g, unknown or other
  misc_feature (553)..(553): n is a, c, g, or t
  modified_base (555)..(577): a, c, t, g, unknown or other
  misc_feature (555)..(577): n is a, c, g, or t
tcagtacacacactcacgaccggtgctcgatttagtacgtcatcagggaaagggccgaccctctcttgtagggccagtcagagtgttagcagcaactacttagcctggtaccagcagacacctggccaggctcccaggctcctcatccatggtgcatccaccagggccactggcactcccaagacaggttcagtggcaggtgggtcngggacagacttcatttcnaccatcagcagatgggancctgaagattttagcagttgattactagtcagcgagtacggtagttcattcgtaccgtacgttcggacccgaagggaaccctaaggtaggaaaacgttaccaaaacggtaccgttaggtaggtacctacggacctaaccagttcgttacgttccgtttactaacgttccctttacccggacccttaatcccgtttaggaaaccgtttgttacggtttggtaaccctttagggaccggtcggggtccgttacgggggtaccaaacggggttccaccggaaagtttaggntcgtagtgngngcgtgngnngngnnnnnnnnnnnnnnnnnnnnnnn

SEQ ID NO: 238542 - DNA, 412 bp, Homo sapiens
  misc_feature: GYAE6OF02GATOP.33.60.F05.1.454.CMB.1.raw
  modified_base (403)..(412): a, c, t, g, unknown or other
  misc_feature (403)..(412): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgaagtgtgtgtactgagcgggctggcaaggcgcatagnnnnnnnnnn

SEQ ID NO: 238543 - DNA, 411 bp, Homo sapiens
  misc_feature: GYAE6OF02ILYW7.33.60.F05.1.454.CMB.1.raw
  modified_base (400)..(411): a, c, t, g, unknown or other
  misc_feature (400)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtctgcagcgtagcaactggcctaacaccttcggccaagggacacgactggagattaaacgactgtgctgcacatctgtcttcatcttcccgccatctgagtgtgtgtactgagcgggctgggcaaggcgcatagnnnnnnnnnnnn

SEQ ID NO: 238544 - DNA, 406 bp, Homo sapiens
  misc_feature: GYAE6OF02GNTTU.33.60.F05.1.454.CMB.1.raw
  modified_base (401)..(406): a, c, t, g, unknown or other
  misc_feature (401)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcacatctgtcttcatcttccgcctatctgaagtgtgtgtactgagcgggctggcaaggcgcatagnnnnnn

SEQ ID NO: 238545 - DNA, 406 bp, Homo sapiens
  misc_feature: GYAE6OF02HDU8Q.33.60.F05.1.454.CMB.1.raw
  modified_base (239)..(239): a, c, t, g, unknown or other
  misc_feature (239)..(239): n is a, c, g, or t
  modified_base (394)..(394): a, c, t, g, unknown or other
  misc_feature (394)..(394): n is a, c, g, or t
  modified_base (400)..(406): a, c, t, g, unknown or other
  misc_feature (400)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggaccaaggtggaaatcaaacgaactgtggctgcacatctgtcttcatctcccgcatctgaagtgtgtgtactgagcgggctggcaaggcncatagnnnnnnn

SEQ ID NO: 238546 - DNA, 407 bp, Homo sapiens
  misc_feature: GYAE6OF02IWZB7.33.60.F05.1.454.CMB.1.raw
  modified_base (220)..(220): a, c, t, g, unknown or other
  misc_feature (220)..(220): n is a, c, g, or t
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
  modified_base (394)..(407): a, c, t, g, unknown or other
  misc_feature (394)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattcncacatcagcagactggagcctgaagatttgcagtgtattactgtcagcagtacggtagttcatctccgacgttcggaccaagggaccaaggtgaaatcaaacgatgtgctgcacanctgtctcatcttcccgcatctgaagtgngtgtacngagcggctggcaaggcncagtgnnnnnnnnnnnnnn

SEQ ID NO: 238547 - DNA, 607 bp, Homo sapiens
  misc_feature: GYAE6OF02I3Z6J.33.60.F05.1.454.CMB.1.raw
  modified_base (213)..(213): a, c, t, g, unknown or other
  misc_feature (213)..(213): n is a, c, g, or t
  modified_base (237)..(237): a, c, t, g, unknown or other
  misc_feature (237)..(237): n is a, c, g, or t
  modified_base (264)..(264): a, c, t, g, unknown or other
  misc_feature (264)..(264): n is a, c, g, or t
  modified_base (342)..(342): a, c, t, g, unknown or other
  misc_feature (342)..(342): n is a, c, g, or t
  modified_base (480)..(480): a, c, t, g, unknown or other
  misc_feature (480)..(480): n is a, c, g, or t
tcagtacacacactcacgaccggtgctcgatttagtacgtcatcagggaaagggccacctctcttgtaggccagtcagagtgttagcagcaactacttagcctggtaccagcagacacctggccaggctccaggctcctcatccatggtgcatccaccagggccactggcatcccagacaggttcagtggcaggtgggtctgggacagacttnattctcacatcagcagactggacncctgaagtattttgctagtgtaattcngtcagcagtacgtagtcatctcgacgttcgccaaggtaccaggtgaaatcaaacgaactgtaggcttgactccgaatntcgtacgttcatttaccgttcccgacacgttccgtagtaaagttcggtacgttggtaaaccttcggaaggtccggggttactaggggtaccgttaaacggtccgggacgtaaacgtttaacgggctttaaaccgggtntacgtacgtacgtacgtacgtacgtacgtacgtacgtacgtacgtacgtacgtacgtacgtacgtacgtacgtacgtacgtacgtacgtacgtcgtacgtacgtacgtacgtacgtacgtacgtacg

SEQ ID NO: 238548 - DNA, 432 bp, Homo sapiens
  misc_feature: GYAE6OF02G6HAN.33.60.F05.1.454.CMB.1.raw
  modified_base (421)..(432): a, c, t, g, unknown or other
  misc_feature (421)..(432): n is a, c, g, or t
tcagtacacacactcacgaccggtgctcgatttagtacgtcatcagggaaggggctggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagttagcagtggctggtatcctttcttccagcactggggccagggtaccctggtcaccgtctcctcagcctcaccaagggcccatcggtcttccccctggccgccctgctccaagagcacctccgagagcacagccggccctgggctgcctggtcaaggactacttccagtgtgtgtactgagcgggctggcaagggcgcataggnnnnnnnnnnnn

SEQ ID NO: 238549 - DNA, 403 bp, Homo sapiens
  misc_feature: GYAE6OF02JFQH5.33.60.F05.1.454.CMB.1.raw
  modified_base (240)..(240): a, c, t, g, unknown or other
  misc_feature (240)..(240): n is a, c, g, or t
  modified_base (280)..(280): a, c, t, g, unknown or other
  misc_feature (280)..(280): n is a, c, g, or t
  modified_base (337)..(337): a, c, t, g, unknown or other
  misc_feature (337)..(337): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (396)..(403): a, c, t, g, unknown or other
  misc_feature (396)..(403): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcatactggancctgaagattttgcagtgtattactgtcagcagtacggtnttcatctccgacgttcggcaagggaccaaggtagaaatcaaacgactgtgctgcacntctgtcttcatcttcccgcatctgagtgtgtgtactgagcggntggacaggcncatagnnnnnnnn

SEQ ID NO: 238550 - DNA, 452 bp, Homo sapiens
  misc_feature: GYAE6OF02GT0QX.33.60.F05.1.454.CMB.1.raw
  modified_base (406)..(406): a, c, t, g, unknown or other
  misc_feature (406)..(406): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
  modified_base (426)..(452): a, c, t, g, unknown or other
  misc_feature (426)..(452): n is a, c, g, or t
tcagtacacacactcacgaccggtgctcgatttagtacgtcatcagggaaagggggctggagtgggtcgcaactattagtggcggtggaactcatacatactacgccgactccgtgaagggccgcttcaccatctccagagacaattccaaacaacacggtgtttctgcaaatgaatagcctgagagtcgaggacatggccatatattactgtgcgagagttagcagtggctggtatcctttctccagcacgtgggccagggtaccctaggtcaccgtctcctcagcctccaccaagggcccatcggtcttccccctggcacccgtcctccaagagcacctctgggggcacagcggccctgggctgcctggtcaaggactacttccagtgtgtgtactgagcgggntggcaaggcgcatagnangnnnnnnnnnnnnnnnnnnnnnnnnnnn

SEQ ID NO: 238551 - DNA, 403 bp, Homo sapiens
  misc_feature: GYAE6OF02HA3UA.33.60.F05.1.454.CMB.1.raw
  modified_base (392)..(392): a, c, t, g, unknown or other
  misc_feature (392)..(392): n is a, c, g, or t
  modified_base (398)..(403): a, c, t, g, unknown or other
  misc_feature (398)..(403): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagccaggttcagtggcggtgggtctggggacagacttcactctcaccatcagcagcctagagcctgaagattttgcagtttatactgtcagcagcgtagcaactggtcttggacgttcggcaagggaccaaggtggaaatcaaacgactgtggctgcacatctgtctcatctcccgcatctgaagtgtgtgtactgaggcgggctggcaaggcncatagnnnnnn

SEQ ID NO: 238552 - DNA, 419 bp, Homo sapiens
  misc_feature: GYAE6OF02GP1SS.33.60.F05.1.454.CMB.1.raw
  modified_base (408)..(419): a, c, t, g, unknown or other
  misc_feature (408)..(419): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcactctcccgcatctgagtgtgtgtactggacggcggcgtggacgaaggcgctagtgnnnnnnnnnnnn

SEQ ID NO: 238553 - DNA, 437 bp, Homo sapiens
  misc_feature: GYAE6OF02FMO2F.33.60.F05.1.454.CMB.1.raw
  modified_base (355)..(355): a, c, t, g, unknown or other
  misc_feature (355)..(355): n is a, c, g, or t
  modified_base (415)..(417): a, c, t, g, unknown or other
  misc_feature (415)..(417): n is a, c, g, or t
  modified_base (419)..(437): a, c, t, g, unknown or other
  misc_feature (419)..(437): n is a, c, g, or t
tcagtacacacactcacgaccggtgctcgatttagtacgtcatcagggaaagggccgaccctctcttgtagggccagtcagagtgttagcagcaactacttagcctggtaccagcagacacctggccaggctcccaggctcctcatccatggtagcatccaccagggccactggcatcccagacaggttcagtggcagtgggtctgggacagacttcattctcaaccatcagctagactggagcctgaagatttgcagtgtattactgtcagcagtacggtagttcatctccgacgttcggccaagggacccaaggtgaaatcaaacgactgtcgctgacgaccatctgtccttnatcctcccgccatctgaacgtgtcgtgtactgagcgggctggcgaaggcgaccagtacgnnncnnnnnnnnnnnnnnnnnnn

SEQ ID NO: 238554 - DNA, 587 bp, Homo sapiens
  misc_feature: GYAE6OF02I1CA8.33.60.F05.1.454.CMB.1.raw
  modified_base (486)..(486): a, c, t, g, unknown or other
  misc_feature (486)..(486): n is a, c, g, or t
  modified_base (495)..(495): a, c, t, g, unknown or other
  misc_feature (495)..(495): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
  modified_base (523)..(523): a, c, t, g, unknown or other
  misc_feature (523)..(523): n is a, c, g, or t
  modified_base (530)..(530): a, c, t, g, unknown or other
  misc_feature (530)..(530): n is a, c, g, or t
  modified_base (549)..(549): a, c, t, g, unknown or other
  misc_feature (549)..(549): n is a, c, g, or t
  modified_base (585)..(585): a, c, t, g, unknown or other
  misc_feature (585)..(585): n is a, c, g, or t
tcagtacacacactcacgaccggtgctcgatttagtacgtcatcagggaaaggggccaaccctactcttgtacgggccagtcagacgtgttagcagacaacctacttagcctggtaccagcagacacctggtccaggctccaggctcctcagtccactggtcgcactccacctagggccactggcagtcccagacaggttcagtcggcgagtgggtctgggactacgacttcattctcaccatcagtcagacgtggagcctagaacgtattttggctacggtcgtaagttaccgtgtacgagtcgagttacggtagttcgatcgtccgtacgttcggccaagggaccaaggtggaaatacaaaacgtactaggtacggactcgacgtaccagtacgtacgtctttacacgttccttacccgacctacgtccgtagtaacgtttgtagttacgtacgtggacgtcggggctcgggacgaacggcganacgtacgancgantcgatnttgngcgtacgtgtacgngtacgtntattagctgtatcgttacncgtacgtacggacgtacgtacgtcgtacgtcgtctncg

SEQ ID NO: 238555 - DNA, 414 bp, Homo sapiens
  misc_feature: GYAE6OF02F4RS9.33.60.F05.1.454.CMB.1.raw
  modified_base (405)..(414): a, c, t, g, unknown or other
  misc_feature (405)..(414): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgaagtgtgtgtactgagcgggctggcaaggcgcgatagnnnnnnnnnn

SEQ ID NO: 238556 - DNA, 621 bp, Homo sapiens
  misc_feature: GYAE6OF02I3Y9F.33.60.F05.1.454.CMB.1.raw
  modified_base (117)..(117): a, c, t, g, unknown or other
  misc_feature (117)..(117): n is a, c, g, or t
  modified_base (146)..(146): a, c, t, g, unknown or other
  misc_feature (146)..(146): n is a, c, g, or t
  modified_base (375)..(375): a, c, t, g, unknown or other
  misc_feature (375)..(375): n is a, c, g, or t
  modified_base (603)..(621): a, c, t, g, unknown or other
  misc_feature (603)..(621): n is a, c, g, or t
tcagtacacacactcacgaccggtgctcgatttagtacgtcatcagggaaagggccaccctctcttgtagggccagtcagagtgttagcagcaactacttagcctggtaccagcganaccacgtcgcgagcctaccgagcctccanactccagtggtcgactactacccaaccggaccgggaccctacggtcggactaccctacccgaacgacgttacggttacgtagggtcggacgtaggggttcgggttcggtacgggaacctaacgttacctttactacctttccacccaacctactacgacgacgaacgtacggtgggacctccgtaaggaacgtttagtttcgacgtaggttagttaacttacgtcgtanacgcgtaacggttacggttactactacttccgtaccggttaccggtccgaaccggaacggaacggtaaggtaacgtaaactaaccgaaacgtaacgtggtacgtcgtacgaccaacctcttcgttacgttcttactcctttccccgtcccgactactcgtaaggtagttgttacgtacgttacggtggaccgggtcggttcggaggacggaacggcgtaactaagtgnnnnnnnnnnnnnnnnnnn

SEQ ID NO: 238557 - DNA, 422 bp, Homo sapiens
  misc_feature: GYAE6OF02JGXR8.33.60.F05.1.454.CMB.1.raw
  modified_base (395)..(395): a, c, t, g, unknown or other
  misc_feature (395)..(395): n is a, c, g, or t
  modified_base (402)..(402): a, c, t, g, unknown or other
  misc_feature (402)..(402): n is a, c, g, or t
  modified_base (405)..(422): a, c, t, g, unknown or other
  misc_feature (405)..(422): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcactctcaccatcagcagcctagagcctgaagattttgcagtttattactgtcagcagtatactggggagacgttcggccaaggggaccaagggtggaaatcaaacgactgtggctgcacatctgtcttcatcttcccgcatctgaagtgtgtgtactgagcgggctgggacaagggtcgnaagtagntgnnnnnnnnnnnnnnnnnn

SEQ ID NO: 238558 - DNA, 418 bp, Homo sapiens
  misc_feature: GYAE6OF02I889E.33.60.F05.1.454.CMB.1.raw
  modified_base (388)..(388): a, c, t, g, unknown or other
  misc_feature (388)..(388): n is a, c, g, or t
  modified_base (404)..(405): a, c, t, g, unknown or other
  misc_feature (404)..(405): n is a, c, g, or t
  modified_base (407)..(418): a, c, t, g, unknown or other
  misc_feature (407)..(418): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaattcaaacgaactgtggctgcaccatctgtcttcatcttcccgccatctgaagtgtgtgtactgagcgggntggcaaggcgcatagnngnnnnnnnnnnnn

SEQ ID NO: 238559 - DNA, 420 bp, Homo sapiens
  misc_feature: GYAE6OF02IJY7G.33.60.F05.1.454.CMB.1.raw
  modified_base (407)..(420): a, c, t, g, unknown or other
  misc_feature (407)..(420): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctggggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgaagtgtgtgtactgagcgggctgggcaagggcgcagtagnnnnnnnnnnnnnn

SEQ ID NO: 238560 - DNA, 411 bp, Homo sapiens
  misc_feature: GYAE6OF02HY63E.33.60.F05.1.454.CMB.1.raw
  modified_base (403)..(411): a, c, t, g, unknown or other
  misc_feature (403)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctcgacgttcggccaagggaccaaggtgaaatcaaacgaactgtaggctgcaccatctagtcttcactcttcccgcatctgaagtgtgtgtacgtgagcgggctggcaggcgcatagnnnnnnnnn

SEQ ID NO: 238561 - DNA, 647 bp, Homo sapiens
  misc_feature: GYAE6OF02I3HMX.33.60.F05.1.454.CMB.1.raw
  modified_base (321)..(321): a, c, t, g, unknown or other
  misc_feature (321)..(321): n is a, c, g, or t
  modified_base (632)..(632): a, c, t, g, unknown or other
  misc_feature (632)..(632): n is a, c, g, or t
  modified_base (639)..(639): a, c, t, g, unknown or other
  misc_feature (639)..(639): n is a, c, g, or t
  modified_base (645)..(645): a, c, t, g, unknown or other
  misc_feature (645)..(645): n is a, c, g, or t
tcagtacacacactcacgaccggtgctcgatttagtacgtcatcaggggaagggccacctctctgtaggccgagtcagagtgttagcagcaacgtaccttagcctggtaccagcgacgaccaccgtggcccaggcgtcccagggcgtcctccatccagtgggtacgctactccaccaggggacccaacttcgggccaacttcccccgacgtaccgtacgggtttccaggttagggcctaagggttgggggtacctagggggaacctaaggtacctttaccatttcctactacccgagtccaaggccaaggacttgggtacncctagtaataattttggactagtagtactacgtcggtacacgtatacgttacggtagttcacttcgtccgtacggttccggacgaacgggtacctaagggtcgaaaacgttcgaaaccgtactggtacggctaggcaccgatcgtgtcttcgatctacccgccatctacgatgtgtactacgtggacgtcgggacttacgggacaacgggtcgttaagaacgtttacggtactagtacacgtacgttacgaggtaactcgtactgtacgttagtcgacgtacgagtagagagacgaagaatcgtgcgagcncgacgtntctctntc

SEQ ID NO: 238562 - DNA, 419 bp, Homo sapiens
  misc_feature: GYAE6OF02IBRSY.33.60.F05.1.454.CMB.1.raw
  modified_base (395)..(395): a, c, t, g, unknown or other
  misc_feature (395)..(395): n is a, c, g, or t
  modified_base (410)..(419): a, c, t, g, unknown or other
  misc_feature (410)..(419): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagtttcatctccgacgtttcggccaagggacccaaagggtggaaaattcgaaacgaactgtaggctgcaccatctgttctcatcttcccgcatctgaagtgtgtgtactgagcgggntggcaggcgcatagnnnnnnnnnn

SEQ ID NO: 238563 - DNA, 430 bp, Homo sapiens
  misc_feature: GYAE6OF02F1JKF.33.60.F05.1.454.CMB.1.raw
  modified_base (412)..(430): a, c, t, g, unknown or other
  misc_feature (412)..(430): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcggtacggtagttcatctccgacgttcggccaagggaccaaggtggaaatcaaacgaactgtggctgcaccatctgtcttcatcttccgcatctgaagtgtgtgtcgcgtgacggcggtcgtcggacgacggcgacagtagnnnnnnnnnnnnnnnnnnn

SEQ ID NO: 238564 - DNA, 414 bp, Homo sapiens
  misc_feature: GYAE6OF02H572P.33.60.F05.1.454.CMB.1.raw
  modified_base (183)..(183): a, c, t, g, unknown or other
  misc_feature (183)..(183): n is a, c, g, or t
  modified_base (239)..(239): a, c, t, g, unknown or other
  misc_feature (239)..(239): n is a, c, g, or t
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (402)..(414): a, c, t, g, unknown or other
  misc_feature (402)..(414): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacnggttcagtggcagtgggtctgggacagacttcattctcaccatcagcagactggancctgaagtattttgcagtgtattacgtgtcagcagtacggtagttcattcgtccgacgttcgaccgaagggaccaaggtggaaatcaaacgatgtgctgcacatctgtctnctcttcccgctatctgtagtgtgtgtactgagtcggntggcaggcncagtgnnnnnnnnnnnnn

SEQ ID NO: 238565 - DNA, 412 bp, Homo sapiens
  misc_feature: GYAE6OF02G5333.33.60.F05.1.454.CMB.1.raw
  modified_base (405)..(412): a, c, t, g, unknown or other
  misc_feature (405)..(412): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgtttcggccaagggaccaaggtggaaatcaaacgaactgtggctggcaccatctgtcttcatcttcccgccatctgaagtgtgtgtactgagcgggctggcaaggcgcatagnnnnnnnn

SEQ ID NO: 238566 - DNA, 425 bp, Homo sapiens
  misc_feature: GYAE6OF02HIHJH.33.60.F05.1.454.CMB.1.raw
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (379)..(379): a, c, t, g, unknown or other
  misc_feature (379)..(379): n is a, c, g, or t
  modified_base (401)..(401): a, c, t, g, unknown or other
  misc_feature (401)..(401): n is a, c, g, or t
  modified_base (407)..(425): a, c, t, g, unknown or other
  misc_feature (407)..(425): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccagaatgcattcaacagggccactggcatcccagccaggttcagtggcagtgggtctgggacagacttcactctcaccatcagcagcctagagcctgaggattctgctagtttatactgtcagcagcgtctcaactggcctccgtgccaccttcggccaagggacacgattggatattagacgaactgtgctgcaccctntgtcttnacttctccgctatctagagtgtgttntactgagcggctggcaaggcanagtagnnnnnnnnnnnnnnnnnnn

SEQ ID NO: 238567 - DNA, 431 bp, Homo sapiens
  misc_feature: GYAE6OF02ICMRN.33.60.F05.1.454.CMB.1.raw
  modified_base (370)..(370): a, c, t, g, unknown or other
  misc_feature (370)..(370): n is a, c, g, or t
  modified_base (410)..(410): a, c, t, g, unknown or other
  misc_feature (410)..(410): n is a, c, g, or t
  modified_base (416)..(431): a, c, t, g, unknown or other
  misc_feature (416)..(431): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagtctgcaacctgaagtattttgactaactttacttctgtacaacactagttacaatcctcccgtactacttttggccagggaccaagctggagatcgaggcgaactgtaggctgccacgatctgtcttcacttctcccncatctgagtgttgtgtacgtgagtcggcgtggctaggcgnatagcnnnnnnnnnnnnnnnn

SEQ ID NO: 238568 - DNA, 410 bp, Homo sapiens
  misc_feature: GYAE6OF02GUEIZ.33.60.F05.1.454.CMB.1.raw
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (402)..(410): a, c, t, g, unknown or other
  misc_feature (402)..(410): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagcgtagcaactggtcttggacgttcggccaagggaccaaggtggaaatcgaaacgaactgtggctgcacatctgtcttcatcttcccgcatctgaagtgtgtgtactgagcgggntggcaaggcncatagnnnnnnnnn

SEQ ID NO: 238569 - DNA, 408 bp, Homo sapiens
  misc_feature: GYAE6OF02GKOHE.33.60.F05.1.454.CMB.1.raw
  modified_base (385)..(385): a, c, t, g, unknown or other
  misc_feature (385)..(385): n is a, c, g, or t
  modified_base (401)..(408): a, c, t, g, unknown or other
  misc_feature (401)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtctcatcttcccgccatctgaagtgtgtgtactgagcgggntggcaaggcgcatagnnnnnnnn

SEQ ID NO: 238570 - DNA, 415 bp, Homo sapiens
  misc_feature: GYAE6OF02GU218.33.60.F05.1.454.CMB.1.raw
  modified_base (404)..(415): a, c, t, g, unknown or other
  misc_feature (404)..(415): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaaggggaccaaggtggaaatcaaaacgaactgtggctgcaccatctgtcttcatccttccgccatctgaagtgtgtgtactgagcgggctggcaggcgcatagnnnnnnnnnnnn

SEQ ID NO: 238571 - DNA, 418 bp, Homo sapiens
  misc_feature: GYAE6OF02F9L0D.33.60.F05.1.454.CMB.1.raw
  modified_base (407)..(418): a, c, t, g, unknown or other
  misc_feature (407)..(418): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcgagtgggtctgggacaggacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatcctgaacgtgtgtgtactgagcgggctggcaaggcgcatagnnnnnnnnnnnn

SEQ ID NO: 238572 - DNA, 522 bp, Homo sapiens
  misc_feature: GYAE6OF02HLCY7.33.60.F05.1.454.CMB.1.raw
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (478)..(481): a, c, t, g, unknown or other
  misc_feature (478)..(481): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
  modified_base (496)..(496): a, c, t, g, unknown or other
  misc_feature (496)..(496): n is a, c, g, or t
  modified_base (501)..(502): a, c, t, g, unknown or other
  misc_feature (501)..(502): n is a, c, g, or t
  modified_base (504)..(506): a, c, t, g, unknown or other
  misc_feature (504)..(506): n is a, c, g, or t
  modified_base (509)..(521): a, c, t, g, unknown or other
  misc_feature (509)..(521): n is a, c, g, or t
tcagtacacacactcacgaccggtgctcgatttagtacgtcatcagggaaaggggccaaccctctcttgtagggccagtcagagtgttagcacgcaactacttagcctggtaccagcagacacctggccaggctcccaggctcctcatccattggtgcatccaccagggccactggcatccagacaggttcagtggcagtggtctgggacagacttcattcgtcacatcagcagtactggacgacctagaagtattttgcgtagttgttacttacgtgtacagcaggtacggttattcatcctccgtacgttcggccgaagggacgaaggtcgaaactacgaaacgtacgtggtacggcgtcgaccgtactcgttcgtacgttcctacttacttcccgtccctactactacgtacgtagtcgtcgttacgtagtacggtacgggacgtcgtacgacgtacgggactagtcgtantnannnnancgtacngatgacngacgnngnnnagnnnnnnnnnnnnnc

SEQ ID NO: 238573 - DNA, 541 bp, Homo sapiens
  misc_feature: GYAE6OF02IOHSV.33.60.F05.1.454.CMB.1.raw
  modified_base (478)..(478): a, c, t, g, unknown or other
  misc_feature (478)..(478): n is a, c, g, or t
  modified_base (492)..(492): a, c, t, g, unknown or other
  misc_feature (492)..(492): n is a, c, g, or t
  modified_base (520)..(520): a, c, t, g, unknown or other
  misc_feature (520)..(520): n is a, c, g, or t
  modified_base (527)..(527): a, c, t, g, unknown or other
  misc_feature (527)..(527): n is a, c, g, or t
tcagtacacacactcacgaccggtgctcgatttagtacgtcatcaggggaaagggccaccctctcttgtagggtccagtcagagttgttagcagcaactacttagcctggtaccagcagacacctgggccaggctcccaggctccgtcactccatggtgccatccaccagggccacgtggcatcccaagacaggttcagtggcaggtgggctagggacagacttcagttctcgacagtcagacagactggagcctgaagtattttacgacaaactttaacttctagtacaaacacagttaacaacgtctcccgtactactttggaccgagggaccaagactaggagatcgagtacgaactagtgctgcaccatctgtcttacatcttccgcaattctgaacgtgtgtagtacgtagagcgggtcttacgggacgtaaacggtccggtacgtaagtaaggtatacagcgcgacgtacanacgacactctcacncgacacgacgacgacgcacgtcgtctcncgcgtcncgacgcgcgatacg

SEQ ID NO: 238574 - DNA, 417 bp, Homo sapiens
  misc_feature: GYAE6OF02F5R8G.33.60.F05.1.454.CMB.1.raw
  modified_base (346)..(346): a, c, t, g, unknown or other
  misc_feature (346)..(346): n is a, c, g, or t
  modified_base (404)..(417): a, c, t, g, unknown or other
  misc_feature (404)..(417): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctccgacgttcggccaagggacaaggtggaaatcaaacgaactgtgctgcacatctgtcttnactcttccgccatctgaagtcgtgtgtactgagcgggcgtggacaaggcgacatagcnnnnnnnnnnnnnn

SEQ ID NO: 238575 - DNA, 407 bp, Homo sapiens
  misc_feature: GYAE6OF02HF651.33.60.F05.1.454.CMB.1.raw
  modified_base (400)..(407): a, c, t, g, unknown or other
  misc_feature (400)..(407): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttcccgcatctgaagtgtgtgtactgagcggctggcaaggcgcatagnnnnnnnn

SEQ ID NO: 238576 - DNA, 425 bp, Homo sapiens
  misc_feature: GYAE6OF02FRDZB.33.60.F05.1.454.CMB.1.raw
  modified_base (343)..(343): a, c, t, g, unknown or other
  misc_feature (343)..(343): n is a, c, g, or t
  modified_base (382)..(382): a, c, t, g, unknown or other
  misc_feature (382)..(382): n is a, c, g, or t
  modified_base (416)..(425): a, c, t, g, unknown or other
  misc_feature (416)..(425): n is a, c, g, or t
tcagtacacacactcacgaccggtgctcgatttagtacgtcatcagggaaaggggctggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagttagcagtggctggtatcctttcttccagcactggggccagggtaccctggtcaccgtctcctcagcctccaccaagggcccatcggtcttccccctggccgccctgctccaggagcacctcganagcacagcggccctgggctgcctggtcaaggctactccngtgtgtgtactgagcgggctggcaggcgcatagnnnnnnnnnn

SEQ ID NO: 238577 - DNA, 411 bp, Homo sapiens
  misc_feature: GYAE6OF02I85YN.33.60.F05.1.454.CMB.1.raw
  modified_base (400)..(411): a, c, t, g, unknown or other
  misc_feature (400)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtgctgcaccatctgtcttcatctcccgcatctgagtgtgtgtactgagcgggctgggcaaggcgcatagnnnnnnnnnnnn

SEQ ID NO: 238578 - DNA, 696 bp, Homo sapiens
  misc_feature: GYAE6OF02FGWWO.33.60.F05.1.454.CMB.1.raw
  modified_base (640)..(640): a, c, t, g, unknown or other
  misc_feature (640)..(640): n is a, c, g, or t
  modified_base (643)..(643): a, c, t, g, unknown or other
  misc_feature (643)..(643): n is a, c, g, or t
  modified_base (646)..(646): a, c, t, g, unknown or other
  misc_feature (646)..(646): n is a, c, g, or t
  modified_base (651)..(651): a, c, t, g, unknown or other
  misc_feature (651)..(651): n is a, c, g, or t
  modified_base (653)..(653): a, c, t, g, unknown or other
  misc_feature (653)..(653): n is a, c, g, or t
  modified_base (659)..(659): a, c, t, g, unknown or other
  misc_feature (659)..(659): n is a, c, g, or t
  modified_base (663)..(663): a, c, t, g, unknown or other
  misc_feature (663)..(663): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
  modified_base (669)..(669): a, c, t, g, unknown or other
  misc_feature (669)..(669): n is a, c, g, or t
  modified_base (672)..(672): a, c, t, g, unknown or other
  misc_feature (672)..(672): n is a, c, g, or t
  modified_base (674)..(674): a, c, t, g, unknown or other
  misc_feature (674)..(674): n is a, c, g, or t
  modified_base (676)..(677): a, c, t, g, unknown or other
  misc_feature (676)..(677): n is a, c, g, or t
  modified_base (679)..(682): a, c, t, g, unknown or other
  misc_feature (679)..(682): n is a, c, g, or t
  modified_base (684)..(685): a, c, t, g, unknown or other
  misc_feature (684)..(685): n is a, c, g, or t
  modified_base (687)..(687): a, c, t, g, unknown or other
  misc_feature (687)..(687): n is a, c, g, or t
  modified_base (689)..(691): a, c, t, g, unknown or other
  misc_feature (689)..(691): n is a, c, g, or t
  modified_base (693)..(693): a, c, t, g, unknown or other
  misc_feature (693)..(693): n is a, c, g, or t
  modified_base (695)..(696): a, c, t, g, unknown or other
  misc_feature (695)..(696): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctccaccatcagcagaccgtggacgcctgaaacgatttttcgacctagttacggttactttaaccgtgttaccaaggtccgtagttaaccggggtttagtttaccaagtcccgttacccggtaaccggtttaccgggaacccgaaaacgggggtaacccaaacgggttaaggtaaaaaccttaccgaaaaacccggtaaacgttcgggtacgggtacccgttacggtaccctaacccgtacgtttacccgttcggtttaacccttttaccgtaaacccgtttccccgtttaccccccggtaccgtaacgtttaccgtacggtaaacggtttcggttaccggtacggtttaccgtcggggaaccggtcccgggggtaccgttacggggaaccgtaacggggaccggtaccttaagtacggacncgntcncgacncncagtcncgancncngncancncnncnnnncnncncnnncncnn

SEQ ID NO: 238579 - DNA, 448 bp, Homo sapiens
  misc_feature: GYAE6OF02INUND.33.60.F05.1.454.CMB.1.raw
  modified_base (186)..(186): a, c, t, g, unknown or other
  misc_feature (186)..(186): n is a, c, g, or t
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (324)..(324): a, c, t, g, unknown or other
  misc_feature (324)..(324): n is a, c, g, or t
  modified_base (357)..(357): a, c, t, g, unknown or other
  misc_feature (357)..(357): n is a, c, g, or t
  modified_base (431)..(431): a, c, t, g, unknown or other
  misc_feature (431)..(431): n is a, c, g, or t
  modified_base (434)..(448): a, c, t, g, unknown or other
  misc_feature (434)..(448): n is a, c, g, or t
tcagtacacacactcacgaccggtgctcgatttagtacgtcatcagggaaaggggcgtggaggtgggtcgcgaactattagtggcggtggaactcatacatactacgccgactccgtgaagggccgcttcaccatctccagagacaattccaacaacacggtgtttctgcaaatgaatagcctganagtcgaggacatggccatatattangtncgagagttagcagtggctgggtatccttttctccagctactgggggccagggtacctggtcaccgtctcctcagcctcaccaagggcccagtcgtccttccccctggccnccctgcctacagagcacctccgaagcgcaacgngcgtcccgtggctgcctggtcaaaggcttactccagtgttacgtgtctaggagcgggctgggcaagggcgacanagnnnnnnnnnnnnnnn

SEQ ID NO: 238580 - DNA, 440 bp, Homo sapiens
  misc_feature: GYAE6OF02JFANT.33.60.F05.1.454.CMB.1.raw
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
  modified_base (401)..(401): a, c, t, g, unknown or other
  misc_feature (401)..(401): n is a, c, g, or t
  modified_base (408)..(410): a, c, t, g, unknown or other
  misc_feature (408)..(410): n is a, c, g, or t
  modified_base (412)..(412): a, c, t, g, unknown or other
  misc_feature (412)..(412): n is a, c, g, or t
  modified_base (414)..(440): a, c, t, g, unknown or other
  misc_feature (414)..(440): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggcctcccaggctcctcgatccatggtgcatccaccaggccactggcatcccagacaggttcagtggcagtgggtctgggacagacttcattctcaccatccagcagactggagcctgaagattttgcagtgtattactgttcagcagtacggtagttcatctccgacgttcggccaagggccaaggtggaaattcaaacgaactgtaggctagcaaccatactgtcttcatcttcccgcanctgaatgtgtntactgagcggctggcaaggcncgatagnnnangnnnnnnnnnnnnnnnnnnnnnnnnnnn

SEQ ID NO: 238581 - DNA, 406 bp, Homo sapiens
  misc_feature: GYAE6OF02GWEC6.33.60.F05.1.454.CMB.1.raw
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
  modified_base (398)..(406): a, c, t, g, unknown or other
  misc_feature (398)..(406): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagcctgaagattttgcagtgtattactgtcagcagtacggtagttcatctccgacgttcggccaagggaccaaggtggaaatcgaaacgacgtgtgctgcacatctgtctcatctcccgctatctgagtgtgtgtactgngcggcgtggcaaggcnatgnnnnnnnnn

SEQ ID NO: 238582 - DNA, 411 bp, Homo sapiens
  misc_feature: GYAE6OF02GBEFP.33.60.F05.1.454.CMB.1.raw
  modified_base (403)..(411): a, c, t, g, unknown or other
  misc_feature (403)..(411): n is a, c, g, or t
tcagtacacacactcacgaccggtgctcgatttagtacgtcatcagggaaagggccaccctctcttgtagggccagtcagagtgttagcagcaactacttagcctggtaccagcagaaacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatacaaacgaactgtggctgcaccatctgtcttcatcttcccgatctgtaacgtgtgtgtactgagcgggctggcaggcgcatagnnnnnnnnn

SEQ ID NO: 238583 - DNA, 416 bp, Homo sapiens
  misc_feature: GYAE6OF02IRW6X.33.60.F05.1.454.CMB.1.raw
  modified_base (341)..(341): a, c, t, g, unknown or other
  misc_feature (341)..(341): n is a, c, g, or t
  modified_base (406)..(416): a, c, t, g, unknown or other
  misc_feature (406)..(416): n is a, c, g, or t
tcagtacacacactcacgaccggtgctcgatttagtacgtcatcagggaaagggccaccctctcttgtagggcaagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgctagtgtattactgtcagcagtacggtattcatctccgacgttcggaccaagggaccaaggtgaaatacaaacgaactgtggctgcacntctgtcttcatccttcccgctactctgaagtgtgtgtacgtgaggcggctggacaggcgcatagnnnnnnnnnnn

SEQ ID NO: 238584 - DNA, 656 bp, Homo sapiens
  misc_feature: GYAE6OF02FV7UA.33.60.F05.1.454.CMB.1.raw
  modified_base (157)..(157): a, c, t, g, unknown or other
  misc_feature (157)..(157): n is a, c, g, or t
  modified_base (166)..(166): a, c, t, g, unknown or other
  misc_feature (166)..(166): n is a, c, g, or t
  modified_base (168)..(168): a, c, t, g, unknown or other
  misc_feature (168)..(168): n is a, c, g, or t
  modified_base (170)..(170): a, c, t, g, unknown or other
  misc_feature (170)..(170): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
  modified_base (635)..(639): a, c, t, g, unknown or other
  misc_feature (635)..(639): n is a, c, g, or t
  modified_base (641)..(643): a, c, t, g, unknown or other
  misc_feature (641)..(643): n is a, c, g, or t
  modified_base (645)..(645): a, c, t, g, unknown or other
  misc_feature (645)..(645): n is a, c, g, or t
  modified_base (647)..(656): a, c, t, g, unknown or other
  misc_feature (647)..(656): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcacnccacgcgcngngncncanagtgtnggngngnggtcggtgagganatctntacttcaccactactacgacgacgacgtacggtaggacctccgtaaggtaagttttagtttcgacgttaggttaatttaacttcgtcgtacgacgtacgttaacgggttaacggttaccgttacgtaccgttcccggtacccggtttccggtacccggaaccgggaaaccgggtaaccggtaagggtaaaacgttaaacctaaaccggtaaaaccgttacggttcggtaccggtacgtaccgaccctaaccgtacttcgttacttccttacgtacctttcccgttacccaaccttacgttacggtaaggttagttggttacgttacggttaggtcgggtaccggggtccgggttcggtaccgggaaccgggtaacggtccggtaaagttaaggacgactgcgtagngngngngngngtgagagtngngnnnnngnnngngnnnnnnnnnn

SEQ ID NO: 238585 - DNA, 419 bp, Homo sapiens
  misc_feature: GYAE6OF02FPBJ5.33.60.F05.1.454.CMB.1.raw
  modified_base (406)..(419): a, c, t, g, unknown or other
  misc_feature (406)..(419): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaaacgaactgtggctgcaccatctgtcttcatcttcccgcatctgaagtgtgtgtactgagcgggctgggcaaggcgacagtagnnnnnnnnnnnnnn

SEQ ID NO: 238586 - DNA, 588 bp, Homo sapiens
  misc_feature: GYAE6OF02ISGIZ.33.60.F05.1.454.CMB.1.raw
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (544)..(544): a, c, t, g, unknown or other
  misc_feature (544)..(544): n is a, c, g, or t
  modified_base (551)..(554): a, c, t, g, unknown or other
  misc_feature (551)..(554): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (560)..(563): a, c, t, g, unknown or other
  misc_feature (560)..(563): n is a, c, g, or t
  modified_base (565)..(567): a, c, t, g, unknown or other
  misc_feature (565)..(567): n is a, c, g, or t
  modified_base (569)..(569): a, c, t, g, unknown or other
  misc_feature (569)..(569): n is a, c, g, or t
  modified_base (572)..(572): a, c, t, g, unknown or other
  misc_feature (572)..(572): n is a, c, g, or t
  modified_base (575)..(575): a, c, t, g, unknown or other
  misc_feature (575)..(575): n is a, c, g, or t
  modified_base (577)..(588): a, c, t, g, unknown or other
  misc_feature (577)..(588): n is a, c, g, or t
tcagtacacacactcacgaccggtgctcgatttagtacgtcatcagggaaagggaccgaccctctcttgtagggccagtcagagtgttagcagcaacctacttagcctggtaccagcagaccacctggccaggctcccaggctcctcatccatggtgcatccaccagggccactggcattcccagacaggttcagtggcagtcgggtctgggacagacgttcagttcncaaccatccagacagactggacncctgaacgtattttgacagtgtattactgtcagcagttacggtagttacatcgtaccgtacggttccggaccgaacgggaccgtaaagggtaggtaaacttacgaaaaccgaaccgttaggtacggtacgttagaccgaaccgtacttcgtttcggttaccgtttacgtaacttcccgtttacccccggaccctacttaccgttacggtaaacggtttcgttacggttacggttaccgtacgggtacgggccgggtacgttagggaacgtaacgggtccgacgtaagtacgtnacgtcgnnnnananannnngnnngnagnagnannnnnnnnnnnn

SEQ ID NO: 238587 - DNA, 423 bp, Homo sapiens
  misc_feature: GYAE6OF02H7651.33.60.F05.1.454.CMB.1.raw
  modified_base (417)..(423): a, c, t, g, unknown or other
  misc_feature (417)..(423): n is a, c, g, or t
tcagtacacacactcacgaccggtgctcgatttagtacgtcatcagggaaggggctggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagttagcagtggctggtatcctttcttccagcactggggccagggtaccctggtcaccgtctcctcagcctccaccaaggcccatcggtcttccccctggccgccctgctccaggacgcacctccgagagcacagcggccctgggctgcctggtcaaggctactccagtgtgtgtactgacgcgggctggcaggcgcatagnnnnnnn

SEQ ID NO: 238588 - DNA, 413 bp, Homo sapiens
  misc_feature: GYAE6OF02JA44G.33.60.F05.1.454.CMB.1.raw
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (403)..(413): a, c, t, g, unknown or other
  misc_feature (403)..(413): n is a, c, g, or t
tcagtacacacactcacgaccggtgctcgatttagtacgtcatcagggaaggggctggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagttagcagtggctggtatcctttcttccagcactggggccagggtaccctggtcaccgtctcctcagcctccaccaaggcccatcggtctcccctggcgccctgctccaggancacctcgangcacagcgcctggctgctggtcaaggctactcagtgtgtgtactgagcggctggcaggcgcatgnnnnnnnnnnn

SEQ ID NO: 238589 - DNA, 415 bp, Homo sapiens
  misc_feature: GYAE6OF02GL1HO.33.60.F05.1.454.CMB.1.raw
  modified_base (395)..(395): a, c, t, g, unknown or other
  misc_feature (395)..(395): n is a, c, g, or t
  modified_base (400)..(415): a, c, t, g, unknown or other
  misc_feature (400)..(415): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtgaaatcaaacgactgtggctgcaccatctgtcttcatcttcccgctatctgagtgtgtgtactgagcgggctggcaaggcgnatagnnnnnnnnnnnnnnnn

SEQ ID NO: 238590 - DNA, 447 bp, Homo sapiens
  misc_feature: GYAE6OF02HDIQ2.33.60.F05.1.454.CMB.1.raw
  modified_base (287)..(287): a, c, t, g, unknown or other
  misc_feature (287)..(287): n is a, c, g, or t
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
  modified_base (406)..(407): a, c, t, g, unknown or other
  misc_feature (406)..(407): n is a, c, g, or t
  modified_base (409)..(409): a, c, t, g, unknown or other
  misc_feature (409)..(409): n is a, c, g, or t
  modified_base (413)..(447): a, c, t, g, unknown or other
  misc_feature (413)..(447): n is a, c, g, or t
tcagtacacacactcacgaccggtgctcgatttagtacgtcatcagggaaagggccaccctctcttgtacgggccagtcagagtgttagcagcaactacttagcctggtaccagcagaaacctggccaggctcccaggctcctcctctatggtgcatccaccagggccactggcatcccagacaggttcagtggcagtgggtctgggacagacttcactcgtcaccatcgacagactggagcctgaagattttgcagtctattactgtcagcagtatacgtgggganacgttcggcctaaagggaccaagggtggaaatcaaaacgactgngctgcaccatcngtcttcatcttcccgctatctagaagtgtgtgtactgacgcggctggcgaaggcgacagtagnngnctannnnnnnnnnnnnnnnnnnnnnnnnnnnnnnnnnn

SEQ ID NO: 238591 - DNA, 425 bp, Homo sapiens
  misc_feature: GYAE6OF02HQ2ND.33.60.F05.1.454.CMB.1.raw
  modified_base (413)..(425): a, c, t, g, unknown or other
  misc_feature (413)..(425): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggacgcctgaagtattttgcagtgtattactgtcagctagtacggtagttcatctccgacgttcggccgaagggacaaggtggaaatcaaacgactgtggctgcacatctgtcttcatctcccgacctatctagtaagtgtgtgtactggacgcgggtctggcgaagggcgcaatcgnnnnnnnnnnnnn

SEQ ID NO: 238592 - DNA, 516 bp, Homo sapiens
  misc_feature: GYAE6OF02FFM91.33.60.F05.1.454.CMB.1.raw
  modified_base (157)..(157): a, c, t, g, unknown or other
  misc_feature (157)..(157): n is a, c, g, or t
  modified_base (244)..(244): a, c, t, g, unknown or other
  misc_feature (244)..(244): n is a, c, g, or t
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
  modified_base (434)..(435): a, c, t, g, unknown or other
  misc_feature (434)..(435): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (468)..(468): a, c, t, g, unknown or other
  misc_feature (468)..(468): n is a, c, g, or t
  modified_base (509)..(509): a, c, t, g, unknown or other
  misc_feature (509)..(509): n is a, c, g, or t
tcagtacacacactcacgaccggtgctcgatttagtacgtcatcagggtaagggccgaccctctcttgtagggtccagtcagagttgttagcagcaactacttagcctggtaccagcagacacctggccaggctcccaggctccgtcatccatggtncatccaccaggccactggcatcccagacaggttcagtgcagtcggtctgggacagactttcagttctcaccatcagcagactggacncctgaagattttgctagtgtattactgtacagcagtacggtagttcatctccgacgttcgacctaagggaccaaggtgaaatcaaacgtactgtagctgcaccatctgtcttcactccttcccgctattcctagaacgttgtgtatacgngaagtcgggcttggcaaggcgtaccgtagtagngtatcgnngngacgnacgngtanactcgnacgcttacaccncgacgacgcgacgtacgtacgtcgacgacgcgcgacgtacncgactac

SEQ ID NO: 238593 - DNA, 419 bp, Homo sapiens
  misc_feature: GYAE6OF02GY15D.33.60.F05.1.454.CMB.1.raw
  modified_base (391)..(391): a, c, t, g, unknown or other
  misc_feature (391)..(391): n is a, c, g, or t
  modified_base (407)..(408): a, c, t, g, unknown or other
  misc_feature (407)..(408): n is a, c, g, or t
  modified_base (410)..(419): a, c, t, g, unknown or other
  misc_feature (410)..(419): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccagactcccaggctcctcatccatggtgcatccaccagggccactggcatcccagacaggttcagtggcagtgggtctgggacagacttcattctcaccatcagcagactggagcctgaagattttgctagtttatactgtcagcagcgtagcaactggtcttgggacgttcggaccaagggaccaaagggtggaaaatcgaaaacgtactgtggactgcacatctgtctcatccttccgcatctagaagtgtgtgactgagcggntggcaaggcatatagnngnnnnnnnnnn

SEQ ID NO: 238594 - DNA, 446 bp, Homo sapiens
  misc_feature: GYAE6OF02IXE5D.33.60.F05.1.454.CMB.1.raw
  modified_base (216)..(216): a, c, t, g, unknown or other
  misc_feature (216)..(216): n is a, c, g, or t
  modified_base (244)..(244): a, c, t, g, unknown or other
  misc_feature (244)..(244): n is a, c, g, or t
  modified_base (425)..(425): a, c, t, g, unknown or other
  misc_feature (425)..(425): n is a, c, g, or t
  modified_base (427)..(446): a, c, t, g, unknown or other
  misc_feature (427)..(446): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccgagggccactggcatcccagacaggttcagtggcagtgggtctgggaaaagcttnattctcaccatcagcagactggagcctnaagattttgcagtgtattactgtcagcagtacggtagttcatctccgacgtttcggccaagggaccaaggtgaaatcaaagaactgaggctgctaaccatctgtctacgattcttacccgccaatccttagaagttcgtgtagttactggacgcgggtctggacaacgggcgactagtagntnnnnnnnnnnnnnnnnnnnn

SEQ ID NO: 238595 - DNA, 436 bp, Homo sapiens
  misc_feature: GYAE6OF02I0DE9.33.60.F05.1.454.CMB.1.raw
  modified_base (425)..(436): a, c, t, g, unknown or other
  misc_feature (425)..(436): n is a, c, g, or t
tcagtacacacactcacgaccggtgctcgatttagtacgtcatcagggaaggggctggagtgggtcgcaactattagtggcggtggaactcatacatactacgccgactccgtgaagggccgcttcaccatctccagagacaattccaaacaacacggtgtttctgcaaatgaatagcctgagagtcgaggacatggccatatattactgtgcgagagttagcagtggctggtacttcctttctccagcactggggccagggtaccctggtcaccgtctcctcagcctccaccaaggcccatccggtccttccccctggccgccctgcctccgaggacgccacctccgagagcaacagcggccctgggctgctggtacaaggctacttccagtgtgtgtactgagcgggctggcaagcgcatagnnnnnnnnnnnn

SEQ ID NO: 238596 - DNA, 424 bp, Homo sapiens
  misc_feature: GYAE6OF02IRLLU.33.60.F05.1.454.CMB.1.raw
  modified_base (410)..(424): a, c, t, g, unknown or other
  misc_feature (410)..(424): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagatttttgcagtgtattactgttcagcagtacggtagttcatctccgacgttcggccaagggccaaaggtggaaatcaaacgaactgtggctgcaccatctgtcttcatcttcccgccatctgacgtgtgtgtactgagcgggtctgggcaaggcgcaacgtagnnnnnnnnnnnnnnn

SEQ ID NO: 238597 - DNA, 413 bp, Homo sapiens
  misc_feature: GYAE6OF02JBCES.33.60.F05.1.454.CMB.1.raw
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
  modified_base (404)..(413): a, c, t, g, unknown or other
  misc_feature (404)..(413): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatctatgatgcatccaccagggccactggcatcccagccaggttcagtggcagtgggtctgggacagacttcactctcaccatcagcagcctagagcctgaagtattttgctagtttattactgtctgcagcgtagcaactggcctaacaccttcggccaagggacacgactggagattaaacgactgtacgctgcaccatctgtcttcactccttcccgcatctgatgtntgtactgngcgggctggacaggcncatagnnnnnnnnnn

SEQ ID NO: 238598 - DNA, 427 bp, Homo sapiens
  misc_feature: GYAE6OF02IUXDY.33.60.F05.1.454.CMB.1.raw
  modified_base (291)..(291): a, c, t, g, unknown or other
  misc_feature (291)..(291): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
  modified_base (415)..(427): a, c, t, g, unknown or other
  misc_feature (415)..(427): n is a, c, g, or t
tcagtacacacactcacgaccggtgctcgatttagtacgtcatcagggaaagggccaccctctcctgcagggccagtcagagtgctggcagcaacttagcctggtaccaaacaaaaacctggccagactcccaggctcctcatctatgatgcatccacagggccactggcatcccagccaggttcagtggcaggtggtctgggacagacttcactctcaccatcagcagcctagcgcctgaagtattttgctagtttattactgtctgcagcgtagcaactggccttaacnccttcggccaagggacacgactggagtaattaaacgacgtgtggctgacacatctgtcttcacttcctcccgcatctagtagttgtgtgtacnggacggcggtntggacgaaggcganagtagnnnnnnnnnnnnn

SEQ ID NO: 238599 - DNA, 409 bp, Homo sapiens
  misc_feature: GYAE6OF02GP3VI.33.60.F05.1.454.CMB.1.raw
  modified_base (400)..(409): a, c, t, g, unknown or other
  misc_feature (400)..(409): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtgtaaatcaaacgactgtggctgcacatctgtcttcatcttcccgcatctgaatgtgtgtactgagcgggctggcaaggcgcagtagnnnnnnnnnn

SEQ ID NO: 238600 - DNA, 423 bp, Homo sapiens
  misc_feature: GYAE6OF02F04MB.33.60.F05.1.454.CMB.1.raw
  modified_base (404)..(404): a, c, t, g, unknown or other
  misc_feature (404)..(404): n is a, c, g, or t
  modified_base (411)..(423): a, c, t, g, unknown or other
  misc_feature (411)..(423): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcttctatgatgcatccaacagggccactggcatcccagccaggttcagtggcggtgggtctgggacagacttcactctcaccatcagcagcctagagcctagaagtattttgactagtttattactgtcagcagcgtagcaacgtggtctggacgttcggcaaagggaccaaggtgaaatcaaacgactgtggctgacacatctgtcttcatccttcccgctatctagaagtgtgtagtacgtgagcgggtctggcaaggcngaatagnnnnnnnnnnnnn

SEQ ID NO: 238601 - DNA, 422 bp, Homo sapiens
  misc_feature: GYAE6OF02IHEA5.33.60.F05.1.454.CMB.1.raw
  modified_base (411)..(422): a, c, t, g, unknown or other
  misc_feature (411)..(422): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatccagcagactggagcctgaagattttgcagtgtattactgtcagcagtacggtagttcatctccgacgttcggccaagggccaaggtggaaatcaaacgaactgtagctgcaccatctgtcttcgattctcccgcatctgaagtgtgtgtactggagcgggtctgggctaagggcgctaatagnnnnnnnnnnnn

SEQ ID NO: 238602 - DNA, 520 bp, Homo sapiens
  misc_feature: GYAE6OF02FZMUQ.33.60.F05.1.454.CMB.1.raw
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
  modified_base (495)..(496): a, c, t, g, unknown or other
  misc_feature (495)..(496): n is a, c, g, or t
  modified_base (498)..(499): a, c, t, g, unknown or other
  misc_feature (498)..(499): n is a, c, g, or t
  modified_base (501)..(502): a, c, t, g, unknown or other
  misc_feature (501)..(502): n is a, c, g, or t
  modified_base (504)..(504): a, c, t, g, unknown or other
  misc_feature (504)..(504): n is a, c, g, or t
  modified_base (507)..(512): a, c, t, g, unknown or other
  misc_feature (507)..(512): n is a, c, g, or t
  modified_base (514)..(520): a, c, t, g, unknown or other
  misc_feature (514)..(520): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctccaggctcctcatccatggtgcatccaccagggccactggcatcccagacaggttcagtggcagtgggtctgggacagacttnactntcacatcagcagcctagagcctgaggattcgtgcagtttatacctgtcagcagcgtctcaacgtggacctccgtgcacctttcggccaagggtacacgtagttggagagttacgaacgaactgtcggactgactacctcgtgtccttcaacttcctttcccggcctagtttccgtagtaaacggttcgttaggttccgttaacgtggtacgggccgggtccttagggaccaaggggttcccaacgttagtaacggctcgacgtgcgtcngctgngnngnngnngngcnnnnnncnnnnnnn

SEQ ID NO: 238603 - DNA, 441 bp, Homo sapiens
  misc_feature: GYAE6OF02HINSC.33.60.F05.1.454.CMB.1.raw
  modified_base (407)..(407): a, c, t, g, unknown or other
  misc_feature (407)..(407): n is a, c, g, or t
  modified_base (411)..(441): a, c, t, g, unknown or other
  misc_feature (411)..(441): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgctagtgtattaactgtcagcagtacggtagttcatctccgacgttcgccgaagggaccaaggtggaaatcgaaacgactgtgctgcacatctagtcttcatcttcccgcatctgagtgtgtgtactgacgcgggtctggctacggcgacatagnagcnnnnnnnnnnnnnnnnnnnnnnnnnnnnnnn

SEQ ID NO: 238604 - DNA, 412 bp, Homo sapiens
  misc_feature: GYAE6OF02IIPC6.33.60.F05.1.454.CMB.1.raw
  modified_base (347)..(347): a, c, t, g, unknown or other
  misc_feature (347)..(347): n is a, c, g, or t
  modified_base (367)..(367): a, c, t, g, unknown or other
  misc_feature (367)..(367): n is a, c, g, or t
  modified_base (389)..(389): a, c, t, g, unknown or other
  misc_feature (389)..(389): n is a, c, g, or t
  modified_base (395)..(412): a, c, t, g, unknown or other
  misc_feature (395)..(412): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggaccaggaccaaggtggaatcaaacgaatgtggctgcacatctgtcttcntcctccgcatctgatgtgtntactgagcgggctgggcaggcncatagnnnnnnnnnnnnnnnnnn

SEQ ID NO: 238605 - DNA, 429 bp, Homo sapiens
  misc_feature: GYAE6OF02I02TG.33.60.F05.1.454.CMB.1.raw
  modified_base (295)..(295): a, c, t, g, unknown or other
  misc_feature (295)..(295): n is a, c, g, or t
  modified_base (414)..(414): a, c, t, g, unknown or other
  misc_feature (414)..(414): n is a, c, g, or t
  modified_base (418)..(429): a, c, t, g, unknown or other
  misc_feature (418)..(429): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcactctcaccatcagcagcctagagcctgaagtattttgctagttttattactgtctgcagcgtagcaacgtggcctaacnccgttcggaccaagggacacgactggagattaaacgaactgtgctgacaccatctgtcttcatccttcccgctactcgtagtaagttgtgtgtactggtagcgggctggacacggcgangtannnnnnnnnnnn

SEQ ID NO: 238606 - DNA, 422 bp, Homo sapiens
  misc_feature: GYAE6OF02IZMXK.33.60.F05.1.454.CMB.1.raw
  modified_base (363)..(363): a, c, t, g, unknown or other
  misc_feature (363)..(363): n is a, c, g, or t
  modified_base (408)..(422): a, c, t, g, unknown or other
  misc_feature (408)..(422): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagtattttgcagtgtattactgtcagcagtacgtagttcatctccgacgttcggaccgaagggaccaagggtagaaatcgaaacgactgtggctgcacatctgtcttcatctcccgctntctgtacgtgtgtgtatggacgtcggctggcgtaaggcgcagtgnnnnnnnnnnnnnnn

SEQ ID NO: 238607 - DNA, 565 bp, Homo sapiens
  misc_feature: GYAE6OF02FZLM9.33.60.F05.1.454.CMB.1.raw
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
tcagtacacacactcacgaccggtgctcgatttagtacgtcatcagggaaaggggggccaccctcgtcgttgtagggcccagtcagaggtgttagcacgccaactacgttacgccgtggtaccagcagacaccctggcccaggctcccaggcgtcctcagtcccagtcggtgcatcccaccagggccactggcactccccagacagggttcagtggcagtgggtctgggacagacttcattctcaccatcagcagactggagcctagaagtattttgctagtacgtaattactgtaccaagctagtaccggtagttcaatcctaccgacgttcgactaagggaccaaggtgaaactacgaaaccgactggtgtctagcactatctgtcttacatccttcccgacagtcgtcgtaacgtgtacgtgtactggacggcgggtcctagggacgaagggccgacgagttagactctagtcncncgntacganactacganacgcncgtcgtcgtgtcgtcggacggacgacgacgtcgtacgtcgtacgcgacgacgacgcgtcgtccg

SEQ ID NO: 238608 - DNA, 418 bp, Homo sapiens
  misc_feature: GYAE6OF02FS7GN.33.60.F05.1.454.CMB.1.raw
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
  modified_base (401)..(418): a, c, t, g, unknown or other
  misc_feature (401)..(418): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaagggtggaaatcaaacgaactgtggctgcaccatctgtcttcatcttcccgcatctgacgtgtgtntactgagcggctggcaaggcgnatgnnnnnnnnnnnnnnnnnn

SEQ ID NO: 238609 - DNA, 429 bp, Homo sapiens
  misc_feature: GYAE6OF02F46CQ.33.60.F05.1.454.CMB.1.raw
  modified_base (328)..(328): a, c, t, g, unknown or other
  misc_feature (328)..(328): n is a, c, g, or t
  modified_base (414)..(429): a, c, t, g, unknown or other
  misc_feature (414)..(429): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctagaagattttgctagtgtattactgtcagcagtacgtagttcatctccgcgttcggccgaaggccaaggtgaatacaacgaactgngctgcacatctgtctcatcctcccgacctatcctagtaggtgttagtcgtacgtggacgcgggctgggacacgggcgtctagtagnnnnnnnnnnnnnnnn

SEQ ID NO: 238610 - DNA, 416 bp, Homo sapiens
  misc_feature: GYAE6OF02GLV5K.33.60.F05.1.454.CMB.1.raw
  modified_base (410)..(416): a, c, t, g, unknown or other
  misc_feature (410)..(416): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcgaccaagggaccaaggtggaaatcaaacgaactgtggctgcaccatctgtcttcatccttcccgcctatctgaagttgtgtgtactgagcgggtctgggcaagggcgctatagnnnnnnn

SEQ ID NO: 238611 - DNA, 472 bp, Homo sapiens
  misc_feature: GYAE6OF02J0LGR.33.60.F05.1.454.CMB.1.raw
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (444)..(448): a, c, t, g, unknown or other
  misc_feature (444)..(448): n is a, c, g, or t
  modified_base (450)..(472): a, c, t, g, unknown or other
  misc_feature (450)..(472): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagtacttcattctcacgatcagcagctggancctgaagtatttgcagtttntactgtcagcagtaatcgtagggngtacgtcggacaacggtccaaggtggaaactcgaaaaaggtactggtacggactgacaacagtctacgtcgttacacttccgttacccgactattctaagtacgttgtgtacgtccgagtcggtaccgggctcgggataacgggcgtacaaggttcgagcnnnnngnnnnnnnnnnnnnnnnnnnnnnn

SEQ ID NO: 238612 - DNA, 405 bp, Homo sapiens
  misc_feature: GYAE6OF02G4CS2.33.60.F05.1.454.CMB.1.raw
  modified_base (239)..(239): a, c, t, g, unknown or other
  misc_feature (239)..(239): n is a, c, g, or t
  modified_base (394)..(394): a, c, t, g, unknown or other
  misc_feature (394)..(394): n is a, c, g, or t
  modified_base (398)..(405): a, c, t, g, unknown or other
  misc_feature (398)..(405): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtcggtagttcatctccgacgttcggcctaagggccaaggtggaaatcaaacgaactgtggctgcaccatctgtcttcatcttccgccatctgatgtgtgtactgagcgggctggcaaggcgnatgnnnnnnnn

SEQ ID NO: 238613 - DNA, 422 bp, Homo sapiens
  misc_feature: GYAE6OF02G1ES6.33.60.F05.1.454.CMB.1.raw
  modified_base (239)..(239): a, c, t, g, unknown or other
  misc_feature (239)..(239): n is a, c, g, or t
  modified_base (404)..(404): a, c, t, g, unknown or other
  misc_feature (404)..(404): n is a, c, g, or t
  modified_base (409)..(422): a, c, t, g, unknown or other
  misc_feature (409)..(422): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgctagtttatactgtcagcagcgtagcaacgtggtcttggacgttcggccgaagggaccaaggtggaaatcgaaacgaactgtaggctgcacatctgtcttcatcttcccgcatctgagtgtgtgtactgacgcgggctgggactaaggcganatagnnnnnnnnnnnnnn

SEQ ID NO: 238614 - DNA, 411 bp, Homo sapiens
  misc_feature: GYAE6OF02GWVKC.33.60.F05.1.454.CMB.1.raw
  modified_base (393)..(393): a, c, t, g, unknown or other
  misc_feature (393)..(393): n is a, c, g, or t
  modified_base (399)..(411): a, c, t, g, unknown or other
  misc_feature (399)..(411): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtctcatctccgcatctgagtgtgtgtactgagcgggctggcaaggcgnagtagnnnnnnnnnnnnn

SEQ ID NO: 238615 - DNA, 408 bp, Homo sapiens
  misc_feature: GYAE6OF02F8VE6.33.60.F05.1.454.CMB.1.raw
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (402)..(408): a, c, t, g, unknown or other
  misc_feature (402)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggacgcctgaagtattttgcagtgtattactgtcagcagtcgtagttcatctccgacgttcggccaagggccaaggtgaaatacaaacgaactgtggctggacacatctgtcttcatcttcccgcctatctgacgtgtgtgtactggagcggctggcaggcgnangnnnnnnn

SEQ ID NO: 238616 - DNA, 432 bp, Homo sapiens
  misc_feature: GYAE6OF02JBD3G.33.60.F05.1.454.CMB.1.raw
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (399)..(400): a, c, t, g, unknown or other
  misc_feature (399)..(400): n is a, c, g, or t
  modified_base (403)..(432): a, c, t, g, unknown or other
  misc_feature (403)..(432): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattcncaccatccagcagactggancctgaagatttgcagtgtattactgtcagcagtacgtagtcatctccgagttcggccaggccaaggtgaactcaacgactgtgctgcacntcgtntctcactcttcccgctatctagagtgtagtcgtactggaggcggtactggcaaggcgcgatagnncgnnnnnnnnnnnnnnnnnnnnnnnnnnnnnn

SEQ ID NO: 238617 - DNA, 427 bp, Homo sapiens
  misc_feature: GYAE6OF02GN3Y4.33.60.F05.1.454.CMB.1.raw
  modified_base (292)..(292): a, c, t, g, unknown or other
  misc_feature (292)..(292): n is a, c, g, or t
  modified_base (407)..(408): a, c, t, g, unknown or other
  misc_feature (407)..(408): n is a, c, g, or t
  modified_base (410)..(411): a, c, t, g, unknown or other
  misc_feature (410)..(411): n is a, c, g, or t
  modified_base (413)..(427): a, c, t, g, unknown or other
  misc_feature (413)..(427): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcactctcaccatcagcagcctagagcctgaagattttgctagtttattactgtctgcagcgtagcaactggcctaacnccttcggccaagggacacgactggagattaaacgactgtggctgcaccatctgtcttcatcttcccgctatctgaagtgtgtgtactggagcgggctgggcaaggcgacagtagnngnngnnnnnnnnnnnnnnn

SEQ ID NO: 238618 - DNA, 424 bp, Homo sapiens
  misc_feature: GYAE6OF02HOPVD.33.60.F05.1.454.CMB.1.raw
  modified_base (406)..(406): a, c, t, g, unknown or other
  misc_feature (406)..(406): n is a, c, g, or t
  modified_base (408)..(424): a, c, t, g, unknown or other
  misc_feature (408)..(424): n is a, c, g, or t
tcagtacacacactcacgaccggtgctcgatttagtacgtcatcagggaaaggtccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagtattttgctagttttattactgtcagcagcgtagcaactggtcttggacgttcggccaagggaccaaggtgaaatcaaacgactgtggctgcacatctgtcttcatccttcccgctactctgtagtgtgtgtactgagcgggctgggcaaggcgcatagngnnnnnnnnnnnnnnnnn

SEQ ID NO: 238619 - DNA, 420 bp, Homo sapiens
  misc_feature: GYAE6OF02FPCPX.33.60.F05.1.454.CMB.1.raw
  modified_base (396)..(396): a, c, t, g, unknown or other
  misc_feature (396)..(396): n is a, c, g, or t
  modified_base (402)..(420): a, c, t, g, unknown or other
  misc_feature (402)..(420): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagactttcattctcaccatcagcagactggagcctgaagattttgcagtgtattactgtcagcatacggtagttcatctccgacgttcggccaagggaccaaggtggaaaatcaaacgaactgtggctgcacatctgtctcatcttcccgcatctgaagtgtgtgtactgagcgggctgggcaaggcncatagnnnnnnnnnnnnnnnnnnn

SEQ ID NO: 238620 - DNA, 441 bp, Homo sapiens
  misc_feature: GYAE6OF02GZOOY.33.60.F05.1.454.CMB.1.raw
  modified_base (429)..(429): a, c, t, g, unknown or other
  misc_feature (429)..(429): n is a, c, g, or t
  modified_base (433)..(441): a, c, t, g, unknown or other
  misc_feature (433)..(441): n is a, c, g, or t
tcagtacacacactcacgaccggtgctcgatttagtacgtcatcagggaaaggggctggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagttagcagtggctggtatcctttctccagcactggggccagggtaccctggtcaccgtctcctcagcctcaccaaggcccatcggtcttccccctggcgccctgctccgaggagccacctccgagacgcacacggccgcccgtggggcctcgccttgggtcaacggactaccttccagttgtgtgtactggaggcgggctggcagggcgacntagnnnnnnnnn

SEQ ID NO: 238621 - DNA, 434 bp, Homo sapiens
  misc_feature: GYAE6OF02G5AUX.33.60.F05.1.454.CMB.1.raw
  modified_base (239)..(239): a, c, t, g, unknown or other
  misc_feature (239)..(239): n is a, c, g, or t
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
  modified_base (417)..(434): a, c, t, g, unknown or other
  misc_feature (417)..(434): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtcttggacagacttcattctcaccatcagcagactggancctgaagtattttgcagtgttattactgtcagcagtacggtagttcatctccgtacgttcggccaagggaccaaggtggaaatacgaaacgactgnggctgcacntctgtctcactccttcccgcatctgtagtgtgtgtacgtggaggcggtcgtggactaagggccactagtacgnnnnnnnnnnnnnnnnnn

SEQ ID NO: 238622 - DNA, 413 bp, Homo sapiens
  misc_feature: GYAE6OF02F1RP2.33.60.F05.1.454.CMB.1.raw
  modified_base (400)..(400): a, c, t, g, unknown or other
  misc_feature (400)..(400): n is a, c, g, or t
  modified_base (406)..(413): a, c, t, g, unknown or other
  misc_feature (406)..(413): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggacgcctgaagattttgctagtgttattactgtcagcagtacggtagttcatctccgacgttcggccaagggaccaaggtggaaatcaaacgactgtggctgcaccatctgtcttcatcttcccgccatctgagttgtgtgtactgagcgggtctggcacggcncagtgnnnnnnnn

SEQ ID NO: 238623 - DNA, 434 bp, Homo sapiens
  misc_feature: GYAE6OF02H9HXB.33.60.F05.1.454.CMB.1.raw
  modified_base (422)..(434): a, c, t, g, unknown or other
  misc_feature (422)..(434): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcatttctcaccatcagcagactggagcctgaagtattttgcagtgtattactgtcagcagtacgtagttcattctccgacgttcggaccgaagggaccaagggtggaaaatacaaacgactgtggctgcacatctgtcttcactctcccgcctatctagaagttgtagtgtacgtggacggcgggctgggacaagggtcacagtagnnnnnnnnnnnnn

SEQ ID NO: 238624 - DNA, 405 bp, Homo sapiens
  misc_feature: GYAE6OF02HD2BE.33.60.F05.1.454.CMB.1.raw
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (397)..(405): a, c, t, g, unknown or other
  misc_feature (397)..(405): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagtcatctccgacgttcggccaagggccaaggtggaaatcgaaacgaactgtggctgcacatctgtcttcatctcccncatctgagtntgtgtntgagcgggctggcaggcgcatagnnnnnnnnn

SEQ ID NO: 238625 - DNA, 504 bp, Homo sapiens
  misc_feature: GYAE6OF02HOFL4.33.60.F05.1.454.CMB.1.raw
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
  modified_base (470)..(472): a, c, t, g, unknown or other
  misc_feature (470)..(472): n is a, c, g, or t
  modified_base (474)..(489): a, c, t, g, unknown or other
  misc_feature (474)..(489): n is a, c, g, or t
  modified_base (491)..(504): a, c, t, g, unknown or other
  misc_feature (491)..(504): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtgcagtgggtctgggacagacttcattcctcaccatcagcagcctagngcctgaagtnttttgctagtttattactgtcagcagcgtagcaactggtcttgggaccgttcggaccaacgggacctaagggtacggaaataccaaaacggtaactggtaggactggacaacctagtctgttccttacacttcctttcccccgactatcgtagaagttgttacggttgtaccgtgaacgggcgggcgttacgggacgaacgggtccactaacgtagctagnnngnnnnnnnnnnnnnnnngnnnnnnnnnnnnnn

SEQ ID NO: 238626 - DNA, 461 bp, Homo sapiens
  misc_feature: GYAE6OF02I8MI5.33.60.F05.1.454.CMB.1.raw
  modified_base (238)..(238): a, c, t, g, unknown or other
  misc_feature (238)..(238): n is a, c, g, or t
  modified_base (400)..(400): a, c, t, g, unknown or other
  misc_feature (400)..(400): n is a, c, g, or t
  modified_base (429)..(461): a, c, t, g, unknown or other
  misc_feature (429)..(461): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtggtctgggacagacttcattctcaccatcagcagactggancctgaagattttgcagtgtattactgtcagcagtacggtagttcatcgtccgacggttcggaccgaagggaccaaggtggaaatcgaaaacgaacgtgtgctgcaccgatctgtcttcatccttccgcctatctgtaagtgtagttcgtactggcgcgggtntcgggacaagggccgacgtagtagtacgnnnnnnnnnnnnnnnnnnnnnnnnnnnnnnnnn

SEQ ID NO: 238627 - DNA, 421 bp, Homo sapiens
  misc_feature: GYAE6OF02GOYH6.33.60.F05.1.454.CMB.1.raw
  modified_base (410)..(410): a, c, t, g, unknown or other
  misc_feature (410)..(410): n is a, c, g, or t
  modified_base (412)..(421): a, c, t, g, unknown or other
  misc_feature (412)..(421): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaagggtggaaatcaaaacgaactgtaggctgcacatctgtcttcatcttcccgccatctgaagtgtgtgtactgaggtcgggctggcaagggcgacagtagnannnnnnnnnn

SEQ ID NO: 238628 - DNA, 413 bp, Homo sapiens
  misc_feature: GYAE6OF02FL04T.33.60.F05.1.454.CMB.1.raw
  modified_base (370)..(370): a, c, t, g, unknown or other
  misc_feature (370)..(370): n is a, c, g, or t
  modified_base (405)..(413): a, c, t, g, unknown or other
  misc_feature (405)..(413): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagtattttgcagtgtattactgtcagcagtacggtattcatctccgacgttcggccaagggaccaaggtggaaatcaaacgaactgtggctgcacatctgtcttcatcttcccgcatctgagtgtntgtactggagcgggctgggcaaggcgactagtagnnnnnnnnn

SEQ ID NO: 238629 - DNA, 435 bp, Homo sapiens
  misc_feature: GYAE6OF02GEO5H.33.60.F05.1.454.CMB.1.raw
  modified_base (296)..(296): a, c, t, g, unknown or other
  misc_feature (296)..(296): n is a, c, g, or t
  modified_base (324)..(324): a, c, t, g, unknown or other
  misc_feature (324)..(324): n is a, c, g, or t
  modified_base (415)..(415): a, c, t, g, unknown or other
  misc_feature (415)..(415): n is a, c, g, or t
  modified_base (417)..(435): a, c, t, g, unknown or other
  misc_feature (417)..(435): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggacgcctgaagattttgctaagtttattactgtctgcagcgtagcaactcggacctaacncccttcggaccaagggacacgactgganataaacgactgtgctgcacctatctgtcttcattcctccgcatctgagttgtgtcgtactggacggcggtcgtggactaggctcgataggntnnnnnnnnnnnnnnnnnnn

SEQ ID NO: 238630 - DNA, 532 bp, Homo sapiens
  misc_feature: GYAE6OF02IYGQB.33.60.F05.1.454.CMB.1.raw
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (497)..(497): a, c, t, g, unknown or other
  misc_feature (497)..(497): n is a, c, g, or t
  modified_base (501)..(504): a, c, t, g, unknown or other
  misc_feature (501)..(504): n is a, c, g, or t
  modified_base (506)..(506): a, c, t, g, unknown or other
  misc_feature (506)..(506): n is a, c, g, or t
  modified_base (508)..(517): a, c, t, g, unknown or other
  misc_feature (508)..(517): n is a, c, g, or t
  modified_base (519)..(532): a, c, t, g, unknown or other
  misc_feature (519)..(532): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcactctcaccatcagcagcctagacgcctagaagtattttgcagtctaattactgtcagctagtatactggggagacgttcggaccgaagggaaccgaagggtggaaaacttacgaaaacgaacgttagtggaccgtgacctaccgactcgtacgttaccttctacttccttccccgtacctactccgtaggtaacggtttgtacggtttagtaaccgtcggtaacggtccggggtacgtcgggacgtaacgggccgtacgtacgtaacggngngtcgagtcntgannnngngnnnnnnnnnngnnnnnnnnnnnnnn

SEQ ID NO: 238631 - DNA, 522 bp, Homo sapiens
  misc_feature: GYAE6OF02JFVBW.33.60.F05.1.454.CMB.1.raw
  modified_base (245)..(245): a, c, t, g, unknown or other
  misc_feature (245)..(245): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (480)..(480): a, c, t, g, unknown or other
  misc_feature (480)..(480): n is a, c, g, or t
  modified_base (485)..(486): a, c, t, g, unknown or other
  misc_feature (485)..(486): n is a, c, g, or t
  modified_base (492)..(492): a, c, t, g, unknown or other
  misc_feature (492)..(492): n is a, c, g, or t
  modified_base (494)..(509): a, c, t, g, unknown or other
  misc_feature (494)..(509): n is a, c, g, or t
  modified_base (511)..(522): a, c, t, g, unknown or other
  misc_feature (511)..(522): n is a, c, g, or t
tcagtacacacactcacgaccggtgctcgatttagtacgtcatcagggaaggggcgtggaggtgggtcggcaactattagtggcggtggaactcgatacatactacgccgactccgtgaagggccgcttcaccatctccagagacaattccaaacaacacggtgtttctgcaaatgaatagcctgagagtcgagacatggccatatattactgtgcgagagttagcaggtggctggtatcctttnttccagcactgggggccagggtacccctggtcaccggtctcctcagccctcaccaacgggcccatccggtccttcccccnggccncccgtcgccttccgaggacgcacctccggagtcgccaccgagcccgggcctggggctcgccgtcgggtacaaagggccttaccgtttccgaggtttcgtggtcgtaacgttggagccgggtctaggccgtaaagggcgccgtaaagtcgntacgnngctagngnnnnnnnnnnnnnnnncnnnnnnnnnnnn

SEQ ID NO: 238632 - DNA, 419 bp, Homo sapiens
  misc_feature: GYAE6OF02JE7DH.33.60.F05.1.454.CMB.1.raw
  modified_base (239)..(239): a, c, t, g, unknown or other
  misc_feature (239)..(239): n is a, c, g, or t
  modified_base (351)..(351): a, c, t, g, unknown or other
  misc_feature (351)..(351): n is a, c, g, or t
  modified_base (403)..(419): a, c, t, g, unknown or other
  misc_feature (403)..(419): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggaccaaaggtggaaaatcaaacgaactgtggctgcacatctgtcttnatcttcccgcatctgaatgtgtgtactggagcggctgggcaaggcgcatagnnnnnnnnnnnnnnnnn

SEQ ID NO: 238633 - DNA, 586 bp, Homo sapiens
  misc_feature: GYAE6OF02I2P1T.33.60.F05.1.454.CMB.1.raw
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
  modified_base (539)..(539): a, c, t, g, unknown or other
  misc_feature (539)..(539): n is a, c, g, or t
  modified_base (548)..(548): a, c, t, g, unknown or other
  misc_feature (548)..(548): n is a, c, g, or t
tcagtacacacactcacgaccggtgctcgatttagtacgtcatcagggaaaggggccaccctctcttcgtagggccagtcagagtgttagcagcaactaccttagcctggtaccagtcagaccacctggccaggcctccgaggctccctcatccatggtgcatccaccagggccacctggccatcccagacaggttcagtggcagttgggtctgggacagacttcgattcgtcaccatcagccagactggatcctgaaagtacttttgcagttagtatttacctagtacagtcaggttacggtacggttcagtccgtccggacgttcggtaccgaaggggactaagggtggaaatcctaaacgaactgtaggctgacaaccgatcgtagtcttacgtaacttccgttacccgcctagttcctacggtaagttcggttacggttcggtaaccgttcggtaacgggccgggtacgtacgggaccgaaagggccgtacctaagttacggnactagngntacgacgngacntgacgcgcgtcngagagtagngtgcgtgtagtcgacgtgtcgcgcgtacgcgcgacgcg

SEQ ID NO: 238634 - DNA, 467 bp, Homo sapiens
  misc_feature: GYAE6OF02JD7VO.33.60.F05.1.454.CMB.1.raw
  modified_base (238)..(238): a, c, t, g, unknown or other
  misc_feature (238)..(238): n is a, c, g, or t
  modified_base (377)..(377): a, c, t, g, unknown or other
  misc_feature (377)..(377): n is a, c, g, or t
  modified_base (412)..(412): a, c, t, g, unknown or other
  misc_feature (412)..(412): n is a, c, g, or t
  modified_base (432)..(433): a, c, t, g, unknown or other
  misc_feature (432)..(433): n is a, c, g, or t
  modified_base (436)..(467): a, c, t, g, unknown or other
  misc_feature (436)..(467): n is a, c, g, or t
tcagtacacacactcacgaccggtgctcgatttagtacgtcatcagggaaagggccaccctctcttatagggccagtcagagtgttagcagcaactacttagcctggtaccagcagacacctggccaggctcccagtctcctcatccatggtgcatccaccagggccactggcatcccagacaggttcagtgcagtgggtctgggacagacttcattctcaccatcagcagactggancctgaagtattttgcagtagtattactgtacagcagtacggtattcatctccgacgttcggaccgaagggaccaagggtcgaaatccaaacgtaactaggtcggctagaccaaccatctagtcttacatccgttccccnctaatcgtagtaagtgtacgtgtactggagtcggntacggcaaggctacatacgnntannnnnnnnnnnnnnnnnnnnnnnnnnnnnnnn

SEQ ID NO: 238635 - DNA, 447 bp, Homo sapiens
  misc_feature: GYAE6OF02HIDYR.33.60.F05.1.454.CMB.1.raw
  modified_base (340)..(340): a, c, t, g, unknown or other
  misc_feature (340)..(340): n is a, c, g, or t
  modified_base (384)..(384): a, c, t, g, unknown or other
  misc_feature (384)..(384): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (418)..(420): a, c, t, g, unknown or other
  misc_feature (418)..(420): n is a, c, g, or t
  modified_base (422)..(447): a, c, t, g, unknown or other
  misc_feature (422)..(447): n is a, c, g, or t
tcagtacacacactcacgaccggtgctcgatttagtacgtcatcagggaaaggggccaccctctcttgtagggccagtcagagtgttagcagcaactaccttagcctggtaccagcagacacctggccaggctcccaggcctcctcatccatggtgcatccaccagggccactggcatcccagacaggttcagtgcagtgggtctgggacagacttcactctcaccatccgaacagactgggagcctgaagattttgcagtctattacgtgtctagcagtatatgggggagacgtttcggacctaagggaccaagggtggaaagtcaaacgaactgtggntgcacatctgtctcgattctccgccatctgacgtgtgtgtctgnggcggctgcgaagcacgatgngtngcanacgnannngnnnnnnnnnnnnnnnnnnnnnnnnnn

SEQ ID NO: 238636 - DNA, 426 bp, Homo sapiens
  misc_feature: GYAE6OF02GWXOY.33.60.F05.1.454.CMB.1.raw
  modified_base (420)..(426): a, c, t, g, unknown or other
  misc_feature (420)..(426): n is a, c, g, or t
tcagtacacacactcacgaccggtgctcgatttagtacgtcatcagggaaaggggctggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagttagcagtggctggtatcctttcttccagcactggggccagggtaccctggtcaccgtctcctcagcctccaccaaggcccatcggtcttccccctggcgccctgctccaggacgcacctccgagacgcacagcggcctgggctgcctggtcaaggactacttccagtcgtgtgtactgagcgggctggcaaggcgcatagnnnnnnn

SEQ ID NO: 238637 - DNA, 429 bp, Homo sapiens
  misc_feature: GYAE6OF02GSSAS.33.60.F05.1.454.CMB.1.raw
  modified_base (392)..(392): a, c, t, g, unknown or other
  misc_feature (392)..(392): n is a, c, g, or t
  modified_base (410)..(410): a, c, t, g, unknown or other
  misc_feature (410)..(410): n is a, c, g, or t
  modified_base (415)..(429): a, c, t, g, unknown or other
  misc_feature (415)..(429): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagtattttgcagtgttattactgtcagcagtacggtagttcatctccgacgttcggccaagggaccaaggtgaaatcaaacgactgtgctgcacatctcgtcttcactccttcccgcctatcctgtaagtgtgtgtacgtgaggcggngtggacgaaggcgactancgtannnnnnnnnnnnnnn

SEQ ID NO: 238638 - DNA, 515 bp, Homo sapiens
  misc_feature: GYAE6OF02GHANW.33.60.F05.1.454.CMB.1.raw
  modified_base (243)..(243): a, c, t, g, unknown or other
  misc_feature (243)..(243): n is a, c, g, or t
  modified_base (418)..(418): a, c, t, g, unknown or other
  misc_feature (418)..(418): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (478)..(478): a, c, t, g, unknown or other
  misc_feature (478)..(478): n is a, c, g, or t
  modified_base (490)..(490): a, c, t, g, unknown or other
  misc_feature (490)..(490): n is a, c, g, or t
  modified_base (504)..(504): a, c, t, g, unknown or other
  misc_feature (504)..(504): n is a, c, g, or t
  modified_base (508)..(510): a, c, t, g, unknown or other
  misc_feature (508)..(510): n is a, c, g, or t
  modified_base (514)..(515): a, c, t, g, unknown or other
  misc_feature (514)..(515): n is a, c, g, or t
tcagtacacacactcacgaccggtgctcgatttagtacgtcatcagggaaagggccaccctctcttagtagggccagtcagagtagttagcagcaactacttagcctggtaccagcagacacctggccaggctcccaggctcctcatccatggtgcatccaccagggccactggcatcccagacaggttcagtggcaggtgggtctgggacagacttcattctcaccatcagtcagactggancctagaagtattttgctagttgttattactgtcagcagtacggtagttcatctccgtacgttcggacaagggaccaaggtgaaatcgaaacgaactgagctagcacatctcgtcttcacttccttacccgactatcctagtaacgtcgttagtcgtaacgtggtacggcgggtcngggactaacgggcgtactaagtagtcgactgntacgngtctagtgctagngagnatatanactacatacgtntactactctactancgcnnnctcnn

SEQ ID NO: 238639 - DNA, 583 bp, Homo sapiens
  misc_feature: GYAE6OF02IO4GV.33.60.F05.1.454.CMB.1.raw
  modified_base (538)..(538): a, c, t, g, unknown or other
  misc_feature (538)..(538): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (562)..(563): a, c, t, g, unknown or other
  misc_feature (562)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(578): a, c, t, g, unknown or other
  misc_feature (569)..(578): n is a, c, g, or t
  modified_base (580)..(582): a, c, t, g, unknown or other
  misc_feature (580)..(582): n is a, c, g, or t
tcagtacacacactcacgaccggtgctcgatttagtacgtcatcagggaaaggggccgaccctctcttgtagggccagtcagagtgttagcagccaactacttagcctggtaccagccagacacctggccaggcctcccaggactcctcatccatggtgcatccaccagggccactcggcatcccagcaggttcgagtggcaggtgggtctgggacagacttcattctcaccatccagcagactggacgcctgaagattttgccagtgtacttactgtcagactaggttacggttagttacctagttccgtccggaccggtttccgggaccgtaaaccggggaccgaaagggttacggtaaagtaccgaaacggaaccgttaggtacggaccttcgggacctaaccgactttaccgtacggttcctttacgtaacttcccgtttaccccgacctacgttccgtacgtaaggtcgttacgttagtacgttggacggtcgggtcgtagggtacgtaacgggcggtactacgtagctgacngtngntangnagcgtgngngagannanangnnnnnnnnnncnnnc

SEQ ID NO: 238640 - DNA, 463 bp, Homo sapiens
  misc_feature: GYAE6OF02ITARG.33.60.F05.1.454.CMB.1.raw
  modified_base (217)..(217): a, c, t, g, unknown or other
  misc_feature (217)..(217): n is a, c, g, or t
  modified_base (290)..(290): a, c, t, g, unknown or other
  misc_feature (290)..(290): n is a, c, g, or t
  modified_base (431)..(433): a, c, t, g, unknown or other
  misc_feature (431)..(433): n is a, c, g, or t
  modified_base (435)..(463): a, c, t, g, unknown or other
  misc_feature (435)..(463): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccgagggccactggcatccccagacaggttcagtggcagtgggtctgggacagacttnattctcaccatcagcagactggagcctgaagtatttgcagttgtattactgtcagcagtacggtagttcatcnccgtagttcggacaaggccaaggtagaaactcaaacgtatgtgctgccactatctgtctcactctccgactgtctgaagttctagtctaacggtgaggtacgggtctagggacgtaacgggcgtactaagttgacgcgagnnngnnnnnnnnnnnnnnnnnnnnnnnnnnnnn

SEQ ID NO: 238641 - DNA, 429 bp, Homo sapiens
  misc_feature: GYAE6OF02G3YV5.33.60.F05.1.454.CMB.1.raw
  modified_base (416)..(429): a, c, t, g, unknown or other
  misc_feature (416)..(429): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtacgttcatctccgacgttcggccaagggaccaaggtgaaatcaaacgactgtgctgcacatctgtcttcactccttcccgcctatctagtaagtgtgtgtacgtgaggcgggtgtcgggacaacgggcgacgagtagnnnnnnnnnnnnnn

SEQ ID NO: 238642 - DNA, 792 bp, Homo sapiens
  misc_feature: GYAE6OF02FH8BJ.33.60.F05.1.454.CMB.1.raw
  modified_base (142)..(142): a, c, t, g, unknown or other
  misc_feature (142)..(142): n is a, c, g, or t
  modified_base (773)..(773): a, c, t, g, unknown or other
  misc_feature (773)..(773): n is a, c, g, or t
  modified_base (780)..(780): a, c, t, g, unknown or other
  misc_feature (780)..(780): n is a, c, g, or t
tcagtacacacactcacgaccggtgctcgatttagtacgtcatcagggaagggccaccctctcttgtagggccagtcagagtgttagcagcaactacttagcctggtaccagcagacacctggccaggctcccaggctcctnatccatggtgcatccaccagggccactggcatcccagacaggttcagtggccaggtgggtcctgggacagaccttcacttcctccaccatccagtccagaccgtggacgccgtagtaacgatttttcggaccagttcgttaacttaaccgtgttaccacggtccgaacgttaaccggggttacgttacctaacgttccttaccgggtaacccggtttaccgggtaccccgtaaacggggggtaccccctaaaggggttaccgggtaaaaaacttcccgaaaaacccgggtaaaaccgttacgggttcggggtaccgtttacgggaccctaaccccgtaaacgttcccgttacggttacccttttacccgaaccgggtttaaccccctttttccccccgggaaccctaaccgttttacccgtaacggttaaaccgggtttggtttaccggtacggtttaacccgttacgggtaaccgggtcccgggggttaccgtaacggggtacccgtaaacgggtacccggtacccgtaaagtttaaccgggacttcggacctcgcgtacgtacacgtactacgacgacgtactctacctctacgtacacgtacacgacgtacacgtacgtacgacgtcnccgtccncgacacactacg

SEQ ID NO: 238643 - DNA, 460 bp, Homo sapiens
  misc_feature: GYAE6OF02HDYK6.33.60.F05.1.454.CMB.1.raw
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (388)..(388): a, c, t, g, unknown or other
  misc_feature (388)..(388): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (435)..(445): a, c, t, g, unknown or other
  misc_feature (435)..(445): n is a, c, g, or t
  modified_base (447)..(460): a, c, t, g, unknown or other
  misc_feature (447)..(460): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtgcagtggtctgggacagacttcattctacaccatcagcagacgtgagcctgaagtattttgcagtntattactntcagcagtacggtagttcatctccgtacgttcggccaaggaccagggtgaaatcaaacgtaatgtgctgcacntctgtctnacttctacccgctactctgtaagtgtgttacgtacgtgacgngggtctaggacgaacgggcngaacgtagtncctagnatcgnagctcnnnnnnnnnnngnnnnnnnnnnnnnn

SEQ ID NO: 238644 - DNA, 541 bp, Homo sapiens
  misc_feature: GYAE6OF02G7T5M.33.60.F05.1.454.CMB.1.raw
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (509)..(511): a, c, t, g, unknown or other
  misc_feature (509)..(511): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (517)..(518): a, c, t, g, unknown or other
  misc_feature (517)..(518): n is a, c, g, or t
  modified_base (520)..(521): a, c, t, g, unknown or other
  misc_feature (520)..(521): n is a, c, g, or t
  modified_base (523)..(524): a, c, t, g, unknown or other
  misc_feature (523)..(524): n is a, c, g, or t
  modified_base (527)..(527): a, c, t, g, unknown or other
  misc_feature (527)..(527): n is a, c, g, or t
  modified_base (529)..(532): a, c, t, g, unknown or other
  misc_feature (529)..(532): n is a, c, g, or t
  modified_base (534)..(534): a, c, t, g, unknown or other
  misc_feature (534)..(534): n is a, c, g, or t
  modified_base (536)..(541): a, c, t, g, unknown or other
  misc_feature (536)..(541): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcactctcaccatcagcagcctagagcctgaggattcngcagtttatactgtcagcagcgtctacactggcctccgtncctacctttcggaccaaggggaccacgtagttggagtacttacgaacgtaactggtggccttaggccctaacccttctgttcctttcacgtttcccttaccccggctactttcccgtggtaaaccgttgggttacgttacggtttaacttcggaacggggtccggggtcgtagggtacccgaaagggtccgaacgttaagtaggcacgtnacgngngnnngngngnngnngnngtncnnnngncnnnnnn

SEQ ID NO: 238645 - DNA, 427 bp, Homo sapiens
  misc_feature: GYAE6OF02JGE5Y.33.60.F05.1.454.CMB.1.raw
  modified_base (221)..(221): a, c, t, g, unknown or other
  misc_feature (221)..(221): n is a, c, g, or t
  modified_base (410)..(427): a, c, t, g, unknown or other
  misc_feature (410)..(427): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggcctcccaggctcctcatccatggtgcatccaccagggccactggcatcccagacaggttcagtggcagtgggtctgggacagacttcattcncaccatcagcagtctgcaacctgaagattttgcaacttacttctgtcaacacagttacaatctcccgtacacttttcggccaggggaccaagctggagatcaggcgaactgtaggctgcgaccagtctgtcttcatccttcccgctatctagaagtcgtgtgtatgagcgggctggcaaggcgcatagnnnnnnnnnnnnnnnnnn

SEQ ID NO: 238646 - DNA, 488 bp, Homo sapiens
  misc_feature: GYAE6OF02I6486.33.60.F05.1.454.CMB.1.raw
  modified_base (220)..(220): a, c, t, g, unknown or other
  misc_feature (220)..(220): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
  modified_base (464)..(466): a, c, t, g, unknown or other
  misc_feature (464)..(466): n is a, c, g, or t
  modified_base (468)..(468): a, c, t, g, unknown or other
  misc_feature (468)..(468): n is a, c, g, or t
  modified_base (470)..(471): a, c, t, g, unknown or other
  misc_feature (470)..(471): n is a, c, g, or t
  modified_base (473)..(473): a, c, t, g, unknown or other
  misc_feature (473)..(473): n is a, c, g, or t
  modified_base (475)..(488): a, c, t, g, unknown or other
  misc_feature (475)..(488): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattcncaccatcagccagacctggacgtccgtgagattttgctaggtgtattactgtcagcagtacggtagtcatctccgacggttcgccgaaggccaaggtcgaatcaaacgactgtagctgacacatctgtcttcatccttcccgcctatccgtacgaagtttgtcgttacgtacttggaggtcgggtcttacgggaccaaacggggcgtacgaagtacggntacgntacgtcagcacgcngngngnnnangnncngnnnnnnnnnnnnnn

SEQ ID NO: 238647 - DNA, 681 bp, Homo sapiens
  misc_feature: GYAE6OF02JGQT3.33.60.F05.1.454.CMB.1.raw
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
  modified_base (593)..(593): a, c, t, g, unknown or other
  misc_feature (593)..(593): n is a, c, g, or t
tcagtacacacactcacgaccggtgctcgatttagtacgtcatcagggaaggggccaccctctcttgtagggccagtcagagtgttagcagcaactacttagcctggtaccagcagacacctggccaggctcccaggctcctcatccatggtgcatccaccagggccactggcatcccagacaggttcagtggcaggtggtctgggacnggactcattctcacatcagcagactggacnccttagaacgtatttcggacagttcgtagttacttgacgagcagttacgggtaattcgattcgtaccgacggttcggacccgtaaaggacctaaagggtagtaaaagttaccgaaaaacggtaaaccgttggttaccggacgttacggacctaacccgagttacccgtagggtaacctttcaaacggttccctttaacccggaccctaagttacccgtaacgggttaagttaaccggttaggtttaaaccgtcttttaagggaaccgggtacccgggtccggtaagggttacgtaaaacgggggccaccggtaaaaggtttaaccggcgtaacgcgaacgttacagaccggtancgactacgtacgtacgtacgtcgtagagacgtagtacgtacgtcgtacgtactacgtcgtagtacgtcgtacgacgacgtactagtcg

SEQ ID NO: 238648 - DNA, 424 bp, Homo sapiens
  misc_feature: GYAE6OF02IQ10J.33.60.F05.1.454.CMB.1.raw
  modified_base (240)..(240): a, c, t, g, unknown or other
  misc_feature (240)..(240): n is a, c, g, or t
  modified_base (393)..(393): a, c, t, g, unknown or other
  misc_feature (393)..(393): n is a, c, g, or t
  modified_base (409)..(424): a, c, t, g, unknown or other
  misc_feature (409)..(424): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctcgacgttcggccaagggaccaaggtggaaatacgaaacgactgtgctgcacatctgtcttcactccttcccgctatcctgaagtgtcttgtacgtgacgcgggtngggcaaggcgcagtgnnnnnnnnnnnnnnnn

SEQ ID NO: 238649 - DNA, 541 bp, Homo sapiens
  misc_feature: GYAE6OF02FMLK8.33.60.F05.1.454.CMB.1.raw
  modified_base (510)..(510): a, c, t, g, unknown or other
  misc_feature (510)..(510): n is a, c, g, or t
  modified_base (514)..(541): a, c, t, g, unknown or other
  misc_feature (514)..(541): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacaggactttcattctcaccatcagcagactgggacgcctagaagtagttttgactagttgttattactgtacagtcgtaggtacggttagttcgtacttccgttcccggtaccgtttccgggaccgtaacgggtaaccgaaagggtacggaaaactaccgaaaacgtacgtggtcggacgtacgacctacctacttcgtcgttacttaccacttcccttccccgactactcgtaggtacgttggtgttcggtaacgtgggtaacgggtccgggtcgtacgggaccgaagggcctagtaagtgnacgnnnnnnnnnnnnnnnnnnnnnnnnnnnn

SEQ ID NO: 238650 - DNA, 605 bp, Homo sapiens
  misc_feature: GYAE6OF02JKMSS.33.60.F05.1.454.CMB.1.raw
  modified_base (554)..(554): a, c, t, g, unknown or other
  misc_feature (554)..(554): n is a, c, g, or t
  modified_base (559)..(559): a, c, t, g, unknown or other
  misc_feature (559)..(559): n is a, c, g, or t
  modified_base (562)..(562): a, c, t, g, unknown or other
  misc_feature (562)..(562): n is a, c, g, or t
  modified_base (567)..(568): a, c, t, g, unknown or other
  misc_feature (567)..(568): n is a, c, g, or t
  modified_base (570)..(570): a, c, t, g, unknown or other
  misc_feature (570)..(570): n is a, c, g, or t
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
  modified_base (582)..(584): a, c, t, g, unknown or other
  misc_feature (582)..(584): n is a, c, g, or t
  modified_base (586)..(587): a, c, t, g, unknown or other
  misc_feature (586)..(587): n is a, c, g, or t
  modified_base (589)..(594): a, c, t, g, unknown or other
  misc_feature (589)..(594): n is a, c, g, or t
  modified_base (596)..(605): a, c, t, g, unknown or other
  misc_feature (596)..(605): n is a, c, g, or t
tcagtacacacactcacgaccggtgctcgatttagtacgtcatcagggaaagggccgacccgtctcttgtagggccagtcagagtgttagcagcaactacttagcctggtaccaacaaaacctgccagactccagctctcatctatgatgcatccaccagggcccactggcactccccagccaggttcagttggcaggtgggtctgggacacgacttcactctcaccatcagcagccctagacgcctagaacgtattttcgacgtagttttaacttaccgtttgtcttcggctaggacttacgcctaaaccgttccgggacccttaaacccgtaccgtttaccggtaccgaaacgggtaacccgacggtaaccgtacgggaaataaacggttaaactaaacggttcggtacgacgtcgatacccagttctcgttcttacgtaccttccgttacccgcttaactccgttacggtaacgttcggttacgtacgtttacgtcgggtaacggtccgggtggttacgggacgtaaacgggtccgaattacggaagcggntccgngtnagtgnngnagtcgngntcgnnngnntnnnnnntnnnnnnnnnn

SEQ ID NO: 238651 - DNA, 632 bp, Homo sapiens
  misc_feature: GYAE6OF02HGMGR.33.60.F05.1.454.CMB.1.raw
  modified_base (596)..(596): a, c, t, g, unknown or other
  misc_feature (596)..(596): n is a, c, g, or t
  modified_base (601)..(601): a, c, t, g, unknown or other
  misc_feature (601)..(601): n is a, c, g, or t
  modified_base (605)..(613): a, c, t, g, unknown or other
  misc_feature (605)..(613): n is a, c, g, or t
  modified_base (615)..(632): a, c, t, g, unknown or other
  misc_feature (615)..(632): n is a, c, g, or t
tcagtacacacactcacgaccggtgctcgatttagtacgtcatcagggaaagggccaccctctcttgtagggccagtcagagtgttagcagcaactacttagcctggtaccagcagacacctggcccaggctcccaggctcctcatccatggtgcatcccaccagggccactggcatccccagacaggttcagtggcagtgggtctgggacagacttcatttcctcaccatcagcagactggacgcctgaagtattttcgctagtagttattacgtgtacagcgtaagttacggttaagttccaattccgtacccggtaaccggtttccggaacccggtaaacggggtaacccgtaaaagggttaggtaaaaacgttaaccgaaaaaccggtaacgttacggttacggaccgttacggaccctaaacgtaccgttcgttacgttacctttacgtaccctttcccgtttacccccgtaccctagttacccgtaggttaacggtttcgttacgggtttacgttacgtacgggaaccgggtccggggtacgtacgggtaccggaacggggtacccgaacgttaacggtaggctacggangatgngtannnnnnnnngnnnnnnnnnnnnnnnnnn

SEQ ID NO: 238652 - DNA, 410 bp, Homo sapiens
  misc_feature: GYAE6OF02GBN4B.33.60.F05.1.454.CMB.1.raw
  modified_base (332)..(332): a, c, t, g, unknown or other
  misc_feature (332)..(332): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (394)..(410): a, c, t, g, unknown or other
  misc_feature (394)..(410): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctccgacgttcgcaagggccaaggtgaaatcaaacgatgtgctgcacntctgtcttcatcttcccgcatcngagtgtgtntactgagtcgggctgggcaaggcatagagnnnnnnnnnnnnnnnnn

SEQ ID NO: 238653 - DNA, 486 bp, Homo sapiens
  misc_feature: GYAE6OF02GVP50.33.60.F05.1.454.CMB.1.raw
  modified_base (457)..(458): a, c, t, g, unknown or other
  misc_feature (457)..(458): n is a, c, g, or t
  modified_base (460)..(486): a, c, t, g, unknown or other
  misc_feature (460)..(486): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagcctagaagtattttgctagtgtattacgtgtcagcagtacggtagttcatctaccgcgttccgaaccgaaggaccaaggtaggaaatacgaaaacgtaactgtaggctgacaccatctcgtcttacacttccttccccgacctactcctagaacgttgtagtcgtacgtggacggcgggtctcggacgaagggccgacgtaagtaagctagcatgannannnnnnnnnnnnnnnnnnnnnnnnnnn

SEQ ID NO: 238654 - DNA, 446 bp, Homo sapiens
  misc_feature: GYAE6OF02GGUCH.33.60.F05.1.454.CMB.1.raw
  modified_base (330)..(330): a, c, t, g, unknown or other
  misc_feature (330)..(330): n is a, c, g, or t
  modified_base (403)..(403): a, c, t, g, unknown or other
  misc_feature (403)..(403): n is a, c, g, or t
  modified_base (429)..(446): a, c, t, g, unknown or other
  misc_feature (429)..(446): n is a, c, g, or t
tcagtacacacactcacgaccggtgctcgatttagtacgtcatcagggaaaggggctggagtgggtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagttagcagtggctggtatcctttctccagcactgggccaggtaccctggtcaccgtctcctcagcctccaccagggcccatcggtcttccccctggcgccctgcctccagganccacctccgagagcacagcggcccctgggcctgccgtggtcaagggacctacttcccagtgtgtgttactcgngcgggctgggcaagggcgcagtacgnnnnnnnnnnnnnnnnnn

SEQ ID NO: 238655 - DNA, 411 bp, Homo sapiens
  misc_feature: GYAE6OF02GXRSH.33.60.F05.1.454.CMB.1.raw
  modified_base (382)..(382): a, c, t, g, unknown or other
  misc_feature (382)..(382): n is a, c, g, or t
  modified_base (397)..(411): a, c, t, g, unknown or other
  misc_feature (397)..(411): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgactgtgctgcacatctgtcttcatcttcccgccatctgagtgtgtgtactgagcgggntggcaggcgcatagnnnnnnnnnnnnnnn

SEQ ID NO: 238656 - DNA, 532 bp, Homo sapiens
  misc_feature: GYAE6OF02GRY9Z.33.60.F05.1.454.CMB.1.raw
  modified_base (226)..(226): a, c, t, g, unknown or other
  misc_feature (226)..(226): n is a, c, g, or t
  modified_base (462)..(462): a, c, t, g, unknown or other
  misc_feature (462)..(462): n is a, c, g, or t
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
  modified_base (493)..(493): a, c, t, g, unknown or other
  misc_feature (493)..(493): n is a, c, g, or t
tcagtacacacactcacgaccggtgctcgattttagtacgtcatcagggaaagggccacccctcctcttgtagggccagtcagagtgttacgcagcaactacttagcctggtaccagcagacacctggccaggctcccaggctcctcatccatggtgcgatccaccagggccactggcatcccagacgaggttcagtggcagtgggtctgggacagacttcattcncaccatcagcagactggacgcctggaagtattttgctaggttgttattactgtcagctagtacggtagttcattcctccgacgttcggaccaagggaccaggtaggaaatcgaaacgactggtgactgacacctatcgtagtcttcacttccttacccgactactctagtacgttgttcgtacgtcgtagacgggtcgggtctacgggactaacgggcgtacgtaacgtagctagngtcntcncagctgtctgactgcgcagcgtgntcgtcgcgcgcgtcgtcgacgcgcgcgtcctccgtctcg

SEQ ID NO: 238657 - DNA, 488 bp, Homo sapiens
  misc_feature: GYAE6OF02H0Q7F.33.60.F05.1.454.CMB.1.raw
  modified_base (451)..(451): a, c, t, g, unknown or other
  misc_feature (451)..(451): n is a, c, g, or t
  modified_base (454)..(458): a, c, t, g, unknown or other
  misc_feature (454)..(458): n is a, c, g, or t
  modified_base (460)..(470): a, c, t, g, unknown or other
  misc_feature (460)..(470): n is a, c, g, or t
  modified_base (472)..(479): a, c, t, g, unknown or other
  misc_feature (472)..(479): n is a, c, g, or t
  modified_base (481)..(486): a, c, t, g, unknown or other
  misc_feature (481)..(486): n is a, c, g, or t
  modified_base (488)..(488): a, c, t, g, unknown or other
  misc_feature (488)..(488): n is a, c, g, or t
tcagtacacacactcacgaccggtgctcgatttagtacgtcatcagggaaagggccacccctctcttgtagggccagtcagagtgttagcagcaactacttagcctggtaccagcagacacctggccaggctcccaggctcctcatccatggtgcatcccaccagggccactggcatcccagacaggttcagtggcaggtgggtctgggacagactttcattcctcaccatcagcagactggaatcctgaaagtattttgctagtcgtattactgtcagctagtagtagtcatctaccgcggttcggaccgaaggaccaaggtaggaaactcaaaacgacgtagtgactcgacaccatctcgtcttaccacttccttcccgctactcctagaacgttgtgttaggtccgtagacggtcgggcctgggaacgaccgggtagcctaaagtganacnnnnnannnnnnnnnnncnnnnnnnnannnnnntn

SEQ ID NO: 238658 - DNA, 518 bp, Homo sapiens
  misc_feature: GYAE6OF02HMUNO.33.60.F05.1.454.CMB.1.raw
  modified_base (351)..(351): a, c, t, g, unknown or other
  misc_feature (351)..(351): n is a, c, g, or t
  modified_base (470)..(471): a, c, t, g, unknown or other
  misc_feature (470)..(471): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
  modified_base (501)..(504): a, c, t, g, unknown or other
  misc_feature (501)..(504): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtggtctgggacagacttcattctcaccatcagcagactggagcctagaagtattttgactagtgtattactgtcagcagtacggtagttcatctccgacgttcggccaagggacaaggtgaaatacaaacgactgtggctgacacctaatcgtnttcttacacttccttccccgactacttcgtagtaagttgttacggttggttaactaggacggtaccgggtcgtacgggtacgaaaggggccgtacttaaagtacgtacgatagcagtanngagagagtgngacagngngtatnatgacannnnagagacnatntnan

SEQ ID NO: 238659 - DNA, 538 bp, Homo sapiens
  misc_feature: GYAE6OF02II6W8.33.60.F05.1.454.CMB.1.raw
  modified_base (504)..(504): a, c, t, g, unknown or other
  misc_feature (504)..(504): n is a, c, g, or t
  modified_base (509)..(510): a, c, t, g, unknown or other
  misc_feature (509)..(510): n is a, c, g, or t
  modified_base (512)..(513): a, c, t, g, unknown or other
  misc_feature (512)..(513): n is a, c, g, or t
  modified_base (515)..(515): a, c, t, g, unknown or other
  misc_feature (515)..(515): n is a, c, g, or t
  modified_base (517)..(538): a, c, t, g, unknown or other
  misc_feature (517)..(538): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcaggtgcaggtgggtctgggacagacttcattctcaccatcagccagacgtggacgcctagaagtattttgctagtgtattactgtcagtcagtacggttagtcatctccgtacggttcgaccgaagggaccaaggtacggaaacttacaaacgtaactggtacggactacgactaacctatacgttcgttcgttacacttcccttaccccggcctactaccgttaggaaccgtttggttacgttacgtaccgttagggacgggtaccggggtcgttacgggacgtaaacggtccgacgtaatacggtcagtcagcngtagnngnngncnnnnnnnnnnnnnnnnnnnnnn

SEQ ID NO: 238660 - DNA, 504 bp, Homo sapiens
  misc_feature: GYAE6OF02GDVTO.33.60.F05.1.454.CMB.1.raw
  modified_base (470)..(470): a, c, t, g, unknown or other
  misc_feature (470)..(470): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (480)..(504): a, c, t, g, unknown or other
  misc_feature (480)..(504): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctacaccatcagcagacgtggacgcctaggaagtagtttttgcgtagttcgttattacgtgttcagcgtagtacggtagttcattctccgtacggttcggacgaagggaccaagggtacgaaatacaaacgtaactgtggactgaccacatctgtcttcacttcccttcccgctactcgtacgtaggtttcgtgttacgtacgtgggtacggcgggtcgttacgggaccgaacgggtccgacgtaagtgacnagntcagngnnnnnnnnnnnnnnnnnnnnnnnnn

SEQ ID NO: 238661 - DNA, 421 bp, Homo sapiens
  misc_feature: GYAE6OF02H73M8.33.60.F05.1.454.CMB.1.raw
  modified_base (345)..(345): a, c, t, g, unknown or other
  misc_feature (345)..(345): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (405)..(421): a, c, t, g, unknown or other
  misc_feature (405)..(421): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctccctcatccatggtgcatccaccagggccactggcatcccagacaggttcagtggcagtgggtctgggacagacttcattctcaccatcagcagactggagcctgaagattttgcagttgtattactgtcagcaagtacgtagttcatcgtccgacgttcggcaagggaccaaggtggaaatcaaacgactgtgctgcaccatctntctcatcttcccgcatctgaagtgtgtgtactgagtcgggntgggcaagggcncgatagnnnnnnnnnnnnnnnnn

SEQ ID NO: 238662 - DNA, 463 bp, Homo sapiens
  misc_feature: GYAE6OF02FQJE3.33.60.F05.1.454.CMB.1.raw
  modified_base (240)..(240): a, c, t, g, unknown or other
  misc_feature (240)..(240): n is a, c, g, or t
  modified_base (331)..(331): a, c, t, g, unknown or other
  misc_feature (331)..(331): n is a, c, g, or t
  modified_base (440)..(463): a, c, t, g, unknown or other
  misc_feature (440)..(463): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagactttcattctcaccatcagcagactggancctgaagacttttgctagtgttattactgttcagcagtacggtattcgatctccgacgttcggcaaggccaaggtgaatcaaacgactggngtctgcaccgtatctgtcttcgacttaccttccccgctactccttagaacgttggttagtcgttaacgtggtaggccgggtgtcggcggtaaggccgacgtagtagcgnnnnnnnnnnnnnnnnnnnnnnnn

SEQ ID NO: 238663 - DNA, 434 bp, Homo sapiens
  misc_feature: GYAE6OF02IUTJH.33.60.F05.1.454.CMB.1.raw
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
  modified_base (376)..(376): a, c, t, g, unknown or other
  misc_feature (376)..(376): n is a, c, g, or t
  modified_base (411)..(434): a, c, t, g, unknown or other
  misc_feature (411)..(434): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcactctcaccatcagcagcctagagcctgaggattctgcagtttattactgtcagcagctctcaactggcctccgtncnccttcggccaaagggcacgattgganagttagacgtaactgtggctgcaacatctgtcttcatcttcccgcaatctgaatgtntgtactgagcgggctaggcaaggcgacaatacggnnnnnnnnnnnnnnnnnnnnnnnn

SEQ ID NO: 238664 - DNA, 492 bp, Homo sapiens
  misc_feature: GYAE6OF02GQNF7.33.60.F05.1.454.CMB.1.raw
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (465)..(471): a, c, t, g, unknown or other
  misc_feature (465)..(471): n is a, c, g, or t
  modified_base (473)..(492): a, c, t, g, unknown or other
  misc_feature (473)..(492): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatcccaccagggccactggcatcccagacaggttcagtggcaggtgggtctggacagacttcattctcaccatcagcagacgtggacgcctagaagtattttgctagttagttattactgtccagctagtacggtagttcatcctccgacgttcggaccgaagggaccaagggtagaaactaccgaaaagactgtggacgtgccactattctcgttcttctacttccttcccgcctacttactgtaagttcgtagttcgtacgtggtaggccgggtagtcggacgaacggccgagtagtagngntnatgcnnnnnnngnnnnnnnnnnnnnnnnnnnn

SEQ ID NO: 238665 - DNA, 408 bp, Homo sapiens
  misc_feature: GYAE6OF02GCLOL.33.60.F05.1.454.CMB.1.raw
  modified_base (270)..(270): a, c, t, g, unknown or other
  misc_feature (270)..(270): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
  modified_base (394)..(408): a, c, t, g, unknown or other
  misc_feature (394)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcactctcaccatcgacagactggagcctgaagattttgcagtctattactgtcagnagtatactgggggagacgttcggacaagggaccaaggtggaaatcgaaaacgaactggtgctgcacatctgtctnatctccgcatctgaatgtgtntctgagcgggctggcaaggcgtnatagnnnnnnnnnnnnnnn

SEQ ID NO: 238666 - DNA, 498 bp, Homo sapiens
  misc_feature: GYAE6OF02GFV7R.33.60.F05.1.454.CMB.1.raw
  modified_base (302)..(302): a, c, t, g, unknown or other
  misc_feature (302)..(302): n is a, c, g, or t
  modified_base (370)..(370): a, c, t, g, unknown or other
  misc_feature (370)..(370): n is a, c, g, or t
  modified_base (478)..(498): a, c, t, g, unknown or other
  misc_feature (478)..(498): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagtacttcattcctcaccatcagcagacgtggacgctagaagtatttgctagtgttattacgtgtctgctagcgtagcacgtcggtacctaacnccgttcggaccgaacgggacacgacgtggaagtaacttaaacgacttaggtcggctcgacctaacctntcgttgttccttactacttcccttacccgacctagtcctaggtaacgttggttacgttcgtacgtcggaacgggtcgggtcgtgggaccgaacggtcgagtacgtcgnnnnnnnnnnnnnnnnnnnnn

SEQ ID NO: 238667 - DNA, 470 bp, Homo sapiens
  misc_feature: GYAE6OF02H5ARX.33.60.F05.1.454.CMB.1.raw
  modified_base (241)..(241): a, c, t, g, unknown or other
  misc_feature (241)..(241): n is a, c, g, or t
  modified_base (337)..(337): a, c, t, g, unknown or other
  misc_feature (337)..(337): n is a, c, g, or t
  modified_base (433)..(434): a, c, t, g, unknown or other
  misc_feature (433)..(434): n is a, c, g, or t
  modified_base (437)..(438): a, c, t, g, unknown or other
  misc_feature (437)..(438): n is a, c, g, or t
  modified_base (440)..(440): a, c, t, g, unknown or other
  misc_feature (440)..(440): n is a, c, g, or t
  modified_base (444)..(470): a, c, t, g, unknown or other
  misc_feature (444)..(470): n is a, c, g, or t
tcagtacacacactcacgaccggtgctcgatttagtacgtcatcagggggaaagggccacccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagactcattctcaccatcagcagactggancctgaagtattttgctagtgtattactgtcagctagtacggtagttcatcgtccgacggttcggccaagggaccaaggtgaaatcaaacgactggngctgcacatctgtcttcacttcctccccgaccatccgtagaaggttgtggttcgtagtggacggccgggcgtcgggacgaacggggcgacagtagnntgnntncagnnnnnnnnnnnnnnnnnnnnnnnnnnn

SEQ ID NO: 238668 - DNA, 415 bp, Homo sapiens
  misc_feature: GYAE6OF02G1DA5.33.60.F05.1.454.CMB.1.raw
  modified_base (239)..(239): a, c, t, g, unknown or other
  misc_feature (239)..(239): n is a, c, g, or t
  modified_base (343)..(343): a, c, t, g, unknown or other
  misc_feature (343)..(343): n is a, c, g, or t
  modified_base (399)..(399): a, c, t, g, unknown or other
  misc_feature (399)..(399): n is a, c, g, or t
  modified_base (406)..(415): a, c, t, g, unknown or other
  misc_feature (406)..(415): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagtattttgcagtgtattactgtcagcagtacggtagttcatctccgacgttcggaccaagggaccaaggtaggaaatcgaaacgactgtggctgcacntctgtctcatcctcccgctatctagagtgtgtgtactgacgcgggctggcaggcgntagtagnnnnnnnnnn

SEQ ID NO: 238669 - DNA, 490 bp, Homo sapiens
  misc_feature: GYAE6OF02G29LL.33.60.F05.1.454.CMB.1.raw
  modified_base (456)..(456): a, c, t, g, unknown or other
  misc_feature (456)..(456): n is a, c, g, or t
  modified_base (459)..(490): a, c, t, g, unknown or other
  misc_feature (459)..(490): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagtattttgcagttgtattactgtcagcagtacggttagttcattccgtccggtacgttccggaccgaagggaccaagggtggaaaatcgaaaacgaacgtgtggctgacactatcctgtcttcgattccttcccgcactcgtagtaagtcgtagttagtacctggacggtccggggtactcgggacgaaacgggccgtacgtaagtacggnacnnnnnnnnnnnnnnnnnnnnnnnnnnnnnnnn

SEQ ID NO: 238670 - DNA, 446 bp, Homo sapiens
  misc_feature: GYAE6OF02HCSIP.33.60.F05.1.454.CMB.1.raw
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
  modified_base (414)..(446): a, c, t, g, unknown or other
  misc_feature (414)..(446): n is a, c, g, or t
tcagtacacacactcacgaccggtgctcgatttagtacgtcatcagggaaagggggccaccctctcttgtagggccagtcagagtgttagcagcaactacttagcctggtaccagcagaccaccctggccaggctcccaggctcctcgatccatggtgcatccaccagggccactggcatcccagacaggttcagtggcagtgggtctgggacagatttcactctcaccataagcagtctggaacctgaagattttggaagatacttctgtcaacagacttatagtaacccgtactacttttggcctaggggaccaagctggacgatcaagcgaactgtggctgcaccatctgtcttcatcttccccgcatctgaacgtgtgtagtacngagcgggctggcaaggcgngatagnnnnnnnnnnnnnnnnnnnnnnnnnnnnnnnnn

SEQ ID NO: 238671 - DNA, 581 bp, Homo sapiens
  misc_feature: GYAE6OF02HOABA.33.60.F05.1.454.CMB.1.raw
  modified_base (534)..(534): a, c, t, g, unknown or other
  misc_feature (534)..(534): n is a, c, g, or t
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
  modified_base (548)..(550): a, c, t, g, unknown or other
  misc_feature (548)..(550): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (563)..(564): a, c, t, g, unknown or other
  misc_feature (563)..(564): n is a, c, g, or t
  modified_base (566)..(567): a, c, t, g, unknown or other
  misc_feature (566)..(567): n is a, c, g, or t
  modified_base (569)..(570): a, c, t, g, unknown or other
  misc_feature (569)..(570): n is a, c, g, or t
  modified_base (572)..(573): a, c, t, g, unknown or other
  misc_feature (572)..(573): n is a, c, g, or t
  modified_base (575)..(579): a, c, t, g, unknown or other
  misc_feature (575)..(579): n is a, c, g, or t
  modified_base (581)..(581): a, c, t, g, unknown or other
  misc_feature (581)..(581): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccacagggccactggcatcccagacaggttcagtggcaggtgggtctgggacagacttcattctcaccatccagcagacgtggactcctaggaagtattttgactaggttgttattactgtacaggcaagcgtacgacaacgttggtcttaggacgtttacggaccgtaaagggtacccaaagggtacggaaactaccgtaaaaacgaccgttaggtaggtaccgtaggtccaacccgattaccgttagttaccttacgtaaccttacccgttccccggtacctaacgttccttagggtaacgtttcggtaggttacgttaaccggttgaaccgggtcggggtacgtcgggtacgaacgggcgtccgaagtacggacntacgnagtntagannncngnanctgactnngnnanncnncnnnnnan

SEQ ID NO: 238672 - DNA, 125 bp, Homo sapiens
  misc_feature: GYAE6OF02HXLAP.33.60.F05.1.454.CMB.1.raw
  modified_base (123)..(125): a, c, t, g, unknown or other
  misc_feature (123)..(125): n is a, c, g, or t
tcagtacacacactcacgaccggtgctcgatttagtacgtcatcagggaaagggccaccctctcttgtagggccagtcagagtgttagcagcaactacttagcctggtaccagcagacacctnnn

SEQ ID NO: 238673 - DNA, 408 bp, Homo sapiens
  misc_feature: GYAE6OF02GN0FH.33.60.F05.1.454.CMB.1.raw
  modified_base (401)..(408): a, c, t, g, unknown or other
  misc_feature (401)..(408): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttccgccatcctgaagtgtgtgtactgagcgggctggcaggcgcatagnnnnnnnn

SEQ ID NO: 238674 - DNA, 604 bp, Homo sapiens
  misc_feature: GYAE6OF02JTO56.33.60.F05.1.454.CMB.1.raw
  modified_base (224)..(224): a, c, t, g, unknown or other
  misc_feature (224)..(224): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (568)..(568): a, c, t, g, unknown or other
  misc_feature (568)..(568): n is a, c, g, or t
  modified_base (574)..(574): a, c, t, g, unknown or other
  misc_feature (574)..(574): n is a, c, g, or t
  modified_base (579)..(581): a, c, t, g, unknown or other
  misc_feature (579)..(581): n is a, c, g, or t
  modified_base (583)..(589): a, c, t, g, unknown or other
  misc_feature (583)..(589): n is a, c, g, or t
  modified_base (591)..(604): a, c, t, g, unknown or other
  misc_feature (591)..(604): n is a, c, g, or t
tcagtacacacactcacgaccggtgctcgatttagtacgtcatcagggaaaggggcgtggagtgggtcgcaactattagtggcggtggaactcatacatactacgccgactccgtgaagggccgcttcaccatctccagagacaattccaacaacacggtgtttctgcaaaatgaatagcctgagagtcgaggacatggcatatattactgtgcgtagagttanctaggtggctggtacttcctttcttcagcacgtcgggggacctagggttacccgtggtcctaccggttctcccgttacgactccccgtcctaacccggaacgggcccctaggtcccggttaccttccccccgtgggacccgtccccgtgcccttacccgaacgggtcgacccctaacccgttccggaaccggaacggccccaacgacggggcccggtccccggtggggtacccttcggaacccgttgggtaacccaacgggtacccttaaccgttcgacggttgttcggtacgtacgtgggtacgcgggtctggacgacggctcgactaggcagccngncgcgngcgagngcgcnnncnnnnnnngnnnnnnnnnnnnnn

SEQ ID NO: 238675 - DNA, 878 bp, Homo sapiens
  misc_feature: GYAE6OF02FVXIN.33.60.F05.1.454.CMB.1.raw
tcagtacacacactcacgaccggtgctcgatttagtacgtcatcaggggaaagggggccaccctatcgtgtagggccagtcaggagtgttacgcagcgaactacgttagcctggtaccagcacgtacacctggccaggctcccaggctcctgactccgactggtgcactccaccagggccctacctgggcccattccccagtacggtacggtttccaggtcgggacaggttcgggtcctaggggactaggtacctttcgacctcctccgaacccatccagtcacgtccgttaaggacgtcctaggtaagacttttggcctacgtttaattactcgtacctggaccacgtaccgtaacgtcaaacgttggaccttaactacccggttaccggggcctaaagggtaccgaccgtaccgttcgggtaaggttaacgtttaaaacgtaaaccgttggttacggtccgttacggtaccctaacccgtaaagttcccgttacgggttaccctttaaccgaaccgtttaccccgttttaccccccgggaccctaacgtttaacccggttttaacggtttacggtttaccggggtttaacggttttaccccgttaacgggggtaaccgggttcccggggggtaaaccggttaccggggggtaaacccggttaaccggggtaacccgggtttaaccgttaaacccggtttagttaacggcgttaacccgttcggtacctttaagaccgggttacgtaccggtacggttaaggttaccggttttacggttaggttccggtaggtccgggtaggtacgtacggtacggtacgtacgtacgtacgtacgtaccgtacgtacgtcccgtaccgtaccgtaccgtacgtccg

SEQ ID NO: 238676 - DNA, 453 bp, Homo sapiens
  misc_feature: GYAE6OF02HBEH2.33.60.F05.1.454.CMB.1.raw
  modified_base (223)..(223): a, c, t, g, unknown or other
  misc_feature (223)..(223): n is a, c, g, or t
  modified_base (371)..(371): a, c, t, g, unknown or other
  misc_feature (371)..(371): n is a, c, g, or t
  modified_base (425)..(425): a, c, t, g, unknown or other
  misc_feature (425)..(425): n is a, c, g, or t
  modified_base (428)..(453): a, c, t, g, unknown or other
  misc_feature (428)..(453): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagtacttcatttccncaccatcagcagactggagcctagaagtatttgcagttgtattactgtcagcagtacggtagttcatcgtccgacgttcggaccaacgggacaaggtaggaaatacaaacgaactgtacgctgacacatactgtctcactccttcccncatcagtagtgtgtgtacgtgaggcggcgtggacgtaacggcgtactagtacgntgnnnnnnnnnnnnnnnnnnnnnnnnnn

SEQ ID NO: 238677 - DNA, 696 bp, Homo sapiens
  misc_feature: GYAE6OF02JJD8V.33.60.F05.1.454.CMB.1.raw
  modified_base (215)..(215): a, c, t, g, unknown or other
  misc_feature (215)..(215): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (640)..(640): a, c, t, g, unknown or other
  misc_feature (640)..(640): n is a, c, g, or t
  modified_base (643)..(643): a, c, t, g, unknown or other
  misc_feature (643)..(643): n is a, c, g, or t
  modified_base (652)..(652): a, c, t, g, unknown or other
  misc_feature (652)..(652): n is a, c, g, or t
  modified_base (667)..(667): a, c, t, g, unknown or other
  misc_feature (667)..(667): n is a, c, g, or t
  modified_base (676)..(676): a, c, t, g, unknown or other
  misc_feature (676)..(676): n is a, c, g, or t
  modified_base (681)..(682): a, c, t, g, unknown or other
  misc_feature (681)..(682): n is a, c, g, or t
  modified_base (686)..(687): a, c, t, g, unknown or other
  misc_feature (686)..(687): n is a, c, g, or t
  modified_base (691)..(691): a, c, t, g, unknown or other
  misc_feature (691)..(691): n is a, c, g, or t
  modified_base (694)..(695): a, c, t, g, unknown or other
  misc_feature (694)..(695): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctccaggctcctcatccatggtgcactccaccagggccacgtggcatcccagacaggttcagtgcaggtggtctgggacagtactnattctcacatcagcagactggacgtcctagaagtattttcgcgtaggttnttattacgngttcaagtccgtagtaacggttacggttactagtccgttacccggtacgttcccggggaccgtaaaacggggtaccctaaacggggttaggtaaaacttacccgggtaaaaaacggtaacccggttgggtaacgggtccttaccgggaacctaaaccccgttgtttaaccccggtttggtttaccctttaacgtaaaccgtttccccgtttaccccccgacgtaaaccgttttccgtaacgggttacgtttaccggtttacggttaccggtttaaccgttagggtaaccgggttcccggggtacgttacggggaacggtaacccgggtacgtacggtaactttacggaacttcgattcgagtaccngtnatcgtagcncgtcgtctcgtgcgngagcgtctncgtanntgtnntacngtnnc

SEQ ID NO: 238678 - DNA, 497 bp, Homo sapiens
  misc_feature: GYAE6OF02F0MI4.33.60.F05.1.454.CMB.1.raw
  modified_base (240)..(240): a, c, t, g, unknown or other
  misc_feature (240)..(240): n is a, c, g, or t
  modified_base (374)..(374): a, c, t, g, unknown or other
  misc_feature (374)..(374): n is a, c, g, or t
  modified_base (464)..(464): a, c, t, g, unknown or other
  misc_feature (464)..(464): n is a, c, g, or t
  modified_base (468)..(497): a, c, t, g, unknown or other
  misc_feature (468)..(497): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggacncctgaagtattttgctagttgttattactgtcagctaggtacggttagtctatccgtccgtacgttccgaaccgaagggaccaaggtaggaaactacgaaaacgactggtggtctagccactatctgtcttacncttcctcccgactacttcgtgtaaggttcgtgttacgtctaggtacggcgggtccgtggtacggaacggtccggactagtacgtgactgntagnnnnnnnnnnnnnnnnnnnnnnnnnnnnnn

SEQ ID NO: 238679 - DNA, 506 bp, Homo sapiens
  misc_feature: GYAE6OF02IDEOT.33.60.F05.1.454.CMB.1.raw
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (420)..(420): a, c, t, g, unknown or other
  misc_feature (420)..(420): n is a, c, g, or t
  modified_base (472)..(472): a, c, t, g, unknown or other
  misc_feature (472)..(472): n is a, c, g, or t
  modified_base (474)..(506): a, c, t, g, unknown or other
  misc_feature (474)..(506): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggcccactggcatcccagcaggttcagtggcagtgggtctggggacagacttcattctcaccatcagcagactggancctgaagtattttcgnagtgtattactgtcagctaggtacggtattcatctcacgttggccaaagggacctaaggtaggaaaatacgaaaaacggaactacggtgacgngacccacctancgttagttccgttaatactttacccggttcccctaaccgtctaccgtaggtaacggtttntacggttagtaacgtggaacggtcggtggtcggaacgacggtcgacaagtangnnnnnnnnnnnnnnnnnnnnnnnnnnnnnnnnn

SEQ ID NO: 238680 - DNA, 546 bp, Homo sapiens
  misc_feature: GYAE6OF02GOBET.33.60.F05.1.454.CMB.1.raw
  modified_base (238)..(238): a, c, t, g, unknown or other
  misc_feature (238)..(238): n is a, c, g, or t
  modified_base (466)..(466): a, c, t, g, unknown or other
  misc_feature (466)..(466): n is a, c, g, or t
  modified_base (474)..(474): a, c, t, g, unknown or other
  misc_feature (474)..(474): n is a, c, g, or t
  modified_base (484)..(484): a, c, t, g, unknown or other
  misc_feature (484)..(484): n is a, c, g, or t
  modified_base (537)..(537): a, c, t, g, unknown or other
  misc_feature (537)..(537): n is a, c, g, or t
tcagtacacacactcacgaccggtgctcgatttagtacgtcatcagggaagggccaccctctcttgtagggccagtcagagtgttagcagcaactacttagcctggtaccagcagacacctggccaggctcccaggctcctcatccatgtgcatccacaggccactggcatcccagacaggttcagtggcaggtggtctgggacaggacttcgattcgtcaccatccagcagactgancctgagatttgctagtgtattactgtcagcaggtaccgtagttcgaatcgtccgtacggttcgaccaagggtccaaggtgaaatacgaacgaactgtggactgacacctagtctgtctcgactaccttcccgactagtcctagtaagtctcggtattaacgtgaacggtccggggtaatccgggtacgaacgggtcgtacgtaattaggactacgaagtcgtaaccgngagtacgngacgcgagcncgacgtctagtacgtacgtacgtacgcgacgacgacgtcgtgtcgtacgtagngagcgagac

SEQ ID NO: 238681 - DNA, 601 bp, Homo sapiens
  misc_feature: GYAE6OF02H4JJZ.33.60.F05.1.454.CMB.1.raw
  modified_base (226)..(226): a, c, t, g, unknown or other
  misc_feature (226)..(226): n is a, c, g, or t
  modified_base (461)..(461): a, c, t, g, unknown or other
  misc_feature (461)..(461): n is a, c, g, or t
  modified_base (536)..(536): a, c, t, g, unknown or other
  misc_feature (536)..(536): n is a, c, g, or t
  modified_base (548)..(548): a, c, t, g, unknown or other
  misc_feature (548)..(548): n is a, c, g, or t
  modified_base (557)..(557): a, c, t, g, unknown or other
  misc_feature (557)..(557): n is a, c, g, or t
  modified_base (563)..(563): a, c, t, g, unknown or other
  misc_feature (563)..(563): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (570)..(571): a, c, t, g, unknown or other
  misc_feature (570)..(571): n is a, c, g, or t
  modified_base (575)..(576): a, c, t, g, unknown or other
  misc_feature (575)..(576): n is a, c, g, or t
  modified_base (578)..(578): a, c, t, g, unknown or other
  misc_feature (578)..(578): n is a, c, g, or t
  modified_base (580)..(581): a, c, t, g, unknown or other
  misc_feature (580)..(581): n is a, c, g, or t
  modified_base (583)..(583): a, c, t, g, unknown or other
  misc_feature (583)..(583): n is a, c, g, or t
  modified_base (586)..(586): a, c, t, g, unknown or other
  misc_feature (586)..(586): n is a, c, g, or t
  modified_base (588)..(595): a, c, t, g, unknown or other
  misc_feature (588)..(595): n is a, c, g, or t
  modified_base (597)..(598): a, c, t, g, unknown or other
  misc_feature (597)..(598): n is a, c, g, or t
  modified_base (600)..(601): a, c, t, g, unknown or other
  misc_feature (600)..(601): n is a, c, g, or t
tcagtacacacactcacgaccggtgctcgatttagtacgtcatcagggaaagggccgaccctctcttgtaggccagtcagagtgttagcagcaactactagcctggtaccagcagacacctggccaggctcccaggcctcctcatccgatggtgccatccaccgagggccactggcatccccagacaggttcagtggcaggtgggtcgtgggacagcttcgattcncgacactcagtcacgatgggagcctaggaactattttgacaaggttgtaacttactgtacagactaaggtaccggttaattcaacttccgtaccctaacgggtttccggacccctaaagggggaaccctaaaggggtacggaaaaacttaccgaaaaacggtaacggtggtacggaactccggacacccgtagttccgtgttaccttaacgtccgttcctttaccccggacttanaccgtttaggaaccgtttgggtagtttaccgtaaacgttcggaaacggtcgggtcgtaggacgaaacggtccganaacgttagcgtnagtctacgnacgctnagngngnngagnngngnngngtnannnnnnnngnngnn

SEQ ID NO: 238682 - DNA, 586 bp, Homo sapiens
  misc_feature: GYAE6OF02IGUBJ.33.60.F05.1.454.CMB.1.raw
  modified_base (265)..(265): a, c, t, g, unknown or other
  misc_feature (265)..(265): n is a, c, g, or t
  modified_base (544)..(545): a, c, t, g, unknown or other
  misc_feature (544)..(545): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (551)..(552): a, c, t, g, unknown or other
  misc_feature (551)..(552): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (561)..(562): a, c, t, g, unknown or other
  misc_feature (561)..(562): n is a, c, g, or t
  modified_base (565)..(565): a, c, t, g, unknown or other
  misc_feature (565)..(565): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (573)..(586): a, c, t, g, unknown or other
  misc_feature (573)..(586): n is a, c, g, or t
tcagtacacacactcacgaccggtgctcgatttagtacgtcatcagggaaagggccacccctctcttgtagggccagtcagagtgttagcagcaactacttagcctggtaccagcagacacctggcccaggcctcccgaggctcctcactccgatggtgcactcccacccagggcccactggcatcccagacaggttcagtggacaggtggtcgtgggacagacttcattctcacctatccagcagactggacgcctggaaggtnttcctgccgtaagttttacttacgtggtactacggtcacggtccgtacctacaaccgtcgggtcctaccggtcgcctacgttccgaccgaaggacacgtagttcggagttaagtcgaacgtactggtacggtctacggaccttaccgtcgttacgttcctacgtcccgtttcccgtcccgtacctacgttccgttagtaacgtttcggttagtacggttagttaccgggcggtccgggtacgtaccgggtacggaacgggttccgtaacctgaaccggnngngngnngncnctagnngcncgncncgnnnnnnnnnnnnnn

SEQ ID NO: 238683 - DNA, 568 bp, Homo sapiens
  misc_feature: GYAE6OF02FRCK1.33.60.F05.1.454.CMB.1.raw
  modified_base (242)..(242): a, c, t, g, unknown or other
  misc_feature (242)..(242): n is a, c, g, or t
  modified_base (515)..(516): a, c, t, g, unknown or other
  misc_feature (515)..(516): n is a, c, g, or t
  modified_base (523)..(523): a, c, t, g, unknown or other
  misc_feature (523)..(523): n is a, c, g, or t
  modified_base (525)..(526): a, c, t, g, unknown or other
  misc_feature (525)..(526): n is a, c, g, or t
  modified_base (532)..(532): a, c, t, g, unknown or other
  misc_feature (532)..(532): n is a, c, g, or t
  modified_base (541)..(541): a, c, t, g, unknown or other
  misc_feature (541)..(541): n is a, c, g, or t
  modified_base (548)..(548): a, c, t, g, unknown or other
  misc_feature (548)..(548): n is a, c, g, or t
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
  modified_base (562)..(564): a, c, t, g, unknown or other
  misc_feature (562)..(564): n is a, c, g, or t
  modified_base (566)..(566): a, c, t, g, unknown or other
  misc_feature (566)..(566): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccgagggccactggcatcccagacaggttcagtgcagtgggtctagggacagtacttcattctcaaccatcagcagactggancctgaagtatttgcagtgtattactgtcagctagtacggtattcatctccgtacgttccggaccaaagggaccgtaaggtagtaaaactaccgtaaaacgtaacgtggtacggtcgtacgaccgtaacctacttacctggttccttactactttacccttccccgactacgtcctagtaacggtttgtacgttacgtacgtacggtacggtccgggtacgtcgggtaaccgaaagggtcccgtaaccgtaagttaccggagtcgagcgacgtnntagtcgntnntactcntatagcgtngtagtcnacagtagngtcntnnncntc

SEQ ID NO: 238684 - DNA, 451 bp, Homo sapiens
  misc_feature: GYAE6OF02FUB4X.33.60.F05.1.454.CMB.1.raw
  modified_base (425)..(451): a, c, t, g, unknown or other
  misc_feature (425)..(451): n is a, c, g, or t
tcagtacacacactcacgaccggtgctcgatttagtacgtcatcagggaaagggccaccctctcttgtagggccagtcagagtgctggcagcaacttagcctggtaccaacaaaaacctggccagactcccaggctcctcatccatggtgcatccaccagggccactggcatcccagccaggttcagtggcagtgggtctgggacagacttcactctcaccatcagcagcctagacgcctgaggattctgctagtttatactgtcagcagcgtctcaactggcctccgtgccgtaccttcggaccgaagggaccacggtattggagtagttagacgtaactggtggctgccacctctgtctcatcctcccgcatctgtagtgtgtgtactggacgcgggactggacgtaaggcgtacagttagannnnnnnnnnnnnnnnnnnnnnnnnnn

SEQ ID NO: 238685 - DNA, 461 bp, Homo sapiens
  misc_feature: GYAE6OF02FX3YS.33.60.F05.1.454.CMB.1.raw
  modified_base (239)..(239): a, c, t, g, unknown or other
  misc_feature (239)..(239): n is a, c, g, or t
  modified_base (429)..(431): a, c, t, g, unknown or other
  misc_feature (429)..(431): n is a, c, g, or t
  modified_base (433)..(433): a, c, t, g, unknown or other
  misc_feature (433)..(433): n is a, c, g, or t
  modified_base (435)..(461): a, c, t, g, unknown or other
  misc_feature (435)..(461): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgttattactgtcagcagtacggtagttcatctccgacgttcggaccaagggaccaaggtagaaatacaaacgaacgtgtggctgacactatctgtcttcactcttcccgacctatcgtgtaacgtgtgtagttacgtggaggcgggcttacgggacgaaggcgacgtatagtnnngnannnnnnnnnnnnnnnnnnnnnnnnnnn

SEQ ID NO: 238686 - DNA, 431 bp, Homo sapiens
  misc_feature: GYAE6OF02ILUVR.33.60.F05.1.454.CMB.1.raw
  modified_base (422)..(431): a, c, t, g, unknown or other
  misc_feature (422)..(431): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggcccactggcatcccagacaggttcagtggcagtgggtctgggacagacttcattcctcaccatcagcagactggagcctgaagattttgcagtgtattactgtcagcagtacggtagttcatcgtccgacggttccgccaagggaccaggtgaaatcaaacgactgtgctgcacatctgtcttcgactccttcccgctactctagaagtgttgtacgtacgtgacggcgggtactgggacgaaggcgactagtacgnnnnnnnnnn

SEQ ID NO: 238687 - DNA, 460 bp, Homo sapiens
  misc_feature: GYAE6OF02FW5UO.33.60.F05.1.454.CMB.1.raw
  modified_base (220)..(220): a, c, t, g, unknown or other
  misc_feature (220)..(220): n is a, c, g, or t
  modified_base (390)..(390): a, c, t, g, unknown or other
  misc_feature (390)..(390): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (427)..(428): a, c, t, g, unknown or other
  misc_feature (427)..(428): n is a, c, g, or t
  modified_base (433)..(434): a, c, t, g, unknown or other
  misc_feature (433)..(434): n is a, c, g, or t
  modified_base (437)..(460): a, c, t, g, unknown or other
  misc_feature (437)..(460): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattcncaccatcagcagactggagcctagaagatttttgacagtagtatttactgtcagcaagttacggtagttcatccgtccgacgttcggccaagggacctaagggtggaaatacaaacgaacctggtacggctgcaccgatctgtcttcatctccgcctatctgagtgtgtntacgtgagcgggtntgggactaggcgntagtagagtnncagtnnagnnnnnnnnnnnnnnnnnnnnnnnn

SEQ ID NO: 238688 - DNA, 470 bp, Homo sapiens
  misc_feature: GYAE6OF02GPWN3.33.60.F05.1.454.CMB.1.raw
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
  modified_base (437)..(437): a, c, t, g, unknown or other
  misc_feature (437)..(437): n is a, c, g, or t
  modified_base (439)..(441): a, c, t, g, unknown or other
  misc_feature (439)..(441): n is a, c, g, or t
  modified_base (444)..(470): a, c, t, g, unknown or other
  misc_feature (444)..(470): n is a, c, g, or t
tcagtacacacactcacgaccggtgctcgatttagtacgtcatcagggggaaagggccaccctctcttgtagggccagtcagagtgttagcagcaactacttagcctggtaccagcagacacctggccaggctcccaggctcctcatccatggtgcatccaccagggccactggcatcccagacaggttcagtgcagtgggtctgggacagactttcattctcacactcagcagactggagcctagaagattttnctagttgtattactntcagctagtacggtattcatctcgacgttcggcaaggaccaagtgaaatcgaaacgaactgngntgacacatctgtcttcattcctcccncctatcctagtaagtgtcgttagtacgtgtacggcgggtaccttggggaacctaaagggtccacgtacgtaagctantnnngcnnnnnnnnnnnnnnnnnnnnnnnnnnn

SEQ ID NO: 238689 - DNA, 627 bp, Homo sapiens
  misc_feature: GYAE6OF02IBVWG.33.60.F05.1.454.CMB.1.raw
  modified_base (154)..(154): a, c, t, g, unknown or other
  misc_feature (154)..(154): n is a, c, g, or t
  modified_base (208)..(208): a, c, t, g, unknown or other
  misc_feature (208)..(208): n is a, c, g, or t
  modified_base (532)..(532): a, c, t, g, unknown or other
  misc_feature (532)..(532): n is a, c, g, or t
  modified_base (537)..(537): a, c, t, g, unknown or other
  misc_feature (537)..(537): n is a, c, g, or t
  modified_base (545)..(545): a, c, t, g, unknown or other
  misc_feature (545)..(545): n is a, c, g, or t
  modified_base (555)..(555): a, c, t, g, unknown or other
  misc_feature (555)..(555): n is a, c, g, or t
  modified_base (560)..(560): a, c, t, g, unknown or other
  misc_feature (560)..(560): n is a, c, g, or t
  modified_base (566)..(566): a, c, t, g, unknown or other
  misc_feature (566)..(566): n is a, c, g, or t
  modified_base (578)..(578): a, c, t, g, unknown or other
  misc_feature (578)..(578): n is a, c, g, or t
  modified_base (584)..(584): a, c, t, g, unknown or other
  misc_feature (584)..(584): n is a, c, g, or t
  modified_base (605)..(605): a, c, t, g, unknown or other
  misc_feature (605)..(605): n is a, c, g, or t
tcagtacacacactcacgaccggtgctcgatttagtacgtcatcagggaaagggccgaccctctcttgtagggccagtcagagtgttagcagcaactacttagcctggtaccagcagacacctggccaggctccaggctcctcatccatggtcncatcccaccgagggccactggccatcccagactagttcagtggcaggtgggtcngggacacggtacttcactttccgtacaccactcgacgtcgaagtacgtggacgtccgtagaagtactttcgctaggttcgtattacgtgtacgagcgtaagtacggtacgttacgaacgttccgttaccgacggtttccggaccgaacgggtaccaaagggttacggaactacgtaaacggacgtggtcggtactcggacctacgtacgttctcgttcttacctagttacccgtccgccctagtcgtacggtacgtgttcggtacttacggtacgacgggtcggtccgtggaaccgagggtccgacgttacgtacgtacgcgtntacgntacgcgancgtagcgtanacgtnacggtntacgatccgaanccgttnaaccgtggcacgtacggtacnccgttagcgttacacgtcgtcc

SEQ ID NO: 238690 - DNA, 626 bp, Homo sapiens
  misc_feature: GYAE6OF02GP0DU.33.60.F05.1.454.CMB.1.raw
  modified_base (573)..(573): a, c, t, g, unknown or other
  misc_feature (573)..(573): n is a, c, g, or t
  modified_base (581)..(581): a, c, t, g, unknown or other
  misc_feature (581)..(581): n is a, c, g, or t
  modified_base (585)..(586): a, c, t, g, unknown or other
  misc_feature (585)..(586): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (598)..(598): a, c, t, g, unknown or other
  misc_feature (598)..(598): n is a, c, g, or t
  modified_base (607)..(607): a, c, t, g, unknown or other
  misc_feature (607)..(607): n is a, c, g, or t
  modified_base (610)..(610): a, c, t, g, unknown or other
  misc_feature (610)..(610): n is a, c, g, or t
  modified_base (612)..(613): a, c, t, g, unknown or other
  misc_feature (612)..(613): n is a, c, g, or t
  modified_base (617)..(620): a, c, t, g, unknown or other
  misc_feature (617)..(620): n is a, c, g, or t
  modified_base (626)..(626): a, c, t, g, unknown or other
  misc_feature (626)..(626): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcactccccagacaggttcagtggcaggtggtctgggacagcttcattctcaccatcagcagaccgtggacgcctagaagtattttgctaggtgttaattacgtgtacaggtactaaggttacgggttacgttcacttccgtccggtacggtttccggaccgaaacgggggacctaagggtacggtaaacaccggtaaaaccgtaacgtggtacggtcttacgacccgtaacctacgttcttacggttcctttacgtaacccttcccgtttccccggaccctagttaccgttaggtaacgtttggttaggttacggttaacgtacgggtaacgggtccggggtacggttacggggacgtaaaccgggccggttacggtaacgtacggtgagtcagtcgtagngagacgangtanntcncncgcgtantacgtcgtntcngnnactnnnntcgtan

SEQ ID NO: 238691 - DNA, 579 bp, Homo sapiens
  misc_feature: GYAE6OF02HYPKG.33.60.F05.1.454.CMB.1.raw
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (552)..(579): a, c, t, g, unknown or other
  misc_feature (552)..(579): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctccaggctcctcatccatggtgcatcccaccagggccacgtggcatcccagacaggttcagtggcaggtgggtctgggacagtacttcattcncaccntacagcagactcggacgccgtagtaagttagtttttacgacgtaggttagttatttacgttcggtcgaagaccgttaaggttacggttatttactacgtttccgtacccggtacggttccggacccgaaacggggtaacccgtaaaggggttaacggtaaaactaccgaaaaccggtacgttagggtcggtacgtcgacctacccgtattcgtcgtttcttacctacttcccgttacccgacctattccgtaggtagtttcgtagttcgtacgtcggtacggcgggtcgtaggaccgaggccgacgtaagtgntngtngncgtnnnnnnnnnnnnnnnnnnnnnnnnnnnn

SEQ ID NO: 238692 - DNA, 556 bp, Homo sapiens
  misc_feature: GYAE6OF02IWJI9.33.60.F05.1.454.CMB.1.raw
  modified_base (493)..(493): a, c, t, g, unknown or other
  misc_feature (493)..(493): n is a, c, g, or t
  modified_base (531)..(556): a, c, t, g, unknown or other
  misc_feature (531)..(556): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcactcccaccagggcccactggcactcccagacaggttcagtggcaggtgggtctggggacagaccttcgattctacaccatcagcagtacgtggacgctagaacgttattttcgcgtagttagttattacgtgtccgagctaggacgtacgactaccgtggttcgttacgggtacgttaccggaccggaaacgggaacctaaggggtaagaaacgtaacgtaaaacgtaacgttggaacggtcgacgtacaacgtacttccgtgttcccttacgtaacttccccgtaccggtcctacgttactcgggtaagttccgtagtttcgtaacgtcgggtcggngggttcctacgggaccgtaggaccgttactaaggtgcnnnnnnnnnnnnnnnnnnnnnnnnnn

SEQ ID NO: 238693 - DNA, 582 bp, Homo sapiens
  misc_feature: GYAE6OF02F9XI3.33.60.F05.1.454.CMB.1.raw
  modified_base (531)..(531): a, c, t, g, unknown or other
  misc_feature (531)..(531): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (563)..(565): a, c, t, g, unknown or other
  misc_feature (563)..(565): n is a, c, g, or t
  modified_base (567)..(573): a, c, t, g, unknown or other
  misc_feature (567)..(573): n is a, c, g, or t
  modified_base (575)..(575): a, c, t, g, unknown or other
  misc_feature (575)..(575): n is a, c, g, or t
  modified_base (577)..(581): a, c, t, g, unknown or other
  misc_feature (577)..(581): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccaggccactggcatcccagacaggttcagtggcaggtggtctgggacagacttcattctcaccatcagcagacctggacgcctgaagtattttgacagtgtacttactgtacagcaggttacgtagttcatctaccggtacgttccggacgaaagggtacccaagggtacggaaaataccgtaaaaccggaagttcggtcggactacgggaccaacctcgttctttacgtacctttacaccgttcccgtttccccgactacgttccgtaggtaacgtttggtacgttacgttacgttacgggaccggtccggggtacgtacgggacggtaaacgggtcccgtaacgttaaacggttcggcgtataccgtanccgtagtcacgcgtagtgcgtacngancntcnnngnnnnnnncncnnnnnc

SEQ ID NO: 238694 - DNA, 449 bp, Homo sapiens
  misc_feature: GYAE6OF02FQZAP.33.60.F05.1.454.CMB.1.raw
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (322)..(322): a, c, t, g, unknown or other
  misc_feature (322)..(322): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (420)..(449): a, c, t, g, unknown or other
  misc_feature (420)..(449): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcgattctcaccatcagcagactggancctgaanattttgctagtttattactgtctgcagcgtagcaactggcctaaacaccttcggaccaaagggacacgactgganattaaacgatgtgctgcacatctgtcttcactccttcccgaccattcgtgaagttgtagtgtacgtgacgcgggtctggcaagggccanatagncnannnnnnnnnnnnnnnnnnnnnnnnnnnnnn

SEQ ID NO: 238695 - DNA, 487 bp, Homo sapiens
  misc_feature: GYAE6OF02GPR40.33.60.F05.1.454.CMB.1.raw
  modified_base (240)..(240): a, c, t, g, unknown or other
  misc_feature (240)..(240): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
  modified_base (462)..(463): a, c, t, g, unknown or other
  misc_feature (462)..(463): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtgcaggtgggtctgggcagacttcattcctcaccatcagcagactggacncctgagattttgcagtgtattactgtcagcagtacggtgttcatctcgacgttcgccaagggccaaggtcggaaatccaaaacgactgtggctgcaccatctcgtcttcgactcttcccgcattctanacgtntcgtntacgtgacggcgggcttagggacaacggccgcgtaacgtgnactgactnacgtncgtnatngctagcgacgtntntcgngtcgnnagngtcgngtncgngntcgtntnc

SEQ ID NO: 238696 - DNA, 491 bp, Homo sapiens
  misc_feature: GYAE6OF02FHNZN.33.60.F05.1.454.CMB.1.raw
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
  modified_base (466)..(491): a, c, t, g, unknown or other
  misc_feature (466)..(491): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacagttcagtggcagtgggtctgggacagacttcattctcaccatcagcagactggacgcctgaagacttttgctagtgttattactgtcagcagtacggtagtttcatctccgaacgttccggcagggacccaaggtggaaatcaaacgatacgtgggcctgccgtacacgtctgtctttcacttctttccccggacctctaccttggaaaggttgttacgttcggttactcgtacggtcgggcgtgggtaccgagggccggagtactacgagctangacntcgnnnnnnnnnnnnnnnnnnnnnnnnnn

SEQ ID NO: 238697 - DNA, 545 bp, Homo sapiens
  misc_feature: GYAE6OF02GBWF1.33.60.F05.1.454.CMB.1.raw
  modified_base (153)..(153): a, c, t, g, unknown or other
  misc_feature (153)..(153): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
  modified_base (515)..(523): a, c, t, g, unknown or other
  misc_feature (515)..(523): n is a, c, g, or t
  modified_base (526)..(527): a, c, t, g, unknown or other
  misc_feature (526)..(527): n is a, c, g, or t
  modified_base (529)..(529): a, c, t, g, unknown or other
  misc_feature (529)..(529): n is a, c, g, or t
  modified_base (531)..(536): a, c, t, g, unknown or other
  misc_feature (531)..(536): n is a, c, g, or t
  modified_base (540)..(545): a, c, t, g, unknown or other
  misc_feature (540)..(545): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtncatccaccagggccatggcatcccagacaggttcagtggcagtgggtctgggacagacttcactctcaccatcagcagcctagagcctagaagtattttgctaagtttattactgtactgcagtcgtagcaacgtcgacctaactaccgtcggaccgaacgggtacacggtacgtcgggaagtaacttaaaacgaacgttggtacggctgaccacctaacgtcgttaggttccttacgtaactttcccgttaccccgactaaccttcgtacgtaagggttcgttggttacggttaacgtcggaacgggtcgggacgtcgggtaccgtaaacgggcgacgtacgttaggcacgtntangcgtnnnnnnnnngannantnnnnnngtgnnnnnn

SEQ ID NO: 238698 - DNA, 426 bp, Homo sapiens
  misc_feature: GYAE6OF02GAD50.33.60.F05.1.454.CMB.1.raw
  modified_base (210)..(210): a, c, t, g, unknown or other
  misc_feature (210)..(210): n is a, c, g, or t
  modified_base (350)..(350): a, c, t, g, unknown or other
  misc_feature (350)..(350): n is a, c, g, or t
  modified_base (403)..(403): a, c, t, g, unknown or other
  misc_feature (403)..(403): n is a, c, g, or t
  modified_base (405)..(406): a, c, t, g, unknown or other
  misc_feature (405)..(406): n is a, c, g, or t
  modified_base (409)..(426): a, c, t, g, unknown or other
  misc_feature (409)..(426): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatccccagacaggttcagtggcagtgggtctgggacngacttcattctcaccatcagcagactggagcctgaagattttgcagtgtattactgtcagcagtacggtagttcatctccgacgttcggccaagggaccaagggtgaaatcaaacgaactgtggctgcaccatctgtctnatcttcccgccatctgagtgtgtgtactgagcgggctggcgaaggcgcatagncnnagnnnnnnnnnnnnnnnnnn

SEQ ID NO: 238699 - DNA, 503 bp, Homo sapiens
  misc_feature: GYAE6OF02JEYIC.33.60.F05.1.454.CMB.1.raw
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (448)..(448): a, c, t, g, unknown or other
  misc_feature (448)..(448): n is a, c, g, or t
  modified_base (456)..(457): a, c, t, g, unknown or other
  misc_feature (456)..(457): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
  modified_base (501)..(502): a, c, t, g, unknown or other
  misc_feature (501)..(502): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcagtcccagacaggttcagtggcagtgggtctgggacagacttcattctcaccatcagcagactggagtcctgaagactttttgcagtgtattactgtcagacagtacggtagttcattctaccgacgttcggccaagggtaccaaggtgaaatcaaacgtactgtcggactgcaccatcgtgtcttcgactcttcccgctactctagaacgttgtcgtgtacttgacgcgggtctgggactaacgggcgtacgaacgtacgatnanctctcacgnagcatcanncncgcgngntgtacgtactctctcgcgtacgacncgngcgcncnnc

SEQ ID NO: 238700 - DNA, 491 bp, Homo sapiens
  misc_feature: GYAE6OF02FWENC.33.60.F05.1.454.CMB.1.raw
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (427)..(427): a, c, t, g, unknown or other
  misc_feature (427)..(427): n is a, c, g, or t
  modified_base (454)..(454): a, c, t, g, unknown or other
  misc_feature (454)..(454): n is a, c, g, or t
  modified_base (460)..(491): a, c, t, g, unknown or other
  misc_feature (460)..(491): n is a, c, g, or t
tcagtacacacactcacgaccggtgctcgatttagtacgtcatcagggaaagggccacccgtctcttggtagggccagtcagagtgttagcagcaactacttagcctggtaccagcagacacctggccaggctcccaggctcctcatccatggtgcatccaccagggccactggcatcccagacaggttcagtggcagtgggtctgggactagactttcactctcaccatcgcagactggancctgaagattttagnagtctatttatgttcagcagtataccgtggggacgtacggttcggaccaagggaccgaaggttggaaattacgaaaacggaactggtagtctgacgacctatctagttcttacgacttcttcccgacctatcctgtaaacgttgtagttcggtacttagggcgtccgggngtcgggacaagggtcgactaagtgatncgtgcnnnnnnnnnnnnnnnnnnnnnnnnnnnnnnnn

SEQ ID NO: 238701 - DNA, 555 bp, Homo sapiens
  misc_feature: GYAE6OF02FJ8GS.33.60.F05.1.454.CMB.1.raw
  modified_base (496)..(496): a, c, t, g, unknown or other
  misc_feature (496)..(496): n is a, c, g, or t
  modified_base (507)..(507): a, c, t, g, unknown or other
  misc_feature (507)..(507): n is a, c, g, or t
  modified_base (511)..(512): a, c, t, g, unknown or other
  misc_feature (511)..(512): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (522)..(522): a, c, t, g, unknown or other
  misc_feature (522)..(522): n is a, c, g, or t
  modified_base (531)..(532): a, c, t, g, unknown or other
  misc_feature (531)..(532): n is a, c, g, or t
  modified_base (539)..(539): a, c, t, g, unknown or other
  misc_feature (539)..(539): n is a, c, g, or t
  modified_base (548)..(548): a, c, t, g, unknown or other
  misc_feature (548)..(548): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtcggcagtgggtctgggacagactttcattctcaccatcagcagtacctggagcctgaagtattttgctagtgttattactgtacagacgtagtacggttagtcacgtctccgtacgttcgaccgaagggacctaaggtaggaaactacgaaaacgaacgttggtacggctagccacctaagttctggtacctttacacgttccccttacccgaccctagttccgtagtaacggttagttcggtacgtaccgtggaaccgggtcgggaccgtcgggacctaacgggccgtacgagtacgctgcgtnacgagtcaganacgnngcnananacncacacgagnnacgatcngcgcacacncgtcagc

SEQ ID NO: 238702 - DNA, 533 bp, Homo sapiens
  misc_feature: GYAE6OF02HKUEG.33.60.F05.1.454.CMB.1.raw
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (503)..(505): a, c, t, g, unknown or other
  misc_feature (503)..(505): n is a, c, g, or t
  modified_base (507)..(509): a, c, t, g, unknown or other
  misc_feature (507)..(509): n is a, c, g, or t
  modified_base (511)..(513): a, c, t, g, unknown or other
  misc_feature (511)..(513): n is a, c, g, or t
  modified_base (515)..(521): a, c, t, g, unknown or other
  misc_feature (515)..(521): n is a, c, g, or t
  modified_base (523)..(533): a, c, t, g, unknown or other
  misc_feature (523)..(533): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcacatcagcagactggacgcctagaagtattttgcagtgtattacgtgtacagcagtacggtagttacattcctccggtacggttaccggaccgaaagggaaccgaagggtaggaaaactacgaaaaccgtacgtaggtggactgactacctattcctggtcttactacgttcccttaccccgcgtactcgttagtaacggttgttcgttacgtacgtagggacgggtccgggacgtacgggtacaacggggccgtaacctaagttaggctntagtngantnnnannnannnannnnnnncnnnnnnnnnnn

SEQ ID NO: 238703 - DNA, 658 bp, Homo sapiens
  misc_feature: GYAE6OF02HMF3U.33.60.F05.1.454.CMB.1.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (588)..(588): a, c, t, g, unknown or other
  misc_feature (588)..(588): n is a, c, g, or t
  modified_base (593)..(593): a, c, t, g, unknown or other
  misc_feature (593)..(593): n is a, c, g, or t
  modified_base (600)..(600): a, c, t, g, unknown or other
  misc_feature (600)..(600): n is a, c, g, or t
  modified_base (608)..(608): a, c, t, g, unknown or other
  misc_feature (608)..(608): n is a, c, g, or t
  modified_base (617)..(617): a, c, t, g, unknown or other
  misc_feature (617)..(617): n is a, c, g, or t
  modified_base (631)..(631): a, c, t, g, unknown or other
  misc_feature (631)..(631): n is a, c, g, or t
  modified_base (635)..(635): a, c, t, g, unknown or other
  misc_feature (635)..(635): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
  modified_base (649)..(651): a, c, t, g, unknown or other
  misc_feature (649)..(651): n is a, c, g, or t
  modified_base (656)..(657): a, c, t, g, unknown or other
  misc_feature (656)..(657): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccaggccactggcactcccagaccaggttcagtcggactaggtcgggtctgggaccaggaccttntacgttccncaaccatcacgtccaggacgtggagtcacgaagtatttcggacctagtggttacttacctgtacagtccgaggtaacggttacgtctaacgtccgtaccggtaccgttacggtaccggaacggaccggtaaagggtacggtaaactaaccggaaaacgtacgtggtacggtctacggtccaacctaagttcccgtacgttctttaaccgtaccgtttacccgttcccgtaccgtaaccgttccgttacggtaaacggttcggtttacgtaccggtttaacggttaacgggtaaccgggttacggggtcgtaacggggttaccgaacgggtccgaccgggttataaaggtccgaancgtcnccgtaancgtcggtntaccgaggncgtaatgatcagcngtangacngncngtcgcnnnctacnnc

SEQ ID NO: 238704 - DNA, 455 bp, Homo sapiens
  misc_feature: GYAE6OF02GE7PM.33.60.F05.1.454.CMB.1.raw
  modified_base (240)..(240): a, c, t, g, unknown or other
  misc_feature (240)..(240): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
  modified_base (419)..(419): a, c, t, g, unknown or other
  misc_feature (419)..(419): n is a, c, g, or t
  modified_base (421)..(422): a, c, t, g, unknown or other
  misc_feature (421)..(422): n is a, c, g, or t
  modified_base (426)..(426): a, c, t, g, unknown or other
  misc_feature (426)..(426): n is a, c, g, or t
  modified_base (429)..(455): a, c, t, g, unknown or other
  misc_feature (429)..(455): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtggtctgggacagacttcattctcaccatcagcagactggacncctgaagattttgcagtgtattactgtcagtcagtacgtattcatctccgtcgttcgaccgagggaccaagggtacgaatcgaaacgactgngcngcacntctgtcttcncttcctccgctactctagagtntgtcgtacgtggacgcggtgtcggacgtaacggcgtaacagtcgatnanncgancgnnnnnnnnnnnnnnnnnnnnnnnnnnn

SEQ ID NO: 238705 - DNA, 589 bp, Homo sapiens
  misc_feature: GYAE6OF02F387T.33.60.F05.1.454.CMB.1.raw
  modified_base (153)..(153): a, c, t, g, unknown or other
  misc_feature (153)..(153): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
  modified_base (542)..(542): a, c, t, g, unknown or other
  misc_feature (542)..(542): n is a, c, g, or t
  modified_base (545)..(545): a, c, t, g, unknown or other
  misc_feature (545)..(545): n is a, c, g, or t
  modified_base (559)..(559): a, c, t, g, unknown or other
  misc_feature (559)..(559): n is a, c, g, or t
  modified_base (572)..(572): a, c, t, g, unknown or other
  misc_feature (572)..(572): n is a, c, g, or t
  modified_base (579)..(579): a, c, t, g, unknown or other
  misc_feature (579)..(579): n is a, c, g, or t
  modified_base (587)..(587): a, c, t, g, unknown or other
  misc_feature (587)..(587): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctccaggctcctcatccatggtancatccaccagggccactggcatcccagacaggttcagtggcagtgggtctggggacagacttcactctcaccatcagaccaacctagaacttgaacgtattttcaattttattactgttacaactactaccacggctacgtactggccctcctcaccgttttcgggaccgggaagggtacccgtaagggtcggagtcctacgaaaccgaacttggtcggctgcctaaccgtagtacctggttccttactaaccttccgttcccgtccctaagtccgtaggtaacgttcggtcgtacggtaccgtggacgggtccggtagtacgggaccgtaacggggccgtaccgtagttacgagtnagtacgtncgacgncgtgagtcgatgatcggngcngacgagtacgctangacgtacgacgtntcgagtntctacgtntc

SEQ ID NO: 238706 - DNA, 684 bp, Homo sapiens
  misc_feature: GYAE6OF02IFKCC.33.60.F05.1.454.CMB.1.raw
  modified_base (147)..(147): a, c, t, g, unknown or other
  misc_feature (147)..(147): n is a, c, g, or t
  modified_base (225)..(225): a, c, t, g, unknown or other
  misc_feature (225)..(225): n is a, c, g, or t
  modified_base (615)..(615): a, c, t, g, unknown or other
  misc_feature (615)..(615): n is a, c, g, or t
  modified_base (622)..(622): a, c, t, g, unknown or other
  misc_feature (622)..(622): n is a, c, g, or t
  modified_base (628)..(628): a, c, t, g, unknown or other
  misc_feature (628)..(628): n is a, c, g, or t
tcagtacacacactcacgaccggtgctcgatttagtacgtcatcagggaaaggggccgaccctctccttgtagggtccagtcagagtgttagacagcaactacttagcctggtaccagcagacacctggccaggctccaggctcctnataccatggtgacatccacgtaggccacgtggacatcccgagtacgaggttaccgaggttaggcctagtcgggttccngggtactaggtacttccgacttacctcgaacccagttaccgaactaggcctaggcgaccttaggtaacgtattttacggaacgtagttccgttaacttaacgtcggtacctagacgtacgtaacgttaacgtagggtaaccgtcgtttacgggaccgtaacggtaccgtaacgggaacggtaacgtaaccgtaaaaccggattacggtacgaacgttacgacgaaaccgtcgttacgtcgtacctacgtattacccgtacccggtactctaacgttcgtaacggttctcgttacgtacgtacggtagaccggtaggtacgtacgaacggtaccggtaacgtacgtagtagtaccgatacgcgtacgcgaacttgacgttagactgtaacngtacganagtacncgtaagcgatagtcggaatcgtaacagaccgactaggtaccacgtgtacgtgtaac

SEQ ID NO: 238707 - DNA, 586 bp, Homo sapiens
  misc_feature: GYAE6OF02HQ9BT.33.60.F05.1.454.CMB.1.raw
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (556)..(586): a, c, t, g, unknown or other
  misc_feature (556)..(586): n is a, c, g, or t
tcagtacacacactcacgaccggtgctcgatttagtacgtcatcagggaaagggccaccctctcctgcagggccagtcagagtgttagcgggtacctagcctggtaccaacagagacctggccaggctcccaggctcctcttctatgatgcatcccaacagggccactggcactccccagcccaggttcaggtggcggtgggtctggggacagtaccttcactctcaaccatcagccagccctaagacgccgtagaagtattttgccttaagttttattaccgtgtccgagcacggtacgtagcctaaccgttggtcgttggtaccgttccgggaccgaaggggaacccgtaagggttacggaaaacgtaccgtaaaaaccggtaacgtggttaggtccgttacgaccctaacctaacttccgttacggtttacctttacgaacccttttcccttaccccggacctaattcccgttaaggtaacggttcgttaggttaccgtacgtgggtacggtccggggacttacgggacgaacgggtcacggtanagncntannnnnnnnnnnnnnnnnnnnnnnnnnnnnnn

SEQ ID NO: 238708 - DNA, 473 bp, Homo sapiens
  misc_feature: GYAE6OF02GARRH.33.60.F05.1.454.CMB.1.raw
  modified_base (315)..(315): a, c, t, g, unknown or other
  misc_feature (315)..(315): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (443)..(445): a, c, t, g, unknown or other
  misc_feature (443)..(445): n is a, c, g, or t
  modified_base (447)..(470): a, c, t, g, unknown or other
  misc_feature (447)..(470): n is a, c, g, or t
  modified_base (472)..(472): a, c, t, g, unknown or other
  misc_feature (472)..(472): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggctgggacagacttcattctcaccatcagcagactggagcctgaagattttgctagtgtattactgtcagcagtacggtagttcatctccgacgttcgcgaaggaccaggtagaancaaacgactgtgctgcacatctgtcttctatcccgttacccgcctacgtctaagtacgttggtacgtgtaaccgtggacggccgggtcgtagggtaccgaagggccggtactagtagtcngntgntcnnncnnnnnnnnnnnnnnnnnnnnnnnngnc

SEQ ID NO: 238709 - DNA, 525 bp, Homo sapiens
  misc_feature: GYAE6OF02IS3Q5.33.60.F05.1.454.CMB.1.raw
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
  modified_base (462)..(462): a, c, t, g, unknown or other
  misc_feature (462)..(462): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (522)..(522): a, c, t, g, unknown or other
  misc_feature (522)..(522): n is a, c, g, or t
tcagtacacacactcacgaccggtgctcgatttagtacgtcatcagggaaagggccaccctctcttgtagggccagtcagagtgttagcagcaactacttagcctggtaccagcagaccacctggccaggctcccaggctcctcatccatggtgcatccaccagggccactggcatcccagacaggttcagtgcaggtgggtctgggacagacttcattctaccaccactcagccagacctggacgcctagaagtattttgctagttgtaattactgtcagctacgtacggttatctactccgtccgtacggtcggaccgaagggaccaaggtagaaatcaaaacgactgngctcgactaccatcgtntcttctactccgtcccgctatctagaagttcgtgtacgtcgtaggacggtccggtacgtcggtaccgaacgggtccgtacgaagtacgcgtacngactcgnatcggatnanacgngagcncgtgagcngngtntcncnacngntcngcgctctnacg

SEQ ID NO: 238710 - DNA, 485 bp, Homo sapiens
  misc_feature: GYAE6OF02JP5G4.33.60.F05.1.454.CMB.1.raw
  modified_base (265)..(265): a, c, t, g, unknown or other
  misc_feature (265)..(265): n is a, c, g, or t
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
  modified_base (381)..(381): a, c, t, g, unknown or other
  misc_feature (381)..(381): n is a, c, g, or t
  modified_base (458)..(458): a, c, t, g, unknown or other
  misc_feature (458)..(458): n is a, c, g, or t
  modified_base (460)..(485): a, c, t, g, unknown or other
  misc_feature (460)..(485): n is a, c, g, or t
tcagtacacacactcacgaccggtgctcgatttagtacgtcatcagggaaagggccaccctctcttgtagggccagtcagagtgttagcagcaactacttagcctggtaccagcagaaacctggccaggctcccaggcctcctcctctatggtgcatccaccagggccaactggcactcccagactagggttcaggtggctaggtgggtctggggacagtacttcattctcacctatcaagcagtacgtggacgccttgaaagtntttgctagtgtattacgngtacagtcagtgtagtntagtctacgcgttccgacaaggtacaagtgaaatcaacgatgngacgngcacacttncgttctcgaacttcctaccgtccngtttcgacttaacggttgttcggttgttacgtagtcgggcggtcggtggtacgacgggtcgactagtagctgactgntnnnnnnnnnnnnnnnnnnnnnnnnnn

SEQ ID NO: 238711 - DNA, 631 bp, Homo sapiens
  misc_feature: GYAE6OF02GRUQQ.33.60.F05.1.454.CMB.1.raw
  modified_base (153)..(153): a, c, t, g, unknown or other
  misc_feature (153)..(153): n is a, c, g, or t
  modified_base (246)..(246): a, c, t, g, unknown or other
  misc_feature (246)..(246): n is a, c, g, or t
  modified_base (549)..(549): a, c, t, g, unknown or other
  misc_feature (549)..(549): n is a, c, g, or t
  modified_base (569)..(569): a, c, t, g, unknown or other
  misc_feature (569)..(569): n is a, c, g, or t
  modified_base (590)..(590): a, c, t, g, unknown or other
  misc_feature (590)..(590): n is a, c, g, or t
  modified_base (593)..(593): a, c, t, g, unknown or other
  misc_feature (593)..(593): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (602)..(602): a, c, t, g, unknown or other
  misc_feature (602)..(602): n is a, c, g, or t
  modified_base (614)..(614): a, c, t, g, unknown or other
  misc_feature (614)..(614): n is a, c, g, or t
  modified_base (623)..(623): a, c, t, g, unknown or other
  misc_feature (623)..(623): n is a, c, g, or t
  modified_base (629)..(629): a, c, t, g, unknown or other
  misc_feature (629)..(629): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtncatccaccacgggccactggcatcccagacaggttcaggtgcaggttgggtcgtgggacagtacttcattctcaccactcagcagactggacnccgtagaagtattttgcttaagttttattacttgtcagcgagtacgtacgactacgttggtcgttacggtaccggttcggaccggaaacgggtaaccgaaagggttaacggaaactaaccgtaaaacggtaacgtggtacggtctcgacctactacgttcgttacgtccttactaccgtttccttcccgaccttacgttccttaaggttacggttcggttacggtttagtaaccgttagggacgggtccgggttcggtacggggtaaccgtaaggggcccgttaaggtaaccgtaccgggttntcgagtacgcgtgtacgtgngtacgtcgtcgtcgtcgcgancgngtngngacngagatagcgtancgaccgagngtctancg

SEQ ID NO: 238712 - DNA, 427 bp, Homo sapiens
  misc_feature: GYAE6OF02FKRKP.33.60.F05.1.454.CMB.1.raw
  modified_base (405)..(427): a, c, t, g, unknown or other
  misc_feature (405)..(427): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtctcatcttcccgcatctgaagtgtgtgtactgagtcgggctgggcaagggcgctagtagnnnnnnnnnnnnnnnnnnnnnnn

SEQ ID NO: 238713 - DNA, 230 bp, Homo sapiens
  misc_feature: GYAE6OF02HZQOA.33.60.F05.1.454.CMB.1.raw
  modified_base (199)..(199): a, c, t, g, unknown or other
  misc_feature (199)..(199): n is a, c, g, or t
  modified_base (207)..(230): a, c, t, g, unknown or other
  misc_feature (207)..(230): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcactcccaccagggcccataggaactcccagacaggttcagtggcngtgggtcnnnnnnnnnnnnnnnnnnnnnnnn

SEQ ID NO: 238714 - DNA, 659 bp, Homo sapiens
  misc_feature: GYAE6OF02IHMIO.33.60.F05.1.454.CMB.1.raw
  modified_base (153)..(153): a, c, t, g, unknown or other
  misc_feature (153)..(153): n is a, c, g, or t
  modified_base (219)..(219): a, c, t, g, unknown or other
  misc_feature (219)..(219): n is a, c, g, or t
  modified_base (615)..(615): a, c, t, g, unknown or other
  misc_feature (615)..(615): n is a, c, g, or t
  modified_base (628)..(628): a, c, t, g, unknown or other
  misc_feature (628)..(628): n is a, c, g, or t
  modified_base (630)..(630): a, c, t, g, unknown or other
  misc_feature (630)..(630): n is a, c, g, or t
  modified_base (632)..(659): a, c, t, g, unknown or other
  misc_feature (632)..(659): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtncactcccaacccgagggcccactggcactccccagacaggttcaggtgcaggtgggtcgtgggacngacttcattcctcaccataccagtaccgaagcgttggaacgtcctaggtaaatttgttttcgcgtaggttgttaattacgttggtacacggcgtaagggttacggttacgtttacgacgtttcccggtacccggtacggtttcccgggaaacccgaaaggggtaaccccgtaaaggggttaacggggaaaaactttaacccggaaaaacggttaaacgttacgggtccgggttcgttaaacgacccgtaaccgtaccgtttaccgttaccgttacccgtttactaacccggtttcccttaccccccgtaccgtttaactcgtttaacgggtaacgtttcggtcggtttacgtaccggttagggaccggtccggggtactcggggaagtacccgggntacggtataggangntnnnnnnnnnnnnnnnnnnnnnnnnnnnn

SEQ ID NO: 238715 - DNA, 666 bp, Homo sapiens
  misc_feature: GYAE6OF02I2YCF.33.60.F05.1.454.CMB.1.raw
  modified_base (624)..(624): a, c, t, g, unknown or other
  misc_feature (624)..(624): n is a, c, g, or t
  modified_base (627)..(627): a, c, t, g, unknown or other
  misc_feature (627)..(627): n is a, c, g, or t
  modified_base (629)..(631): a, c, t, g, unknown or other
  misc_feature (629)..(631): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (642)..(642): a, c, t, g, unknown or other
  misc_feature (642)..(642): n is a, c, g, or t
  modified_base (644)..(650): a, c, t, g, unknown or other
  misc_feature (644)..(650): n is a, c, g, or t
  modified_base (652)..(666): a, c, t, g, unknown or other
  misc_feature (652)..(666): n is a, c, g, or t
tcagtacacacactcacgaccggtgctcgatttagtacgtcatcagggaaagggccaccctctcttgtagggccagtcagagtgttagcagcaactacttagcctggccaggtgtctgctggtaccaggcctcccaggctcctcatccagtggtgcactcccaccacgggcccacgtcggcactcccgaagacgtacggttcaggtggcgtaggtgggttccgtagggactaggtaccttactactttccaccaccgtagtccgaacgcgtaacggccgttagggacgtccgtaaggtaagttacgttttcggcgtaaggttacgttacgtttaacgtcggttacgaacgtacgttaacgggttaaccggttattacccgtaacgtccccggttaccgtaacccgggttccggaaaccggtaacgggaacccgttaagggtaacgaaagttaaccgaaaacgtacggttgaccggtactacgacccgtaactacttacggtttctaacctttactaccgttccccgttaaccccgaactcgttacgtaggtaacgttgttcgtacggttagtcgggtaacggcgggttaccgagggtaccgacggttcgacgtaacgtgcgtanagngnnngngngngntgngnnnnnnngnnnnnnnnnnnnnnn

SEQ ID NO: 238716 - DNA, 495 bp, Homo sapiens
  misc_feature: GYAE6OF02HFALM.33.60.F05.1.454.CMB.1.raw
  modified_base (144)..(144): a, c, t, g, unknown or other
  misc_feature (144)..(144): n is a, c, g, or t
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (283)..(283): a, c, t, g, unknown or other
  misc_feature (283)..(283): n is a, c, g, or t
  modified_base (366)..(366): a, c, t, g, unknown or other
  misc_feature (366)..(366): n is a, c, g, or t
  modified_base (465)..(467): a, c, t, g, unknown or other
  misc_feature (465)..(467): n is a, c, g, or t
  modified_base (469)..(495): a, c, t, g, unknown or other
  misc_feature (469)..(495): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctccctnatccatggtgcatcccaccgagggccacgtggcactcccagacctggtcaggtcggctaggtgggtctgggacagtacttgacttcncacctatcagcagctggacncctgaagtatttcgcagttcgttattactgtnagcgtaggttacgtagtcatccgtacgcgttcggacgaaggacgtaaggtagaactacgaaacgacgtgtggactgaccactntctgttcttcacttccttcccgatactcgtagtacgttgtgttacgtagttcgggaacggtcggacgtaggacgaaggtccagaagtcagtcagtctannnannnnnnnnnnnnnnnnnnnnnnnnnnn

SEQ ID NO: 238717 - DNA, 519 bp, Homo sapiens
  misc_feature: GYAE6OF02H1QCU.33.60.F05.1.454.CMB.1.raw
  modified_base (276)..(276): a, c, t, g, unknown or other
  misc_feature (276)..(276): n is a, c, g, or t
  modified_base (372)..(372): a, c, t, g, unknown or other
  misc_feature (372)..(372): n is a, c, g, or t
  modified_base (478)..(478): a, c, t, g, unknown or other
  misc_feature (478)..(478): n is a, c, g, or t
  modified_base (484)..(484): a, c, t, g, unknown or other
  misc_feature (484)..(484): n is a, c, g, or t
  modified_base (486)..(488): a, c, t, g, unknown or other
  misc_feature (486)..(488): n is a, c, g, or t
  modified_base (490)..(491): a, c, t, g, unknown or other
  misc_feature (490)..(491): n is a, c, g, or t
  modified_base (493)..(493): a, c, t, g, unknown or other
  misc_feature (493)..(493): n is a, c, g, or t
  modified_base (495)..(519): a, c, t, g, unknown or other
  misc_feature (495)..(519): n is a, c, g, or t
tcagtacacacactcacgaccggtgctcgatttagtacgtcatcagggaaagggccgaccctctcttgtagggccagtcagagtgttagcagcaactacttagcctggtaccagcagacacctggccaggctcccaggctcctcatccatggtgcatcccaccagggccactggcatccccagacaggttcagtggcagtgggtctgggacagatcagttctcacatcagcagactggagcctagaaggtattttgctagttgtattactgtcagnaagtacgtagttcatctccgacgttcgaccaagggacctaaggtaggaaatcgaaaacgtaccgtaggtacggactcggactacccgtaatcgttnttacgtacctattccgttccccacgtattcgtacgtaagtcgttcggttacgtacgttacgacgggtcgggtcgtcggggacgtaaacgggcgactaaacggttgngtacgngnnngnntngnnnnnnnnnnnnnnnnnnnnnnnnn

SEQ ID NO: 238718 - DNA, 554 bp, Homo sapiens
  misc_feature: GYAE6OF02HKLDU.33.60.F05.1.454.CMB.1.raw
  modified_base (245)..(245): a, c, t, g, unknown or other
  misc_feature (245)..(245): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (523)..(523): a, c, t, g, unknown or other
  misc_feature (523)..(523): n is a, c, g, or t
  modified_base (525)..(526): a, c, t, g, unknown or other
  misc_feature (525)..(526): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (532)..(533): a, c, t, g, unknown or other
  misc_feature (532)..(533): n is a, c, g, or t
  modified_base (535)..(539): a, c, t, g, unknown or other
  misc_feature (535)..(539): n is a, c, g, or t
  modified_base (541)..(554): a, c, t, g, unknown or other
  misc_feature (541)..(554): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggtcagtggcaggtgggtctgggacagtacgttcattcctcaaccatcagcagactgggacncctagaagtattttgctagtttatacgtgtctgcagcgtagactacgcgcctaacgtcccgttcggacctaacgggactacgacgtagaacgtaagttaaaaccgacgtaggtcgacgtacgacgaacctacgtacgttacgtcctttactacttcccgttacccgaccttacgtcgtaacggtagtttcggttcgttacgggtacgtacgggcggtccggggtaccgtggaacccggtaagggccttacgaacggttagacgatcgangacngacgngnngngngnngnnnnngnnnnnnnnnnnnnn

SEQ ID NO: 238719 - DNA, 468 bp, Homo sapiens
  misc_feature: GYAE6OF02FU9LC.33.60.F05.1.454.CMB.1.raw
  modified_base (240)..(240): a, c, t, g, unknown or other
  misc_feature (240)..(240): n is a, c, g, or t
  modified_base (369)..(369): a, c, t, g, unknown or other
  misc_feature (369)..(369): n is a, c, g, or t
  modified_base (431)..(431): a, c, t, g, unknown or other
  misc_feature (431)..(431): n is a, c, g, or t
  modified_base (436)..(439): a, c, t, g, unknown or other
  misc_feature (436)..(439): n is a, c, g, or t
  modified_base (441)..(468): a, c, t, g, unknown or other
  misc_feature (441)..(468): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtgcagtgggtctgggacagacttcattcctcaccatcagcagactggacncctgaagattttgactagtgtattactgtcagtcaggtcggtagttcatctccgcgttccggccaagggaccgaaggtgaaatacgaaacgaatgtagctgcacctatctagtcttcgactccttcccncctatctagtaagtgttgtagtacgtgacggcgggtctcggacgaacgggcgagtaagtagntcgannnngnnnnnnnnnnnnnnnnnnnnnnnnnnnn

SEQ ID NO: 238720 - DNA, 665 bp, Homo sapiens
  misc_feature: GYAE6OF02FGOJO.33.60.F05.1.454.CMB.1.raw
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (575)..(575): a, c, t, g, unknown or other
  misc_feature (575)..(575): n is a, c, g, or t
  modified_base (600)..(600): a, c, t, g, unknown or other
  misc_feature (600)..(600): n is a, c, g, or t
  modified_base (623)..(623): a, c, t, g, unknown or other
  misc_feature (623)..(623): n is a, c, g, or t
tcagtacacacactcacgaccggtgctcgatttagtacgtcatcagggaagggccaccctctcttgtaggccagtcagagtgttagcagcaactacgtttacgcctggtaccagcaggacacctggccaggctcccaggctccgtcatccatggtgcatccacaggccactgcatcccagcaggttcagtgcagtggtctggacagacttcattctacaccagtcgacagactggacnccgtaggaactnttttacgactaggttcttatttaccgtggtaccaaggacctaggtaacttacggtagggggactacgttaccggaccgaaggtacctaagggttcgaaactcgtaaaaggtacgttcggaggtcgttacgactaccgtaagtctacgttccgtttacacgttcccgttcccacgttaagttcccgtaaggtaaggttcgtttacggtaacgttaccttcggaacgggtcgggtacggtacgggacccgtaagggtacccggtactaaacggtacgtagaacgtcgttagaccttaggacctagacgttacgattcggacttacgngtaccgattacgggatttacccggngtacgactacggtacgacgttanaccgtacgaccgtacgcgtacgtacgtacgacgtacgtaccg

SEQ ID NO: 238721 - DNA, 621 bp, Homo sapiens
  misc_feature: GYAE6OF02JCK0H.33.60.F05.1.454.CMB.1.raw
  modified_base (152)..(152): a, c, t, g, unknown or other
  misc_feature (152)..(152): n is a, c, g, or t
  modified_base (527)..(527): a, c, t, g, unknown or other
  misc_feature (527)..(527): n is a, c, g, or t
  modified_base (552)..(552): a, c, t, g, unknown or other
  misc_feature (552)..(552): n is a, c, g, or t
  modified_base (559)..(559): a, c, t, g, unknown or other
  misc_feature (559)..(559): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (619)..(619): a, c, t, g, unknown or other
  misc_feature (619)..(619): n is a, c, g, or t
tcagtacacacactcacgaccggtgctcgatttagtacgtcatcagggaagggccaccctctcttgtagggccagtcagagtgttagcagcaactacttagcctggtaccagcagacacctggccaggctcccaggctcctcatccatggtncactcccaccgagggccactggacactcccagacctaggttcagtggcgaggtgggtcgtaggacagtacttcacttacacaccatcagcagacgtgacgacctagaagttattttgacctagttagttaacttacgtagtcacgtacgagttacggttagttcctacgttccgtccggtaccggttccggaaccgtaacgggtaacccgtaagggttacgaaacgtaccgtaaaacgtcgtacggtacggtcctacggaccgtacctagttaccttagtccgtttacacgtttacccgtccgtacctacgtcgtagtagtcgttagttacgtacgtcggacggttccgggtagaccgggtacgaaggtccgtanaacgttgagacgcctgtaccatcgngtaacgntatacgtatgtgtacgngtnacnagagtagtagtacgacgatagtagtactagtcgtcgnag

SEQ ID NO: 238722 - DNA, 456 bp, Homo sapiens
  misc_feature: GYAE6OF02GCI5N.33.60.F05.1.454.CMB.1.raw
  modified_base (209)..(209): a, c, t, g, unknown or other
  misc_feature (209)..(209): n is a, c, g, or t
  modified_base (426)..(456): a, c, t, g, unknown or other
  misc_feature (426)..(456): n is a, c, g, or t
tcagtacacacactcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtggtctgggacngacttcattctcaccatcagcagactgagcctgagattttgcagtgtattactgtcagcagtaggtagttcatctccgacgttcggcctaagggaccaaggtggaaatcaaacgaactgtggctgcaaccattctgttcttcattcctcccgacattcagtagttgtagtgtacgtggacggtcgggtgtcggacgtaacggcgtacaagtagcgannnnnnnnnnnnnnnnnnnnnnnnnnnnnnn

SEQ ID NO: 238723 - DNA, 645 bp, Homo sapiens
  misc_feature: GYAE6OF02HFZ5N.33.60.F05.1.454.CMB.1.raw
  modified_base (231)..(231): a, c, t, g, unknown or other
  misc_feature (231)..(231): n is a, c, g, or t
  modified_base (260)..(260): a, c, t, g, unknown or other
  misc_feature (260)..(260): n is a, c, g, or t
  modified_base (589)..(589): a, c, t, g, unknown or other
  misc_feature (589)..(589): n is a, c, g, or t
  modified_base (593)..(593): a, c, t, g, unknown or other
  misc_feature (593)..(593): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (606)..(606): a, c, t, g, unknown or other
  misc_feature (606)..(606): n is a, c, g, or t
  modified_base (609)..(610): a, c, t, g, unknown or other
  misc_feature (609)..(610): n is a, c, g, or t
  modified_base (612)..(612): a, c, t, g, unknown or other
  misc_feature (612)..(612): n is a, c, g, or t
  modified_base (619)..(619): a, c, t, g, unknown or other
  misc_feature (619)..(619): n is a, c, g, or t
  modified_base (621)..(622): a, c, t, g, unknown or other
  misc_feature (621)..(622): n is a, c, g, or t
  modified_base (625)..(625): a, c, t, g, unknown or other
  misc_feature (625)..(625): n is a, c, g, or t
  modified_base (630)..(631): a, c, t, g, unknown or other
  misc_feature (630)..(631): n is a, c, g, or t
  modified_base (633)..(633): a, c, t, g, unknown or other
  misc_feature (633)..(633): n is a, c, g, or t
  modified_base (635)..(636): a, c, t, g, unknown or other
  misc_feature (635)..(636): n is a, c, g, or t
  modified_base (638)..(638): a, c, t, g, unknown or other
  misc_feature (638)..(638): n is a, c, g, or t
  modified_base (641)..(641): a, c, t, g, unknown or other
  misc_feature (641)..(641): n is a, c, g, or t
  modified_base (643)..(644): a, c, t, g, unknown or other
  misc_feature (643)..(644): n is a, c, g, or t
tcagtacacacactcacgaccggtgctcgatttagtacgtcatcagggaaagggccaaccctctcttgtagggccagtcagagtgttagcagcaactacttagcctggtaccagcagacacctggccaggctcccaggctcctcatccatggtgcactccaccagggccactcggcatcccgagacgaggttcagtggcaggtgggtctgggacagtacttcattctcacntacacgcagactggacgtcctagaagttntttgcgtagttcgttattacgtgtactaggccgtaggttaacgggttacgttcgtacgttccgttaccgggtacccggtttcgggaacccggtaacgggtaaccgtaaagggttaacggaaaacgttaccgaaaaccggtacgttggtacggtacgtcggtacctaaccgtagttctttacggttacctttcgtacgtttcccccgtacccgtaacccgtacgttccgtaacggtaacgtttcggtacggttacgtaacggttgggaacggggtccggtcggtaccgggtacgggaaccgggtccgtaacgtagttacgcgtaagtcgntcgnaccgggtngngtnagnngngctgtgngnngtnctgtnngngnngngtngnng

SEQ ID NO: 238724 - DNA, 682 bp, Homo sapiens
  misc_feature: GYAE6OF02FRC4I.33.60.F05.1.454.CMB.1.raw
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
  modified_base (579)..(579): a, c, t, g, unknown or other
  misc_feature (579)..(579): n is a, c, g, or t
  modified_base (593)..(593): a, c, t, g, unknown or other
  misc_feature (593)..(593): n is a, c, g, or t
  modified_base (606)..(606): a, c, t, g, unknown or other
  misc_feature (606)..(606): n is a, c, g, or t
  modified_base (629)..(629): a, c, t, g, unknown or other
  misc_feature (629)..(629): n is a, c, g, or t
  modified_base (640)..(640): a, c, t, g, unknown or other
  misc_feature (640)..(640): n is a, c, g, or t
  modified_base (642)..(642): a, c, t, g, unknown or other
  misc_feature (642)..(642): n is a, c, g, or t
  modified_base (655)..(655): a, c, t, g, unknown or other
  misc_feature (655)..(655): n is a, c, g, or t
  modified_base (677)..(677): a, c, t, g, unknown or other
  misc_feature (677)..(677): n is a, c, g, or t
  modified_base (679)..(679): a, c, t, g, unknown or other
  misc_feature (679)..(679): n is a, c, g, or t
tcagtacacacactcacgaccggtgctcgatttagtacgtcatcagggaaggggctggagtgggtcgcaactattagtggcggtggaactcatacatactacgccgactccgtgaaggccgcttcaccatctccagagacaattccaacaacacggtgtttctgacaaatgaatagcctgagagtcgagacatggccatatattactgtncgagagttagcagtggctggtacttctttcttccagcacgtggggcacggtaccctggtcnccgtctcctcacgcctccaccgaacgggccctacgtccggttcccttcccccgtcggccctacccctaccgtacccaaacggacgcccgtaacccgttccgggttacggggggaccaaccggaccggtcccgggtccccggttcggggtacccttcggccccgtttacggggttaaccgaaacgggttaccgtttaaccgtttcccggtaaggttcggtttacggtttacggttaccgtgggtaaccggggtccggggtcggttacggggtaccggtaaaaccgggccggtaacctaaaggttacggnaacgttcgtcggcncgtacgtctctcngtacgtcgtcgtacgacgtcgtngtacgacgcgngngcgcgtcgtagtntacgagcgacgtcgtcgtacgngnacg

SEQ ID NO: 238725 - DNA, 597 bp, Homo sapiens
  misc_feature: GYAE6OF02GGPRT.33.60.F05.1.454.CMB.1.raw
  modified_base (511)..(511): a, c, t, g, unknown or other
  misc_feature (511)..(511): n is a, c, g, or t
  modified_base (535)..(535): a, c, t, g, unknown or other
  misc_feature (535)..(535): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
  modified_base (549)..(549): a, c, t, g, unknown or other
  misc_feature (549)..(549): n is a, c, g, or t
  modified_base (554)..(554): a, c, t, g, unknown or other
  misc_feature (554)..(554): n is a, c, g, or t
  modified_base (566)..(568): a, c, t, g, unknown or other
  misc_feature (566)..(568): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
  modified_base (578)..(579): a, c, t, g, unknown or other
  misc_feature (578)..(579): n is a, c, g, or t
  modified_base (586)..(586): a, c, t, g, unknown or other
  misc_feature (586)..(586): n is a, c, g, or t
  modified_base (592)..(592): a, c, t, g, unknown or other
  misc_feature (592)..(592): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggacatcccagacaggttcagtgcagtgggtctgggacagacttcgattctacaccatcagcagactggactcctagaagtagttttcgctagttgtaatttactcgtcacgacgtaggtttaccggttagttaccagttaccgtccggtaaccggtttaccggaacccggtaaacgggaaccgtaagggtaggtaaaacgtacgaaaaccggtaacgtcggtaaggccgttacggacctaaccacgttacttacgttcttaccgtacttccttcccgacgtacttacgtagtaagtcgtaggtacgttactggaacggcggtacgtacggtacgaacggngtaaccgtaagtacggatcgaacncgtanagtnacgancgagnctatcgactagnnnagncncgacnngcgagtnacacgntagac

SEQ ID NO: 238726 - DNA, 506 bp, Homo sapiens
  misc_feature: GYAE6OF02FQCN7.33.60.F05.1.454.CMB.1.raw
  modified_base (472)..(472): a, c, t, g, unknown or other
  misc_feature (472)..(472): n is a, c, g, or t
  modified_base (474)..(506): a, c, t, g, unknown or other
  misc_feature (474)..(506): n is a, c, g, or t
tcagtacacacactcacgaccggtgctcgatttagtacgtcatcagggaaagggccaccctctcttgtagggccagtcagagtgttagcagcggcttcttagcctggtaccagcagaaacctggccaggctcccaggctcctcctctatggtgcatcccaccagggccactggcatcccagacaggttcagtggcaggtgggtctgggacagacttcaccttctcaccatcgacagactggagcctgaacgtattttgcaggttcttattactgtcagactagtatacgtgggggacgtacggttcggaccaaacggggaccaagggtggaaactacgaaaacgatggtggctaggcacgactcgtctacttctacttcttccccgactactcgtaagtagttggttagttctaacgttgggacggtcgggtcctagggtacgaaacggggtccgaacgtacgtaagcgagngnnnnnnnnnnnnnnnnnnnnnnnnnnnnnnnnn

SEQ ID NO: 238727 - DNA, 649 bp, Homo sapiens
  misc_feature: GYAE6OF02GFKO5.33.60.F05.1.454.CMB.1.raw
  modified_base (586)..(586): a, c, t, g, unknown or other
  misc_feature (586)..(586): n is a, c, g, or t
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
  modified_base (599)..(599): a, c, t, g, unknown or other
  misc_feature (599)..(599): n is a, c, g, or t
  modified_base (609)..(609): a, c, t, g, unknown or other
  misc_feature (609)..(609): n is a, c, g, or t
  modified_base (612)..(612): a, c, t, g, unknown or other
  misc_feature (612)..(612): n is a, c, g, or t
  modified_base (616)..(616): a, c, t, g, unknown or other
  misc_feature (616)..(616): n is a, c, g, or t
  modified_base (620)..(620): a, c, t, g, unknown or other
  misc_feature (620)..(620): n is a, c, g, or t
  modified_base (624)..(624): a, c, t, g, unknown or other
  misc_feature (624)..(624): n is a, c, g, or t
  modified_base (627)..(627): a, c, t, g, unknown or other
  misc_feature (627)..(627): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (640)..(641): a, c, t, g, unknown or other
  misc_feature (640)..(641): n is a, c, g, or t
  modified_base (648)..(649): a, c, t, g, unknown or other
  misc_feature (648)..(649): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccgaggccactggcatcccagacaggttcagtggcagtgggtcgtgggacagacttcactcctcaccatccagaccaacctagtaacttggaagttactttttactactttttaattacgtcgtaacaactactaccgacggcagtctcggccttctctaccgtttcgggacggtaacggaccgagggtcggactcgtaaccgaaacgtaacgttggtacggtctacgaccctacctagttcccgtttagttaccctttacctaccgtttaccccgttcccccggtaaccttaccttacggttaacgggtaaggtttcgtttaggtttaccgttaaccggttaggggtacccgggtaccggggttacggttaacggggaccggaaacggggttcccgaacggtaacgttaacgggatcgtacaacgntacgacnanacanatcgtactangtnatanactntagnganagtagngngtcgnngcatatnn

SEQ ID NO: 238728 - DNA, 628 bp, Homo sapiens
  misc_feature: GYAE6OF02HRNVE.33.60.F05.1.454.CMB.1.raw
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (564)..(564): a, c, t, g, unknown or other
  misc_feature (564)..(564): n is a, c, g, or t
  modified_base (570)..(570): a, c, t, g, unknown or other
  misc_feature (570)..(570): n is a, c, g, or t
  modified_base (583)..(583): a, c, t, g, unknown or other
  misc_feature (583)..(583): n is a, c, g, or t
  modified_base (590)..(590): a, c, t, g, unknown or other
  misc_feature (590)..(590): n is a, c, g, or t
  modified_base (610)..(610): a, c, t, g, unknown or other
  misc_feature (610)..(610): n is a, c, g, or t
  modified_base (613)..(613): a, c, t, g, unknown or other
  misc_feature (613)..(613): n is a, c, g, or t
  modified_base (626)..(626): a, c, t, g, unknown or other
  misc_feature (626)..(626): n is a, c, g, or t
tcagtacacacactcacgaccggtgctcgatttagtacgtcatcaggggaagggccaccctctcttgtagggccagtcagagtgttagcagcaaactaacttagcctggtaccagcagtacacctggccaggctccaggctcctcatccagtggtgcactccacgagggcccacgtggcactcccgagacaggttcaggtcggccaggtgggtcgtacgggacngtactcactctcactntaccgacacgacgtagacgtcgtaggaggttagtttcgcgacttacttagttactgtcagacgtacgtactaggtgggaacgtcggttaccggaccgtaaacgggtactaaggggtcgtaaaactaccgtaaaacgtagtagggtaccgtcggtacgaccaacgtactacgttcggtaaccttgtaccgttacccgttaccctaccgtacttcggtaacgtaggtttcgtaacggttcgtacgtacgggtacgggtaccggcggttaccggtacggtacggtccgtaagacgttagcgtaacgtgtatacgcacgtcgtaacgngtacgngacgactgtctgntctctcncgtctcgcgacgcgcgtcgngcncgccgcgacgtcngc

SEQ ID NO: 238729 - DNA, 608 bp, Homo sapiens
  misc_feature: GYAE6OF02IHKXM.33.60.F05.1.454.CMB.1.raw
  modified_base (153)..(153): a, c, t, g, unknown or other
  misc_feature (153)..(153): n is a, c, g, or t
  modified_base (533)..(533): a, c, t, g, unknown or other
  misc_feature (533)..(533): n is a, c, g, or t
  modified_base (550)..(550): a, c, t, g, unknown or other
  misc_feature (550)..(550): n is a, c, g, or t
  modified_base (557)..(557): a, c, t, g, unknown or other
  misc_feature (557)..(557): n is a, c, g, or t
  modified_base (562)..(562): a, c, t, g, unknown or other
  misc_feature (562)..(562): n is a, c, g, or t
  modified_base (578)..(578): a, c, t, g, unknown or other
  misc_feature (578)..(578): n is a, c, g, or t
  modified_base (606)..(606): a, c, t, g, unknown or other
  misc_feature (606)..(606): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtncatccaccagggccactggcatcccagacaggttcagtggcagtgggtctgggacagacttcattctccacctatcagcagacgtggacgcctggaagtattttgctagttttatactgtctgcgtagtcgtagcaacgtcggacctaaaccgtaccgttccgggaccgtaaacgggaccaaccggtacgtggaacgtaaacttaaaacggaacgttggtcggaccgttgaccgaccctaagtccgttacgttccttacgtacttccctttcccgcctaacttcgtaggtaaggttcggttaagtccggttacgtacggtcgggtcgggaccggtacggtaccggaaacggggccgtaacgtaaggttaaggctgtacgngtgactagcgagtgagngtcgacntagancatacgtacgtactcncgtgtctagtacgtcgtacgtactcgtncg

SEQ ID NO: 238730 - DNA, 587 bp, Homo sapiens
  misc_feature: GYAE6OF02HAE94.33.60.F05.1.454.CMB.1.raw
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (515)..(515): a, c, t, g, unknown or other
  misc_feature (515)..(515): n is a, c, g, or t
  modified_base (520)..(520): a, c, t, g, unknown or other
  misc_feature (520)..(520): n is a, c, g, or t
  modified_base (527)..(527): a, c, t, g, unknown or other
  misc_feature (527)..(527): n is a, c, g, or t
  modified_base (531)..(531): a, c, t, g, unknown or other
  misc_feature (531)..(531): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
  modified_base (550)..(550): a, c, t, g, unknown or other
  misc_feature (550)..(550): n is a, c, g, or t
  modified_base (559)..(560): a, c, t, g, unknown or other
  misc_feature (559)..(560): n is a, c, g, or t
  modified_base (572)..(572): a, c, t, g, unknown or other
  misc_feature (572)..(572): n is a, c, g, or t
  modified_base (580)..(580): a, c, t, g, unknown or other
  misc_feature (580)..(580): n is a, c, g, or t
  modified_base (586)..(586): a, c, t, g, unknown or other
  misc_feature (586)..(586): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcactccaccgagggccactggcatcccagacaggttcagtgcaggtgggtctgggacagacttcattctcacatcagctagacgtgggactccgtagaagttacttttggactaggttagttacttacgtggtacaggtctaaggttacggttctacactcctccggtacgttccggacgaaaacggccgtaaagggtacggtaaaatacgtaaaaccggtaagttcgggtagccgttacgactacccaagttccgtttntcccgtttanaccgtttacccgttcccgaactattcgtagtaacgtttgtacgtctaacgtcggaggccgggtgtacgccggaaaggcttaacgagttacgntcgancgtactnacgngatgagngncgngacncgnagtgtcgtnntacgcgtcgagngtcgcgcngtcgtnc

SEQ ID NO: 238731 - DNA, 625 bp, Homo sapiens
  misc_feature: GYAE6OF02GROJT.33.60.F05.1.454.CMB.1.raw
  modified_base (213)..(213): a, c, t, g, unknown or other
  misc_feature (213)..(213): n is a, c, g, or t
  modified_base (555)..(555): a, c, t, g, unknown or other
  misc_feature (555)..(555): n is a, c, g, or t
  modified_base (562)..(562): a, c, t, g, unknown or other
  misc_feature (562)..(562): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (583)..(584): a, c, t, g, unknown or other
  misc_feature (583)..(584): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (593)..(594): a, c, t, g, unknown or other
  misc_feature (593)..(594): n is a, c, g, or t
  modified_base (596)..(596): a, c, t, g, unknown or other
  misc_feature (596)..(596): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (608)..(609): a, c, t, g, unknown or other
  misc_feature (608)..(609): n is a, c, g, or t
  modified_base (612)..(612): a, c, t, g, unknown or other
  misc_feature (612)..(612): n is a, c, g, or t
  modified_base (616)..(616): a, c, t, g, unknown or other
  misc_feature (616)..(616): n is a, c, g, or t
  modified_base (619)..(619): a, c, t, g, unknown or other
  misc_feature (619)..(619): n is a, c, g, or t
tcagtacacacactcacgaccggtgctcgatttagtacgtcatcagggaaggggctggagtgggtcgcaactattagtggcggtggaactcatacatactacgccgactccgtgaagggccgcttcaccatctccagagacaattccaaacaacacggtgtttctgcaaatgaatagcctgagtgtcgaggacatggccatatattactgtgngagtagttagcaggttcggcgttggtacttccttttcttccaagccacgtcgggggaccgacgggtaccctacggggtcctacccggttctcccgtcgacgccctcccaaccgaacgggtccctagtccggttacccgtttcccccgtacggcccgtccctcgtcccttaccggacggaccgaccgtaccctaccggacgaccgcgacggaaccggccggtcccggttcgggccttcggccgttagggtacgaaacggttactaccgttcgtaggtttcggttggttcgtaacgtggaacgggtccgggtacgtcgggacgtaacggggacctaccggtaanacggtgntcgacgtcagngngngncncnngtgcngncnngntcgtncncgtgnnganagcnganctgacg

SEQ ID NO: 238732 - DNA, 673 bp, Homo sapiens
  misc_feature: GYAE6OF02HFMNX.33.60.F05.1.454.CMB.1.raw
  modified_base (610)..(610): a, c, t, g, unknown or other
  misc_feature (610)..(610): n is a, c, g, or t
  modified_base (622)..(622): a, c, t, g, unknown or other
  misc_feature (622)..(622): n is a, c, g, or t
  modified_base (655)..(655): a, c, t, g, unknown or other
  misc_feature (655)..(655): n is a, c, g, or t
  modified_base (661)..(661): a, c, t, g, unknown or other
  misc_feature (661)..(661): n is a, c, g, or t
tcagtacacacactcacgaccggtgctcgatttagtacgtcatcagggaaagggccaccctctcttgtacggccagtcagagtgttagcagcaactacttagcctggtaccagcagacacctgccaggctccgaggctcctcatccgtatggtgctactccaccgagggcccacgtggcctacgtccccagacgtaggttcgaggtggcgaggttgggtaccgtcgggacgtacgtacttcgacttccgtaccacctgtaccaggccgaagacgtggactccgtagtaacgtgtttcgacgtagttactacttcgtcgtacgagtacgtaaggttacgggtacgttcctacgttccgtacccggtaccggttccggaaccgtaaacgggtaaccgtaagggttagaaactaaccgggtaaacgtaacgttcggtacgtacgtaccgtaccgtaaccgtcgttcgttaccgttcgttaccgtacgtcccgttacccgtcgtaaacgttccgtaacggtacgttcgttacggtacgtaccgtacgggaccggtacggtaccgtacggaccgtaacggcctacgttaacgcgtacgactcgatcgagtcgacngtaccgcgtacngttgactgcgagctagctacgtgaattgacgtncgagtncgtcgcgacgcg

SEQ ID NO: 238733 - DNA, 567 bp, Homo sapiens
  misc_feature: GYAE6OF02HOL3E.33.60.F05.1.454.CMB.1.raw
  modified_base (275)..(275): a, c, t, g, unknown or other
  misc_feature (275)..(275): n is a, c, g, or t
  modified_base (502)..(502): a, c, t, g, unknown or other
  misc_feature (502)..(502): n is a, c, g, or t
  modified_base (531)..(534): a, c, t, g, unknown or other
  misc_feature (531)..(534): n is a, c, g, or t
  modified_base (537)..(537): a, c, t, g, unknown or other
  misc_feature (537)..(537): n is a, c, g, or t
  modified_base (539)..(544): a, c, t, g, unknown or other
  misc_feature (539)..(544): n is a, c, g, or t
  modified_base (546)..(557): a, c, t, g, unknown or other
  misc_feature (546)..(557): n is a, c, g, or t
  modified_base (559)..(566): a, c, t, g, unknown or other
  misc_feature (559)..(566): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggcccagtggcatcccagacaggttcaggtggcaggtgggtcgtagggacagtacttacattcctcaccctatacagcaagactaggacgtcctagaagtatttgcgtagtntaacttactagtctacgtactaggttaacggtacgttctagtaccgtccggtaacggttccggaccggaaacgggtaacccgtaaagggtaacggtaaaactaaccgtaaaaacgtaacgttaggtacggcgtacggacctaaccgagttacctttcgtacctttccaacgttccttacccctccgacttacgtagtaacgtgttacgtgtaactgggacgcgggtntaggacggaacggtcgactaacgtagacnnnnacnannnnnnannnnnnnnnnnnannnnnnnng

SEQ ID NO: 238734 - DNA, 618 bp, Homo sapiens
  misc_feature: GYAE6OF02IUHMS.33.60.F05.1.454.CMB.1.raw
  modified_base (542)..(542): a, c, t, g, unknown or other
  misc_feature (542)..(542): n is a, c, g, or t
  modified_base (590)..(597): a, c, t, g, unknown or other
  misc_feature (590)..(597): n is a, c, g, or t
  modified_base (599)..(607): a, c, t, g, unknown or other
  misc_feature (599)..(607): n is a, c, g, or t
  modified_base (609)..(615): a, c, t, g, unknown or other
  misc_feature (609)..(615): n is a, c, g, or t
  modified_base (617)..(618): a, c, t, g, unknown or other
  misc_feature (617)..(618): n is a, c, g, or t
tcagtacacacactcacgaccggtgctcgatttagtacgtcatcagggaaagggccacccctctcttgtagggccagtcagagtgttagcagcaactacttagccctggtaccagcagacacctggccaggctcccaggctcctcatccatggtgcatccaccacgggccactggcatccccagacgtggttcagtgcgaggtgggtctggggacagtacttcattcctccacctatcagccaagtacgtgggactccgtacggtaagtattttggaccgtaaggttgtttaattaccttggttacaccggacgttaggtaacgggttagttactaacttccggttacccgtaccggtttaaccgggcccggtaaaacgggaacggtaaacggggttaacggaaaacttaacggaaaaacggtaaaccgttggtagggactcggacctaaaccgtacgttcgtttacgtccttacgtacctttacccgttcccggacttactcgttaaggacttagggtgttaggtaccgaggttaccgggnggtccgtaggccggaacgggtaccctataacggtgtacatgactgctnnnnnnnngnnnnnnnnnannnnnnngnn

SEQ ID NO: 238735 - DNA, 190 bp, Homo sapiens
  misc_feature: GYAE6OF02IT5A0.33.60.F05.1.454.CMB.1.raw
  modified_base (169)..(190): a, c, t, g, unknown or other
  misc_feature (169)..(190): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctccaggctcctcatccatggtgcatccacaggccacgtnnnnnnnnnnnnnnnnnnnnnn

SEQ ID NO: 238736 - DNA, 704 bp, Homo sapiens
  misc_feature: GYAE6OF02JJYGS.33.60.F05.1.454.CMB.1.raw
  modified_base (114)..(114): a, c, t, g, unknown or other
  misc_feature (114)..(114): n is a, c, g, or t
  modified_base (615)..(615): a, c, t, g, unknown or other
  misc_feature (615)..(615): n is a, c, g, or t
  modified_base (629)..(629): a, c, t, g, unknown or other
  misc_feature (629)..(629): n is a, c, g, or t
  modified_base (633)..(633): a, c, t, g, unknown or other
  misc_feature (633)..(633): n is a, c, g, or t
  modified_base (645)..(645): a, c, t, g, unknown or other
  misc_feature (645)..(645): n is a, c, g, or t
  modified_base (696)..(696): a, c, t, g, unknown or other
  misc_feature (696)..(696): n is a, c, g, or t
tcagtacacacactcacgaccggtgctcgatttagtacgtcatcagggaaagggccaccctctcttgtagggccagtcagagtgttagcagcaactacttagcctggtaccagnagacacctggccaggcctcccaggctcctcatccagtggtcgcactcccaccgacgggccactcgggcactcccgaagactacgggttcagtcgacgtaggttcgggtcgtcgggaactagtaaccttcgtactttcctaaccgaaccacttcgaacgtcgtaacggtacccgtaggaacgtcccggttaagaacggtttaacgttttccggacgttaacggttacgttaactttaaccgtcggttacgaaccggtacgtacggtttacggtaacgttcctacgttccgtccggtacggtccggtaacggacggtacgtaaggtaacgtaacgaacgtaaacgtaaggtcggtacggctaccgcctaactccgttacgtacgtttccgtactaccgttcccgtaccgtactaccgttcgagttacggtcgttacgttacgtacggtacggtccgggtacggtacgtccggaacggtacggactacgtaaggtccgtcgtcngtcagtctgtacgntcgngtacgactgacncgcgctacactacgtcgtacgtagtcgtacgtagtcgtacgtgtctacgtntacgtacg

SEQ ID NO: 238737 - DNA, 664 bp, Homo sapiens
  misc_feature: GYAE6OF02GOXSE.33.60.F05.1.454.CMB.1.raw
  modified_base (632)..(632): a, c, t, g, unknown or other
  misc_feature (632)..(632): n is a, c, g, or t
  modified_base (636)..(664): a, c, t, g, unknown or other
  misc_feature (636)..(664): n is a, c, g, or t
tcagtacacacactcacgaccggtgctcgatttagtacgtcatcagggaaagggccaccctctcttgtagggccagtcagagtgttagcagcaaactacttagcctggtaccagcagacacctggccaggcctcccgaggctcctcatccagtggtgcatcccaccgacggggccacgtgggccactcccgaagacgtagggtttcaggtggaccgtaggttggggcgttacggggacagtaccttactactttctaccaccactccagaccgaacgcggtagggccgaccgtaggtaattagttttcgcgttagttagtttaacgttacgttgtagtacgcgtacggttacggttgttacgacttccggtacccggttacggtcccgggaccgtaaacggggacccggtaaacgggtaagtaaaccgtaaacgaaaaccggtagttacgggtacggaccgttaccgaaccgtaccgttagttcccgtttatttaaccgttccttacccggtttacccttcccggtacccttacgtacgtttaggttaacggttgggttcgttacggtacgtagggtaccggggttcgggtacggtacgggtacggtacgggtacgtacgtaatagcgtcgnctgnnnnnnnnnnnnnnnnnnnnnnnnnnnnn

SEQ ID NO: 238738 - DNA, 817 bp, Homo sapiens
  misc_feature: GYAE6OF02GGFMN.33.60.F05.1.454.CMB.1.raw
  modified_base (720)..(720): a, c, t, g, unknown or other
  misc_feature (720)..(720): n is a, c, g, or t
  modified_base (726)..(726): a, c, t, g, unknown or other
  misc_feature (726)..(726): n is a, c, g, or t
  modified_base (732)..(732): a, c, t, g, unknown or other
  misc_feature (732)..(732): n is a, c, g, or t
  modified_base (739)..(739): a, c, t, g, unknown or other
  misc_feature (739)..(739): n is a, c, g, or t
  modified_base (759)..(759): a, c, t, g, unknown or other
  misc_feature (759)..(759): n is a, c, g, or t
tcagtacacacactcacgaccggtgctcgatttagtacgtcatcagggaaaggggccaccctctacttgtagggccagtcagacgtgttagcagtcaactacttagcctggtaccagcagacacctggccaggctcccaggctcctcatccatggtcgacacgtccaccgtacgggtccgacgtcgggcacgtcccgaagactacgggtttacaggtggacaggtcggtcgtagggactagtaccttacgtacttcctacaaccgtattaccaagtaccgtaagtaccgttagggaaccgaccgttaaggtaaacggttaacgttttacgaccgttaacggttaacgtttacgtttaacttccgggtaactaacgggtaccgtaaggttaaccgggttaacggttaccgacggttttaccggtaccccgggttacgggttacccgggtaaccggtaaacgggggtaaccgtaaggggtaacggtaaaccggtaaccggttaaacggtaaacggttggttaaccggttcgtacggtaacccctaccgttaacgtttcgttacgtttccctttaaccgtacgttttaccccgtaccccgttaccgttacgttccggttaaacggttacggttttacggttacgggtttaacgttaacggttacggtacggggtccggttacggttacggaaccggttacggacgttacggtactagtaccgntaccgngtacgnacgtagngcgtacgtgaccgtcggtancgaacgtcgtacgtctacgtcgtcgtcgtcgtcgtacgtctctcgtagacgtcgtctc

SEQ ID NO: 238739 - DNA, 605 bp, Homo sapiens
  misc_feature: GYAE6OF02GSYPW.33.60.F05.1.454.CMB.1.raw
  modified_base (252)..(252): a, c, t, g, unknown or other
  misc_feature (252)..(252): n is a, c, g, or t
  modified_base (525)..(525): a, c, t, g, unknown or other
  misc_feature (525)..(525): n is a, c, g, or t
  modified_base (531)..(531): a, c, t, g, unknown or other
  misc_feature (531)..(531): n is a, c, g, or t
  modified_base (539)..(539): a, c, t, g, unknown or other
  misc_feature (539)..(539): n is a, c, g, or t
  modified_base (549)..(549): a, c, t, g, unknown or other
  misc_feature (549)..(549): n is a, c, g, or t
  modified_base (554)..(554): a, c, t, g, unknown or other
  misc_feature (554)..(554): n is a, c, g, or t
  modified_base (596)..(596): a, c, t, g, unknown or other
  misc_feature (596)..(596): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctcctcatccatggtagcactccaccgagggccacgtggctatcccagactaggttcaggttgacagtgggtcgtgggacagtacttcattctcactatacagacagactggacncctagaacgtatttgctagtagttactacgtgtcaggtactaggttacggttacgttcaacgttcgtaccggtcggtaccggaccgtaacggggacctaagggtacgaaacgtacgaaacggtacgtaggtacgacgtacgaccgtaactagttacctgtacttacgtacgttccgttaccctacgtacttcgtacgtaagttcgttagtacgtacgtggacggcggtcgtacggaccgaggtaccgagtaacgtcggatcgtagtcgacgtnaccgangtacgtancgatcgatcncgtcncgtactacgctacggtactcgtattcgggacttgaacgtcgngacgttgcg

SEQ ID NO: 238740 - DNA, 751 bp, Homo sapiens
  misc_feature: GYAE6OF02IL7HQ.33.60.F05.1.454.CMB.1.raw
  modified_base (674)..(674): a, c, t, g, unknown or other
  misc_feature (674)..(674): n is a, c, g, or t
  modified_base (683)..(683): a, c, t, g, unknown or other
  misc_feature (683)..(683): n is a, c, g, or t
  modified_base (688)..(688): a, c, t, g, unknown or other
  misc_feature (688)..(688): n is a, c, g, or t
  modified_base (710)..(710): a, c, t, g, unknown or other
  misc_feature (710)..(710): n is a, c, g, or t
tcagtacacacactcacgaccggtgctcgatttagtacgtcatcagggaaagggccacccctctcttgtagggccagtcagagtgttagcagcaactacttagcctggtaccagcagacacctggccaggcctcccacggctcctcactccagtgggtcgcactcccgaccgagggccacgtggcctactcccgagtacgtacggttcaggtcggacgaggttcggggtgtacggggactacgtacctttactacgtttcctaccacctaacgtacgtaacggaccgacggtacgtcggggacttaccgtaacggtaaagtttaagtttttcggacttaggtttacgttaacgtttacgtcgtaccgtacgtaccgtaaggtttaacgggtttaacgtaccggttactcccggttaccggtaacggtttaccggaccgaaacgggtaacccgaaaggggtaacgaaaacgtaccggaaaaacgtacggttacggtacggtacctacggacctaaacccgtagttaccgttacgttacctttaccgtaaaccgtttccccgttacccgaacttaccgttaacgttacggtaaggttcgttacgttgtaaaccggtggaaccgggtcgggtacgtacgggacggtacggaacgacgtaagtagcacgcacgtagtnatagacagngagangtcgactacgacgcgatactanagtcgtacgtacgagtacgtaacgacgagaacgtagactac

SEQ ID NO: 238741 - DNA, 608 bp, Homo sapiens
  misc_feature: GYAE6OF02JL6KT.33.60.F05.1.454.CMB.1.raw
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (572)..(573): a, c, t, g, unknown or other
  misc_feature (572)..(573): n is a, c, g, or t
  modified_base (575)..(575): a, c, t, g, unknown or other
  misc_feature (575)..(575): n is a, c, g, or t
  modified_base (577)..(582): a, c, t, g, unknown or other
  misc_feature (577)..(582): n is a, c, g, or t
  modified_base (584)..(586): a, c, t, g, unknown or other
  misc_feature (584)..(586): n is a, c, g, or t
  modified_base (588)..(591): a, c, t, g, unknown or other
  misc_feature (588)..(591): n is a, c, g, or t
  modified_base (593)..(608): a, c, t, g, unknown or other
  misc_feature (593)..(608): n is a, c, g, or t
tcagtacacacactcacgaccggtgctcgatttagtacgtcatcagggaaaggccaccctctcttgtagggccagtcagagtgttagcagcaactacttagcctggtaccagcagacacctggccaggcctcccgaggcctcctcactccagtggtcgcactcccaaccgacgggacccaccgtgggaccactccccgaacgaacgtaggttacgtaggttggcgtgggtcgggttcgtagggacgaagtacctttactaacttcctaccaaccgtactcgacggtaccgtaacgtcggtacggacgtaccgttaaggtaagttacgttgtacgtagtttagttacgttctagcaggtcgtaggtacggtgtaccgtctcgtaccgtacggtccgacggtaacggacgtaggtaacgaagtaccgtaaaggagttcggtacgacgtacgacgtacctacgttacgtcttacgttcctaccgtcccgttaccctattaccgtagtacggttacgtggttagtacggtcggtaggtcggcgtacggagtaccgagaccttagccgancngtcgnngngnnnnnngnnngnnnngnnnnnnnnnnnnnnnn

SEQ ID NO: 238742 - DNA, 761 bp, Homo sapiens
  misc_feature: GYAE6OF02J132Z.33.60.F05.1.454.CMB.1.raw
  modified_base (668)..(668): a, c, t, g, unknown or other
  misc_feature (668)..(668): n is a, c, g, or t
tcagtacacacactcacgaccggtgctcgatttagtacgtcatcagggaaagggccaccctctcttgtagggccagtcagagtgttagcagcaactacttagcctggtaccagcagacacctggccaggctcccaggctctcatccatggtgcactccaccgagggccacgtggccactaccccgaagtaccagggtttccacggtggcaggttcgggtcgtacgggaccgagtacctttacacgtttctacccaaccgtactaccgaacggtccgaagtaccggttaggggaacctacccggtttaggaaacgttactttttacgggccgtagtttacggttaacttccgttcggtaccgaaggtccgtaaggttaaccggttagtctaaccgttcgttaccggaacggtttccgaaccccggtaaagggtaacccgtaaggtttaacggaaaacttaccgaaaaccgttacggtacggtcggtacccgttgactaaccctgttaccgtgttccgttaactccgtttaccgtccccggtaactacgttaaccggttgtaacgtttcggttacggttacgttacggtaccgggtaacgggcgggtacgtcgggaacggttaccggaggtctaacggagtacgtacgctagcaagcgccgttaacgggngtaccgtctagtacgtactacgtacgtacgtcgacgtacgtacgtactcgtcggtacgtacgtacgtaccgtacgtacgtcggtagtagaacg

SEQ ID NO: 238743 - DNA, 125 bp, Homo sapiens
  misc_feature: GYAE6OF01EL9OQ.19.25.C03.1.454.CMB.1.raw
  modified_base (125)..(125): a, c, t, g, unknown or other
  misc_feature (125)..(125): n is a, c, g, or t
tcagtactctcgtgcacgaccggtgctcgatttagtagtgtagattgggttggcacagcggcctggctgcctggtcaaggactacttcccacgagagtactgagcgggctggcaaggcgcatagn

SEQ ID NO: 238744 - DNA, 371 bp, Homo sapiens
  misc_feature: GYAE6OF01CXESM.19.25.C03.1.454.CMB.1.raw
  modified_base (368)..(371): a, c, t, g, unknown or other
  misc_feature (368)..(371): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttattgtactactttgactactggggccagggaaccctggtcaccgtctcctcagcctccaccaagggcccatcggtcttcccctggcaccctcctccaagagcacctctggtggcacagcggccctgggctgcctggtcaaggctacttcccacgagagtactgagcgggctggcaaggcgcatagnnnn

SEQ ID NO: 238745 - DNA, 128 bp, Homo sapiens
  misc_feature: GYAE6OF01AC2X2.19.25.C03.1.454.CMB.1.raw
  modified_base (128)..(128): a, c, t, g, unknown or other
  misc_feature (128)..(128): n is a, c, g, or t
tcagtactctcgtgcacgaccggtgctcgatttagtagtgtagatttgggttggcacagcggccctgggctgcctggtcaaggactacttcccacgagagtactgagcgggctggcaaggcgcatagn

SEQ ID NO: 238746 - DNA, 352 bp, Homo sapiens
  misc_feature: GYAE6OF01CGYRM.19.25.C03.1.454.CMB.1.raw
  modified_base (344)..(352): a, c, t, g, unknown or other
  misc_feature (344)..(352): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactggggccagggaaccctggtcaccgtctcctcagcctccaccaagggcccatcggtcttccccctggcaccctcctccaagacgcacctctgggggcacagcggccctgggctgcctggtcaaggactacttccacgagagtactgagcgggctggcaaggcgcatagnnnnnnnnn

SEQ ID NO: 238747 - DNA, 185 bp, Homo sapiens
  misc_feature: GYAE6OF01BVXW3.19.25.C03.1.454.CMB.1.raw
  modified_base (173)..(185): a, c, t, g, unknown or other
  misc_feature (173)..(185): n is a, c, g, or t
tcagtactctcgtgcacgaccggtgctcgatttagtagtgtagatttgggtttgggggaagaggaagactgacggtcccccaggagttcaggtgctgggcacagcggccctgggctgcctggtcaaggactacttcccacgagagtactgagcgggctggcaaggcgcatagnnnnnnnnnnnnn

SEQ ID NO: 238748 - DNA, 174 bp, Homo sapiens
  misc_feature: GYAE6OF01AZRSU.19.25.C03.1.454.CMB.1.raw
  modified_base (172)..(174): a, c, t, g, unknown or other
  misc_feature (172)..(174): n is a, c, g, or t
tcagtactctcgtgcacgaccggtgctcgatttagtagtgtagatttgggtttggggaagaggaagactgacggtcccccaggagttcaggtgctgggcacagcggccctgggctgcctggtcaaggactacttcccacgagagtactgagcgggctggcaaggcgcatagnnn

SEQ ID NO: 238749 - DNA, 174 bp, Homo sapiens
  misc_feature: GYAE6OF01DW45C.19.25.C03.1.454.CMB.1.raw
  modified_base (173)..(174): a, c, t, g, unknown or other
  misc_feature (173)..(174): n is a, c, g, or t
tcagtactctcgtgcacgaccggtgctcgatttagtagtgtagatttgggtttgggggaagaggaagactgacggtcccccaggagttcaggtgctgggcacagcggccctgggctgcctggtcaaggactacttcccacgagagtactgagcgggctggcaaggcgcatagnn

SEQ ID NO: 238750 - DNA, 353 bp, Homo sapiens
  misc_feature: GYAE6OF01BVNBZ.19.25.C03.1.454.CMB.1.raw
  modified_base (349)..(353): a, c, t, g, unknown or other
  misc_feature (349)..(353): n is a, c, g, or t
tcagtactctcgtgcacgaccggtgctcgatttagtagtgtagatttgggtttgggtggcccaaggctaggcctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttccacgagagtactgagcgggctggcaaggcgcatagnnnnn

SEQ ID NO: 238751 - DNA, 174 bp, Homo sapiens; identical to SEQ ID NO: 238749
  misc_feature: GYAE6OF01BWTGP.19.25.C03.1.454.CMB.1.raw
  modified_base (173)..(174): a, c, t, g, unknown or other
  misc_feature (173)..(174): n is a, c, g, or t

SEQ ID NO: 238752 - DNA, 332 bp, Homo sapiens
  misc_feature: GYAE6OF01EABRJ.19.25.C03.1.454.CMB.1.raw
  modified_base (330)..(332): a, c, t, g, unknown or other
  misc_feature (330)..(332): n is a, c, g, or t
tcagtactctcgtgcacgaccggtgctcgatttagtagtgtagatttgggtttgggattcacgttgcagatgtaggtctgggtgcccaagctgctgaaggcctcggacaccgccatgtattactgtggccgggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnn

SEQ ID NO: 238753 - DNA, 374 bp, Homo sapiens
  misc_feature: GYAE6OF01DJ2QA.19.25.C03.1.454.CMB.1.raw
  modified_base (371)..(374): a, c, t, g, unknown or other
  misc_feature (371)..(374): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnnn

SEQ ID NO: 238754 - DNA, 354 bp, Homo sapiens
  misc_feature: GYAE6OF01C1BQS.19.25.C03.1.454.CMB.1.raw
  modified_base (344)..(354): a, c, t, g, unknown or other
  misc_feature (344)..(354): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactaccttcccacgagagtactgagcggctggcaaggcgcatagnnnnnnnnnnn

SEQ ID NO: 238755 - DNA, 359 bp, Homo sapiens
  misc_feature: GYAE6OF01AGEXF.19.25.C03.1.454.CMB.1.raw
  modified_base (341)..(359): a, c, t, g, unknown or other
  misc_feature (341)..(359): n is a, c, g, or t
tcagtactctcgtgcacgaccggtgctcgatttagtagtgtagatttgggtttgggtgccaagctgctggagggcacggtcaccacgctgctgagggagtagagtcctgaaggcctcggacaccgccatgtattactgtgccgggtagtggttatttgtactactttgactactgggccagggaacctggtcaccgtctcctcagcctccaccaagggcccatcggtcttccccctggcaccctcctccaagagcacctctgggggcacagcggccctgggctgcctggtcaaggactacttcccacgagagtacctgagcgggctggcaaggcgcatagnnnnnnnnnnnnnnnnnnn

SEQ ID NO: 238756 - DNA, 379 bp, Homo sapiens
  misc_feature: GYAE6OF01DB7MJ.19.25.C03.1.454.CMB.1.raw
  modified_base (370)..(379): a, c, t, g, unknown or other
  misc_feature (370)..(379): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaaggcccatcggtcttcccctggcaccctcctccaagagcacctctgggggcacagcggccctgggctgccctggtcaaggactacttcccacgagagtactgagcgggctggcaaggcgcatagnnnnnnnnnn

SEQ ID NO: 238757 - DNA, 345 bp, Homo sapiens
  misc_feature: GYAE6OF01DHE09.19.25.C03.1.454.CMB.1.raw
  modified_base (344)..(345): a, c, t, g, unknown or other
  misc_feature (344)..(345): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnn

SEQ ID NO: 238758 - DNA, 373 bp, Homo sapiens
  misc_feature: GYAE6OF01C8EFP.19.25.C03.1.454.CMB.1.raw
  modified_base (370)..(373): a, c, t, g, unknown or other
  misc_feature (370)..(373): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttccacgagagtactgagcgggctggcaaggcgcatagnnnn

SEQ ID NO: 238759 - DNA, 347 bp, Homo sapiens
  misc_feature: GYAE6OF01AUBT4.19.25.C03.1.454.CMB.1.raw
  modified_base (345)..(347): a, c, t, g, unknown or other
  misc_feature (345)..(347): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnn

SEQ ID NO: 238760 - DNA, 378 bp, Homo sapiens
  misc_feature: GYAE6OF01D4H3C.19.25.C03.1.454.CMB.1.raw
  modified_base (372)..(378): a, c, t, g, unknown or other
  misc_feature (372)..(378): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggcccctgggctgcctggtcaaggactacttcccacgagagtactgagcgggctggcaaggcgcatagnnnnnnn

SEQ ID NO: 238761 - DNA, 349 bp, Homo sapiens
  misc_feature: GYAE6OF01EB1SX.19.25.C03.1.454.CMB.1.raw
  modified_base (345)..(349): a, c, t, g, unknown or other
  misc_feature (345)..(349): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttccccacgagagtactgagcgggctggcaaggcgcatagnnnnn

SEQ ID NO: 238762 - DNA, 501 bp, Homo sapiens
  misc_feature: GYAE6OF01CJPJJ.19.25.C03.1.454.CMB.1.raw
  modified_base (203)..(203): a, c, t, g, unknown or other
  misc_feature (203)..(203): n is a, c, g, or t
  modified_base (437)..(437): a, c, t, g, unknown or other
  misc_feature (437)..(437): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttgcctggtaccagcagaaacctggccaggctcccaggctcctcatctatggtgcatcccacagggccatggtatcccagccaggttcagtggcaggtgggtctgggacagagttcactctcaccatcagcagcctgcagtctagaagtattttgctagtttattactgtcagcagtataatactggcctnagtacgtttcggcggtaggaccaagggtgagactacgaaacggactgtgctgacacatcgtgtc

SEQ ID NO: 238763 - DNA, 348 bp, Homo sapiens
  misc_feature: GYAE6OF01CIFRY.19.25.C03.1.454.CMB.1.raw
  modified_base (344)..(348): a, c, t, g, unknown or other
  misc_feature (344)..(348): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnnnn

SEQ ID NO: 238764 - DNA, 173 bp, Homo sapiens
  misc_feature: GYAE6OF01AZ256.19.25.C03.1.454.CMB.1.raw
  modified_base (173)..(173): a, c, t, g, unknown or other
  misc_feature (173)..(173): n is a, c, g, or t
tcagtactctcgtgcacgaccggtgctcgatttagtagtgtagatttgggtttgggggaagaggaagactgacggtcccccaggagttcaggtgctgggcacagcggccctgggctgcctggtcaaggactacttcccacgagagtactgagcgggctggcaaggcgcatagn

SEQ ID NO: 238765 - DNA, 346 bp, Homo sapiens
  misc_feature: GYAE6OF01B3BT5.19.25.C03.1.454.CMB.1.raw
  modified_base (345)..(346): a, c, t, g, unknown or other
  misc_feature (345)..(346): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnn

SEQ ID NO: 238766 - DNA, 535 bp, Homo sapiens
  misc_feature: GYAE6OF01AM5XL.19.25.C03.1.454.CMB.1.raw
  modified_base (203)..(203): a, c, t, g, unknown or other
  misc_feature (203)..(203): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgtgacgagaaactcttagcctggtaccagcagaacctggccaggctcccaggctcctcatctatggtgcatccaccacgggccccctggccatccccagccaggttcagtggcagtgggtctggggcaggacttcactctcaccatcagcagactggacgcctgatgattttgctagtttatactgtcagctagtatggtaggtcgtagggttggtacgttcggaccgaaggggaccgtaagggtacggaaagtacgaaaacggtacgtggtcggctagacctaccatctgttccttctacg

SEQ ID NO: 238767 - DNA, 372 bp, Homo sapiens
  misc_feature: GYAE6OF01BGF7E.19.25.C03.1.454.CMB.1.raw
  modified_base (360)..(360): a, c, t, g, unknown or other
  misc_feature (360)..(360): n is a, c, g, or t
  modified_base (366)..(372): a, c, t, g, unknown or other
  misc_feature (366)..(372): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttcccctggcaccctgctccaggagcacctccgagagcacagccggcctgggctgcctggtcaaggctactcccagagagtactgagcggctggcaaggcncatagnnnnnnn

SEQ ID NO: 238768 - DNA, 346 bp, Homo sapiens
  misc_feature: GYAE6OF01DL68T.19.25.C03.1.454.CMB.1.raw
  modified_base (344)..(346): a, c, t, g, unknown or other
  misc_feature (344)..(346): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccagagagtactgagcgggctggcaaggcgcatagnnn

SEQ ID NO: 238769 - DNA, 350 bp, Homo sapiens
  misc_feature: GYAE6OF01EQ1J7.19.25.C03.1.454.CMB.1.raw
  modified_base (346)..(350): a, c, t, g, unknown or other
  misc_feature (346)..(350): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctcgtgggggcacagccggccctgggctgcctggtaaggactacttcccacgagagtactgagcgggctggcaaggcgcatagnnnnn

SEQ ID NO: 238770 - DNA, 373 bp, Homo sapiens
  misc_feature: GYAE6OF01CNBI3.19.25.C03.1.454.CMB.1.raw
  modified_base (370)..(373): a, c, t, g, unknown or other
  misc_feature (370)..(373): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttcccctggcaccctcctccaagagcacctctgggggcacagcggccctgggctgcctggtcaaggactacttcccacgagagtactgagcgggctggcaaggcgcatagnnnn

SEQ ID NO: 238771 - DNA, 526 bp, Homo sapiens
  misc_feature: GYAE6OF01B8OA7.19.25.C03.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtncatccaccgagggccatggtactcccagccaggttcagtggctaggtgggtctgggacaggtagttcactctcaccatcagcagcctgcagtctagaagtatttgactagtttattactgtcagctagtataatacgtcggtacctcgagtacgttcggcggtacgggaccgaaggtggagtacgtacgaaacgtacgtggtaggcgtacgacacgatcgtgttc

SEQ ID NO: 238772 - DNA, 533 bp, Homo sapiens
  misc_feature: GYAE6OF01EAQGW.19.25.C03.1.454.CMB.1.raw
  modified_base (204)..(204): a, c, t, g, unknown or other
  misc_feature (204)..(204): n is a, c, g, or t
  modified_base (524)..(524): a, c, t, g, unknown or other
  misc_feature (524)..(524): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcagggccagtcagagtgttagcagcaacttgcctggtaccagcagaaacctggccaggctcccaggctcctcatctatggtgcatccacagggccatggtactcccagccagttcagtggcagtggtctgggacagacgttcactctcacgatcagcagcctgacgtagtcgtagtaagtacttttggacttagttttacttacgtgtacagtctaagtataatacgtgtcctactagtacgttcgggacggtaacggaccgaagggtgagtactacgaaacgtacgtggtgctagcctacgtntccgtgtcc

SEQ ID NO: 238773 - DNA, 374 bp, Homo sapiens
  misc_feature: GYAE6OF01B8TKI.19.25.C03.1.454.CMB.1.raw
  modified_base (368)..(374): a, c, t, g, unknown or other
  misc_feature (368)..(374): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtctccccctggcaccctcctccaagagcacctctgggggcacagcggccctgggctgcctggtcaaggctacttccacgagagtactgagcgggctggcaaggcgcatagnnnnnnn

SEQ ID NO: 238774 - DNA, 374 bp, Homo sapiens
  misc_feature: GYAE6OF01BW8W4.19.25.C03.1.454.CMB.1.raw
  modified_base (371)..(374): a, c, t, g, unknown or other
  misc_feature (371)..(374): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggcctacttcccacgagagtactgagcgggctggcaaggcgcatagnnnn

SEQ ID NO: 238775 - DNA, 331 bp, Homo sapiens
  misc_feature: GYAE6OF01C1XM9.19.25.C03.1.454.CMB.1.raw
  modified_base (327)..(331): a, c, t, g, unknown or other
  misc_feature (327)..(331): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattaatgtggccgggtagtggttatttgtactactttgactactggggccagggaaccctggtcaccgtctcctcagcctccaccaaggcccatcggtcttcccctggcacctactccaagagcacctctggggcacagcggccctgggctgcctggtcaaggactacactgagcgggctggcaaggcgcatagnnnnn

SEQ ID NO: 238776 - DNA, 134 bp, Homo sapiens
  misc_feature: GYAE6OF01CEWCX.19.25.C03.1.454.CMB.1.raw
  modified_base (130)..(134): a, c, t, g, unknown or other
  misc_feature (130)..(134): n is a, c, g, or t
tcagtactctcgtgcacgaccggtgctcgatttagtagtgtagatttgggtttgggcacagcggccctgggctgcctggtcaaggactacttcccacgagagtactgagcgggctggcaaggcgcatagnnnnn

SEQ ID NO: 238777 - DNA, 373 bp, Homo sapiens
  misc_feature: GYAE6OF01DLFJ7.19.25.C03.1.454.CMB.1.raw
  modified_base (370)..(373): a, c, t, g, unknown or other
  misc_feature (370)..(373): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccaggggaaccctggtcaccgtctcctcagcctccaccaagggcccatcggtcttcccctggcaccctcctccaagagcacctctgggggcacagcggccctgggctgcctggtcaaggctacttcccacgagagtactgagcgggctggcaaggcgcatagnnnn

SEQ ID NO: 238778 - DNA, 541 bp, Homo sapiens
  misc_feature: GYAE6OF01DE0FR.19.25.C03.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (289)..(289): a, c, t, g, unknown or other
  misc_feature (289)..(289): n is a, c, g, or t
  modified_base (358)..(358): a, c, t, g, unknown or other
  misc_feature (358)..(358): n is a, c, g, or t
  modified_base (395)..(395): a, c, t, g, unknown or other
  misc_feature (395)..(395): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctntcctgcagggccagtcagagtgttagcagcaacttgcctggtaccagcagaaacctggccaggctccaggcctcctnatctatggtgcatcccacagggccactggtactcccagccaggttcagtggcaggtggtctgggacagngttcactctcacatcagcagcctgcagtctagaagtntttgctagtttatactgtcagctaagtataatactggacctacgagttacgttcgggacggtagggtaccgaagggtacggaagtacgtaacgaaacggtacgtgggtacggtccgtacgacctaaccgtattccgtggtttaccc

SEQ ID NO: 238779 - DNA, 373 bp, Homo sapiens
  misc_feature: GYAE6OF01A8EYG.19.25.C03.1.454.CMB.1.raw
  modified_base (370)..(373): a, c, t, g, unknown or other
  misc_feature (370)..(373): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcggctggcaaggcgcatagnnnn

SEQ ID NO: 238780 - DNA, 416 bp, Homo sapiens
  misc_feature: GYAE6OF01CAN2V.19.25.C03.1.454.CMB.1.raw
  modified_base (362)..(363): a, c, t, g, unknown or other
  misc_feature (362)..(363): n is a, c, g, or t
  modified_base (365)..(371): a, c, t, g, unknown or other
  misc_feature (365)..(371): n is a, c, g, or t
  modified_base (373)..(416): a, c, t, g, unknown or other
  misc_feature (373)..(416): n is a, c, g, or t
tcagtactctcgtgcacgaccggtgctcgatttagtagtgtagatttgggtttggggttggcccaagctgctggagggcacggtcaccacgctgcttgagggagtagagtcctgaaggcctcggacaccgccatgtattactgtggccggggtagtgggttatttgtactactttggtactactggggcctagggaaccctggtcaccgtctcctcagcctccaccaagggcccatcggtcgttccccctggcaccctcctccaaggacgcacctctgggggcacagcggccctgggctgcctaggtcaaggactacttcccacgagagtactgacgcgggctggcgaaggcgcagtagcannannnnnnnannnnnnnnnnnnnnnnnnnnnnnnnnnnnnnnnnnnnnnnnnnn

SEQ ID NO: 238781 - DNA, 349 bp, Homo sapiens
  misc_feature: GYAE6OF01A2U0T.19.25.C03.1.454.CMB.1.raw
  modified_base (345)..(349): a, c, t, g, unknown or other
  misc_feature (345)..(349): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnnnn

SEQ ID NO: 238782 - DNA, 352 bp, Homo sapiens
  misc_feature: GYAE6OF01AUVA4.19.25.C03.1.454.CMB.1.raw
  modified_base (343)..(352): a, c, t, g, unknown or other
  misc_feature (343)..(352): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactggggccagggaaccctggtcaccgtctcctcagcctccaccaagggcccatcggtcttccccctggcaccctcctccaagagcacctctggggcacagcggccctgggctgcctggtcaaggactacttcccacgagagtactgagcgggctggcaaggcgcatagnnnnnnnnnn

SEQ ID NO: 238783 - DNA, 346 bp, Homo sapiens
  misc_feature: GYAE6OF01D86YE.19.25.C03.1.454.CMB.1.raw
  modified_base (345)..(346): a, c, t, g, unknown or other
  misc_feature (345)..(346): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattaatgtggccggggtagtggttatttgtactactttgactactggggccagggaaccctggtcaccgtctcctcagcctccaccaagggcccatcggtcttccccctggcaccctactccaagagcacctctgggggcacagcggccctgggctgcctggtcaaggactacttcccacgagagtactgagcgggctggcaaggcgcatagnn

SEQ ID NO: 238784 - DNA, 372 bp, Homo sapiens
  misc_feature: GYAE6OF01DRR3N.19.25.C03.1.454.CMB.1.raw
  modified_base (369)..(372): a, c, t, g, unknown or other
  misc_feature (369)..(372): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttcccctggcaccctcctccaagagcacctctgggggcacagcggcctgggctgcctggtcaaggactacttcccacgagagtactgagcgggctggcaaggcgcatagnnnn

SEQ ID NO: 238785 - DNA, 377 bp, Homo sapiens
  misc_feature: GYAE6OF01BJTSE.19.25.C03.1.454.CMB.1.raw
  modified_base (372)..(377): a, c, t, g, unknown or other
  misc_feature (372)..(377): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggcccctgggctgcctggtcaaggactacttcccacgagagtactgagcgggctggcaaggcgcatagnnnnnn

SEQ ID NO: 238786 - DNA, 373 bp, Homo sapiens
  misc_feature: GYAE6OF01D8HX9.19.25.C03.1.454.CMB.1.raw
  modified_base (371)..(373): a, c, t, g, unknown or other
  misc_feature (371)..(373): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnn

SEQ ID NO: 238787 - DNA, 346 bp, Homo sapiens
  misc_feature: GYAE6OF01CWA22.19.25.C03.1.454.CMB.1.raw
  modified_base (344)..(346): a, c, t, g, unknown or other
  misc_feature (344)..(346): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattaatgtggccgggtagtggttatttgtactactttgactactggggccagggaaccctggtcaccgtctcctcagcctccaccaagggcccatcggtcttccccctggcaccctactccaagagcacctctgggggcacagcggccctgggctgcctggtcaaggactacttcccacgagagtactgagcgggctggcaaggcgcatagnnn

SEQ ID NO: 238788 - DNA, 360 bp, Homo sapiens
  misc_feature: GYAE6OF01B2B6T.19.25.C03.1.454.CMB.1.raw
  modified_base (354)..(360): a, c, t, g, unknown or other
  misc_feature (354)..(360): n is a, c, g, or t
tcagtactctcgtgcacgaccggtgctcgatttagtagtgtagatttgggtttgggcccaggtcaccatctcagccgacaagtccatcagcaccgcctacctgcagtggagcagcctgaaggactcggacaccgccatgtattactgtggccggggtagtggttatttgtactactttgactactggggccagggaaccctggtcaccgtctcctcagcctccaccaagggcccatcggtcttccccctggcacccctcctccaagagcacctctgggggcacagcggccctgggctgcctggtcaaggactacttcccacgagagtactgagcgggctggcaaggcgcatagnnnnnnn

SEQ ID NO: 238789 - DNA, 636 bp, Homo sapiens
  misc_feature: GYAE6OF01C76MQ.19.25.C03.1.454.CMB.1.raw
  modified_base (204)..(204): a, c, t, g, unknown or other
  misc_feature (204)..(204): n is a, c, g, or t
  modified_base (314)..(314): a, c, t, g, unknown or other
  misc_feature (314)..(314): n is a, c, g, or t
  modified_base (472)..(472): a, c, t, g, unknown or other
  misc_feature (472)..(472): n is a, c, g, or t
  modified_base (625)..(625): a, c, t, g, unknown or other
  misc_feature (625)..(625): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcagggccagtcagagtgtagcagcaacttagcctggtaccagcacgaaacctggaccaggcctccgaggcctcctcattctagttcgggtacncactcccacgacgggacctacgtcggtaacctccccgaggtcccgtaagggtttccgaggttcggacgtagggttcggggttacgtggggaactaggtacgtttaccaacttcgtaccaacctagtccgagcctacgcctgactagtctagaaagttntttacgacttagttttactctgtactagtactaagttaattaactaacgttcggtaccttacgtaaggttacccgttacggggacggaacgggtaccgaaggggttacggaacgtaacgtaaccgaaacgtcgtggtcgactcgaccaccgtntccgtgttacc

SEQ ID NO: 238790 - DNA, 609 bp, Homo sapiens
  misc_feature: GYAE6OF01DV0MW.19.25.C03.1.454.CMB.1.raw
  modified_base (205)..(205): a, c, t, g, unknown or other
  misc_feature (205)..(205): n is a, c, g, or t
  modified_base (439)..(439): a, c, t, g, unknown or other
  misc_feature (439)..(439): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagccaccctctcctgcagggccagtcagagtgttagcagcaacttgcctggtaccagacaagaaacctggccaggcctccgaggctcctcatcctagtggtcgcactcccaccgagggccctaacgtcggtactccccagcccgtaggttcaggtggctagggtgggtcgtgggacaggtacgtccactctacaaccgtatcgagacacgccgtgactagtcgtaggtaagttnttttgacttagttttactacttgtacagtactaagttaaataattacgtcgtacctagtacgtacgtttccgggacggtaacgggacgtaagggtagggaacgtaagtaaccgaaacggtaacgttacggtcggtaccgtacggtacctaaccgtacttcgttgttaccc

SEQ ID NO: 238791 - DNA, 375 bp, Homo sapiens
  misc_feature: GYAE6OF01CXCQF.19.25.C03.1.454.CMB.1.raw
  modified_base (371)..(375): a, c, t, g, unknown or other
  misc_feature (371)..(375): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggtgccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnnnn

SEQ ID NO: 238792 - DNA, 547 bp, Homo sapiens
  misc_feature: GYAE6OF01CWQJ9.19.25.C03.1.454.CMB.1.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgtagcagcaacttgcctggtaccagcagaacctggccaggctccaggctcctcatctatggtncatccacgagggccactggtactcccagccaggttcagtggcaggtgggtctggggacaggtacgttcactctcaccatcagcagcctgcagtctagaagtattttgacttagtttattacgtgtacagactagtaataataacgtcgtcctacgtagtacgtttcggacgggtacgggaccgaagggtggaacgtacgtacgaaacggtaacgtggtaggtcgtacggactaacacttcgtcggttacc

SEQ ID NO: 238793 - DNA, 651 bp, Homo sapiens
  misc_feature: GYAE6OF01B34T6.19.25.C03.1.454.CMB.1.raw
  modified_base (206)..(206): a, c, t, g, unknown or other
  misc_feature (206)..(206): n is a, c, g, or t
  modified_base (291)..(291): a, c, t, g, unknown or other
  misc_feature (291)..(291): n is a, c, g, or t
  modified_base (314)..(314): a, c, t, g, unknown or other
  misc_feature (314)..(314): n is a, c, g, or t
  modified_base (323)..(323): a, c, t, g, unknown or other
  misc_feature (323)..(323): n is a, c, g, or t
  modified_base (372)..(372): a, c, t, g, unknown or other
  misc_feature (372)..(372): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaagggggaaanacgcccaaccctctccgtgccaggggccaggtcagagttgtagcagctaaacttgcctggaccagcagaaacctggaccaggtcncccaggctcctcatcgtatggtncatccaacngggcctacgtggactcccagtcccaagggttccaggtggcaggtggtcngggacaggacttcactcncacctancagacacgctgactacgtacgtaagtaagttatttacgtacgttaagtttaacgttacgtacgtacgtagtaacgtaagttaaattaaacgttaacggtaccgtaccttacgtaacggttaccggtttacggggaaccggggtaaacgggtaaaccggtaaaggggtacggtaaacggtaaacgtaaaccggtaaaacggtaacggttacgggttacggaccgtacgaaccctaactacgttcgttcggttacc

SEQ ID NO: 238794 - DNA, 346 bp, Homo sapiens
  misc_feature: GYAE6OF01BB4OR.19.25.C03.1.454.CMB.1.raw
  modified_base (343)..(346): a, c, t, g, unknown or other
  misc_feature (343)..(346): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactgggccagggaaccctggtcaccgtctcctcagcctccaccaagggcccatcggtcttccccctggcaccctcctccaagagccacctctgggggcacagcggccctgggctgcctggtcaaggactacttccacgagagtactgagcgggctggcaaggcgcatagnnnn

SEQ ID NO: 238795 - DNA, 354 bp, Homo sapiens
  misc_feature: GYAE6OF01BDB9C.19.25.C03.1.454.CMB.1.raw
  modified_base (349)..(354): a, c, t, g, unknown or other
  misc_feature (349)..(354): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactgggccagggaaccctggtcaccgtctcctcagcctccaccaacgggcccatcggtccttccccctggccaccctcctccaagagccacctcgtgggggcacagcggccctgggctgcctggtcaaggactacttcccacgagagtactgagcgggctggcaaggcgcatagnnnnnn

SEQ ID NO: 238796 - DNA, 346 bp, Homo sapiens; identical to SEQ ID NO: 238765
  misc_feature: GYAE6OF01E0N93.19.25.C03.1.454.CMB.1.raw
  modified_base (345)..(346): a, c, t, g, unknown or other
  misc_feature (345)..(346): n is a, c, g, or t

SEQ ID NO: 238797 - DNA, 375 bp, Homo sapiens
  misc_feature: GYAE6OF01AP8OD.19.25.C03.1.454.CMB.1.raw
  modified_base (371)..(375): a, c, t, g, unknown or other
  misc_feature (371)..(375): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnnnn

SEQ ID NO: 238798 - DNA, 380 bp, Homo sapiens
  misc_feature: GYAE6OF01A0RTI.19.25.C03.1.454.CMB.1.raw
  modified_base (371)..(380): a, c, t, g, unknown or other
  misc_feature (371)..(380): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggccaccctcctccaagagcacctctgggggcacagcggccctgggctgcctggtcaaggctacttcccacgagagtactgagcgggctggcaaggcgcatagnnnnnnnnnn

SEQ ID NO: 238799 - DNA, 352 bp, Homo sapiens
  misc_feature: GYAE6OF01BCTKB.19.25.C03.1.454.CMB.1.raw
  modified_base (345)..(352): a, c, t, g, unknown or other
  misc_feature (345)..(352): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttccccacgagagtactgagcggctggcaaggcgcatagnnnnnnnn

SEQ ID NO: 238800 - DNA, 618 bp, Homo sapiens
  misc_feature: GYAE6OF01EJNBP.19.25.C03.1.454.CMB.1.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
  modified_base (416)..(416): a, c, t, g, unknown or other
  misc_feature (416)..(416): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcactccaccagggccacgtggtactcccagcccgtaggttcagtcggcaggtgggtctgggacaggacgtttcacgtctcacctatcagcagcctnctagtcagtagtattttgntagtttattactcgtacagctaagttataactaacgttcggtaccttcgtaacggtaaccgttttccggggaaccggggtaacggggtaaccggtaaagggggttacgggaacggtaaacgttaacccgaaaaccggtaacgttacgggttaccgggacttacgggacccgtaaaccccgtattccgttacgggtttacccc

SEQ ID NO: 238801 - DNA, 680 bp, Homo sapiens
  misc_feature: GYAE6OF01EGQOL.19.25.C03.1.454.CMB.1.raw
  modified_base (204)..(204): a, c, t, g, unknown or other
  misc_feature (204)..(204): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttagcagcaacttagcctggtaccagcagaaacctggccaggctccaggcctcctcatctagtggtgcctatcccgaccgacgggccacgtcggtactccccgaggtccctaggttccgaggtcggacgtagggttcggggtccgtagggggaacctaaggtacggtttccaaccgtttcctacccgaaccctagttccgaacggtccgtaacggcccgttcggaccgtaggttaccgttaaggtaaacgtttagtttttacgaacgtttacggtttttaactttacgttagtacgaacgtacgtaagttaacttaacgtaacgtcggtacctacgtacgttaccgttacgggacgggtaacgggaccgtaaagggtaggtaacgtaacgtaacgaaacggtacgtggtcggtaccgtcgaccaccgttattcgttcgttacc

SEQ ID NO: 238802 - DNA, 348 bp, Homo sapiens
  misc_feature: GYAE6OF01C28H7.19.25.C03.1.454.CMB.1.raw
  modified_base (344)..(348): a, c, t, g, unknown or other
  misc_feature (344)..(348): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactggggccagggaaccctggtcaccgtctcctcagcctccaccaagggcccatccggtcttccccctggccaccctcctccaagagcacctctggggcacagcggccctgggctgcctggtcaaggactacttcccagagagtactgagcgggctggcaaggcgcatagnnnnn

SEQ ID NO: 238803 - DNA, 652 bp, Homo sapiens
  misc_feature: GYAE6OF01AFMP1.19.25.C03.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgtagcagcaacttgcctggtaccagcagaacctggccaggcctcccaggcctcctcatctagtggtcncactcccgaaccgagggccctacgtggtaactccccgagtcccgtaggtttccaggttcgggactagggttcggggtactaggggacctaggtacgtttccaccgttcctaccaaccgtatccgacgccacgtccgtcgctagtcgtaggtaagttacttttcgacttaggttttacttacgttagtacgagtacgtaagttaattaaacttaccgtacggtacccttacgtacggttaccggtttacgggacgggtaacgggtacgtaagggtaggtaacgtacgtaacgaaacggtacgttacggtacggtaccgtacgtacctaccgtacttcgtcgtttacccg

SEQ ID NO: 238804 - DNA, 711 bp, Homo sapiens
  misc_feature: GYAE6OF01CYU5C.19.25.C03.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaangccaccctctcctgcagggccagtcagagtgtagcagcaacttgcctggtaccagacagaacctggccaggcctcccaggcctcctcatctatggtcncactcccacgagggcccaacgttcgggtaactccccgaaggtccctaagggtttccaagggttcgggactaagggttcggggtacctaggggaacaggtacgtttaccacgttcctaccaaccctagttccgacgccgaacgcccttggacctaaggttccgtaaggtaaacgttagtttttacgaccgtttaaggttttaactttaccgttgtaccgtaaggtacctaaggtttaacttaaacgttaccgttacgggtacccttaacgtaacggttaccgtttacggggaccgggtaacgggtaacccggtaaaggggtacggaaacgtaacgttaaccgaaaaccggttacgttacgggtacgggtaccgtacggtaccaaccgttacgttccgttcgtttacccg

SEQ ID NO: 238805 - DNA, 347 bp, Homo sapiens
  misc_feature: GYAE6OF01CYQ5H.19.25.C03.1.454.CMB.1.raw
  modified_base (336)..(336): a, c, t, g, unknown or other
  misc_feature (336)..(336): n is a, c, g, or t
  modified_base (342)..(347): a, c, t, g, unknown or other
  misc_feature (342)..(347): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactggggccagggaaccctggtcaccgtctcctcagcctccaccaagggcccatcggtcttccccctggcaccctcctccaagagcacctctggggcacagcggccctgggctgcctggtcaaggactacttcccagagagtactgagcgggctggcaaggcncatagnnnnnn

SEQ ID NO: 238806 - DNA, 583 bp, Homo sapiens
  misc_feature: GYAE6OF01D75AO.19.25.C03.1.454.CMB.1.raw
  modified_base (203)..(203): a, c, t, g, unknown or other
  misc_feature (203)..(203): n is a, c, g, or t
  modified_base (376)..(376): a, c, t, g, unknown or other
  misc_feature (376)..(376): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatcccaccgagggccctacgtggtactccccgagccaggttcagtggcaggtggtctgggacagagttcactcncaccatcagcagcctgcngtctagtaagtnttttgacttagtttattacgtgtcagctagttaattaataacgtcggtacccttacgtaacgttaccgtttcggggacgggtaacgggaaccgtaaggggtcgggaacgtaacgtaccgaaacggtaaccgttagggtacggtcctacggacctaacctacgttccgttcgttaccc

SEQ ID NO: 238807 - DNA, 419 bp, Homo sapiens
  misc_feature: GYAE6OF01CRH6I.19.25.C03.1.454.CMB.1.raw
  modified_base (290)..(290): a, c, t, g, unknown or other
  misc_feature (290)..(290): n is a, c, g, or t
  modified_base (401)..(419): a, c, t, g, unknown or other
  misc_feature (401)..(419): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactacgtggggccagggaaccctggtcaccgtctcctcagcctccaccaagggcccatccggtccttcccctggccaccctcctaccaagacnccaccgtcgtcgggggcacgacggccggccctgggccgtcgccgtggtcaaacggccttaccttcccacgagacgtacgtggacgtcgggctcggacaaggcgacaagtgnnnnnnnnnnnnnnnnnnn

SEQ ID NO: 238808 - DNA, 174 bp, Homo sapiens
  misc_feature: GYAE6OF01CP6AP.19.25.C03.1.454.CMB.1.raw
  modified_base (173)..(174): a, c, t, g, unknown or other
  misc_feature (173)..(174): n is a, c, g, or t
tcagtactctcgtgcacgaccggtgctcgatttagtagtgtagatttgggtttgggggaagaggaagactgacggtcccccaggagttcaggtgctgggcacagcggccctgggctgcctggtcaaggactacttcccaagagagtactgagcgggctggcaaggcgcatagnn

SEQ ID NO: 238809 - DNA, 376 bp, Homo sapiens
  misc_feature: GYAE6OF01EVQMN.19.25.C03.1.454.CMB.1.raw
  modified_base (370)..(376): a, c, t, g, unknown or other
  misc_feature (370)..(376): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctggggcacagcggccctgggctgcctggtcaaggactacttcccacgagagtactgagcgggctggcaaggcgcatagnnnnnnn

SEQ ID NO: 238810 - DNA, 345 bp, Homo sapiens
  misc_feature: GYAE6OF01EW0GE.19.25.C03.1.454.CMB.1.raw
  modified_base (336)..(336): a, c, t, g, unknown or other
  misc_feature (336)..(336): n is a, c, g, or t
  modified_base (342)..(345): a, c, t, g, unknown or other
  misc_feature (342)..(345): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattaatgtggccggggtagtggttatttgtactactttgactactggggccagggaaccctggtcaccgtctcctcagcctccaccaagggcccatcggtcttccccctggcaccctactccaagagcacctctgggggcacagcgcctggctgctggtcaaggactacttcccacgagagtactggagcgggctggcaaggcncatagnnnn

SEQ ID NO: 238811 - DNA, 389 bp, Homo sapiens
  misc_feature: GYAE6OF01ET2NA.19.25.C03.1.454.CMB.1.raw
  modified_base (375)..(389): a, c, t, g, unknown or other
  misc_feature (375)..(389): n is a, c, g, or t
tcagtactctcgtgcacgaccggtgctcgattttagtagtgtagatttgggtttgggtggcccaagctgctggagggcacggtcaccatctcagccgacaagtccatcagcaccgcctacctgccagtgagcagcctgaaggcctcggacaccgccatgtatacgtgtggccggggtagtggttatttgtactactttgactacgtcggggccagggaaccctggtcaccggtctcctcagcctccaccaagggcccatcggtcttccccctggccaccctcctccagagcacctctgggggcacagcggccctgggctgcctggtcaaggctacttcccacgagagtactgagcgggactggcaggcgcatagnnnnnnnnnnnnnnn

SEQ ID NO: 238812 - DNA, 379 bp, Homo sapiens
  misc_feature: GYAE6OF01DDBLF.19.25.C03.1.454.CMB.1.raw
  modified_base (372)..(379): a, c, t, g, unknown or other
  misc_feature (372)..(379): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactacttttgactactggggccagggaaccctggtcaccgtctcctcagcctccaccaagggcccatcggtcttccccctgcaccctcctccaagagcacctctggggcacagcggccctgggctgcctggtcaaggactaccttcccacgagagtactgagcgggctggcaaggcgacatagnnnnnnnn

SEQ ID NO: 238813 - DNA, 373 bp, Homo sapiens
  misc_feature: GYAE6OF01CCSZP.19.25.C03.1.454.CMB.1.raw
  modified_base (370)..(373): a, c, t, g, unknown or other
  misc_feature (370)..(373): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaaggcccatcggtccttcccctgccaccctcctccaagagcacctcgtggggcacagcggcccctgggctgcctggtcaaggactacttcccagagagtactgagcgggctggcaaggcgcatagnnnn

SEQ ID NO: 238814 - DNA, 389 bp, Homo sapiens
  misc_feature: GYAE6OF01AI1RC.19.25.C03.1.454.CMB.1.raw
  modified_base (374)..(389): a, c, t, g, unknown or other
  misc_feature (374)..(389): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggccctcggacaccgccatgtattactgtggccgggtagtggttatttgtactactttgactactggggccagggaaccctggtcaccgtctcctcagcctccaccaagggcccatcggtccttcccctggccaccctcctccaagagcacctctgggggcacagcggccctgggctgcctggtcaaggctacttcccacgagagtactgagcgggcgtggcaaggcgacatacgnnnnnnnnnnnnnnnn

SEQ ID NO: 238815 - DNA, 728 bp, Homo sapiens
  misc_feature: GYAE6OF01B8975.19.25.C03.1.454.CMB.1.raw
  modified_base (204)..(204): a, c, t, g, unknown or other
  misc_feature (204)..(204): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcagggccagtcagagtgtagcagcaacttgcctggtaccagacaacgaaacctggccaggcctcccgaggcctcctcatctagtggtcgcactcccaccgacgggccacgtggtacctcccgagtcctaggttccaggtcggacgtagggtcggggtctaggggactaggtacgtttaccaccttcgtaccaacccgtattccgacggtccaacggtcccgtaggaccgtaacggttcgtaaggtaaaacgtttgtttttacggaccgttttaaaggtttttaacttacgttggttaaccagggttaccttaaagttaacgtttaaaacgttaaccgtcgggtacccctttaacgtaacggtttacccgggtttacggggaaccggggtaaccgggtaaacccggtagggtaacggggtaacgtaaaccgttaacggaaaaccgggttaacggttcggtacggtaccttacggaaccctaaccgtacgtttccgttaggtttacccg

SEQ ID NO: 238816 - DNA, 444 bp, Homo sapiens
  misc_feature: GYAE6OF01EHNAI.19.25.C03.1.454.CMB.1.raw
  modified_base (429)..(444): a, c, t, g, unknown or other
  misc_feature (429)..(444): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactggtggccggggtagtggttatttgtactactttgactacgtggggccgagggaaccctggtcaccgtctcctcacgcctccaccaacgggcccacgtccggttccttccccccgtggccctacccctccctaccgaacgacgccaccgtcggtcgggggccacgacggccggcccgtcgggctcggccgtggtaccaacggtacctaccgtacccgacgagacgtacgtggacggccgggcgtacggacgaacggcgactagagnnnnnnnnnnnnnnnn

SEQ ID NO: 238817 - DNA, 663 bp, Homo sapiens
  misc_feature: GYAE6OF01BUIEZ.19.25.C03.1.454.CMB.1.raw
  modified_base (151)..(151): a, c, t, g, unknown or other
  misc_feature (151)..(151): n is a, c, g, or t
  modified_base (205)..(205): a, c, t, g, unknown or other
  misc_feature (205)..(205): n is a, c, g, or t
  modified_base (320)..(320): a, c, t, g, unknown or other
  misc_feature (320)..(320): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactgganaaatagtgatgacgcagtctccagccaccctgtctgtgtctccgaaggggaaancgcccaccctctcctgcagggccagtcagtagtgtagcagctaacgttagccgtaggtaccagccaacgaacctggccaggcctcccgaggtcctcctcgtatcgtagtcgggtnacctactcccgaacgacgggacctacgttggtacctcccgagtccgtaggttcaggtcggacgtagggtcgggtcgtaggggaactaggtacgttccgacttccgtaccaacctagtccaggccaacgtcctaggacctaggtactaggtaacgtttacgtttcgaacgtttagtttaacttcggtagtacgtagtctaaagttacttaacgtacggtcgtacctacgtacgttaccggttacgggacggtaacggtaccgtaagggtacggaacgtaacgtaaccggaaaggttcgttcggtacgccgttaacgacccgttaactcgtttcgtccgttaccg

SEQ ID NO: 238818 - DNA, 586 bp, Homo sapiens
  misc_feature: GYAE6OF01BRC1D.19.25.C03.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (413)..(413): a, c, t, g, unknown or other
  misc_feature (413)..(413): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctntcctgcagggccagtcagagtgttagcagcaacttagcctggtaccagcagaacctggccaggctcccaggctcctcatctatggtcgcactccaccagggcccacgtggtactccccagccctaggttccagtggctaggtgggtctggggacagtacgttcacttctacgaccatcagcacgtcctgctagtctgaagtntttgctagtttatactgtcagctagtataactaactcggaccttacgaacgttcgtttaccgggacgggtaacgggacccgtaagggttacggtaacgtaacgttaaccggaaaacgttacggtcggttacgggtaccttcggaccctaaccgtacgttccgttcggttaccc

SEQ ID NO: 238819 - DNA, 607 bp, Homo sapiens
  misc_feature: GYAE6OF01DAJXV.19.25.C03.1.454.CMB.1.raw
  modified_base (204)..(204): a, c, t, g, unknown or other
  misc_feature (204)..(204): n is a, c, g, or t
  modified_base (440)..(440): a, c, t, g, unknown or other
  misc_feature (440)..(440): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcacgggccagtcagagtgttagcagcaacttagcctaggtaccagacacgaacctggccaggcctacccgaggcctcctcattcctagtggtcgctactcccacgacgggccacgtggtactcccagccgtagttcagtggctaggtcggtacgtgggacaggtacgttcacttctacaacctataccgagccacgcctgacgtagtctaggtaagttntttagacttagtttacttactgtacagtactaagttaataacgtacgtacgtacctacgtacggttacgttacggggacgggtaacggaccggtaagggtacgggaagtacgtaacgtaaacggtcgttaggtcgacgtaccgacactacgttcgtacgtttacccg

SEQ ID NO: 238820 - DNA, 362 bp, Homo sapiens
  misc_feature: GYAE6OF01AOV3J.19.25.C03.1.454.CMB.1.raw
  modified_base (351)..(351): a, c, t, g, unknown or other
  misc_feature (351)..(351): n is a, c, g, or t
  modified_base (357)..(362): a, c, t, g, unknown or other
  misc_feature (357)..(362): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactggggccagggaaccctggtcaccgtctcctcagcctccaccaagggcccatccggtcttccccctgccaccctcctccaagacgcaccgtcgtcgggggcacgaggccggccctgggctgcctggtcaaggtactaccttcccacgagagtactgacgcggggctggcgaaggcncatagnnnnnn

SEQ ID NO: 238821 - DNA, 377 bp, Homo sapiens
  misc_feature: GYAE6OF01BBYI0.19.25.C03.1.454.CMB.1.raw
  modified_base (362)..(377): a, c, t, g, unknown or other
  misc_feature (362)..(377): n is a, c, g, or t
tcagtactctcgtgcacgaccggtgctcgatttagtagtgtagatttgggtttgggcccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctcaccaagggcccatcggtcttcccctggccaccctcctccaagacgcacctcgtgggggcacgagccggcccgtgggctgcctggcaaggactaccttacccgacgagagtactgagcgggctggcgaaggcgacagtagnnnnnnnnnnnnnnnn

SEQ ID NO: 238822 - DNA, 396 bp, Homo sapiens
  misc_feature: GYAE6OF01CF1KY.19.25.C03.1.454.CMB.1.raw
  modified_base (384)..(396): a, c, t, g, unknown or other
  misc_feature (384)..(396): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatccggtccttccccctggccaccctcctccaagacgcacctcgtgggggcacgaggccggcccgtgggctcgccgtggtcaaggacctacttcccacgagagtactggagcgggctggcaaggcgcatagnnnnnnnnnnnnn

SEQ ID NO: 238823 - DNA, 349 bp, Homo sapiens
  misc_feature: GYAE6OF01E3DA6.19.25.C03.1.454.CMB.1.raw
  modified_base (344)..(349): a, c, t, g, unknown or other
  misc_feature (344)..(349): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaaggcccatcggtcttccccctggcaccctcctccaagacgcacctcgtggggcacagcggccctgggctgcctggtcaaggactacttcccacgagagtactgagcggctggcaaggcgcatagnnnnnn

SEQ ID NO: 238824 - DNA, 347 bp, Homo sapiens
  misc_feature: GYAE6OF01CAMKB.19.25.C03.1.454.CMB.1.raw
  modified_base (344)..(347): a, c, t, g, unknown or other
  misc_feature (344)..(347): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnnn

SEQ ID NO: 238825 - DNA, 737 bp, Homo sapiens
  misc_feature: GYAE6OF01B9LCU.19.25.C03.1.454.CMB.1.raw
  modified_base (209)..(209): a, c, t, g, unknown or other
  misc_feature (209)..(209): n is a, c, g, or t
  modified_base (417)..(417): a, c, t, g, unknown or other
  misc_feature (417)..(417): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagactaccactggaagaaatagtgatgacgcagtctccagcccacctgtctgtgtccgtcggaaggggaaanacgcccacccttctccgtgacgacgggcctagtcgaaggtgttagtagctagactaaacgttacgccgttacggtaaccaggacgtaacggaaacctcgggacccagggccctacccgacggtcctcctactacgttcgtagttcggtcacctacctccgaccgtacggaccctagtacggtacctaccgacgtaccgtaggttacgnggtacggcgtaggtcggtacgtaggacaggttaacgttcccacgttaccacgtacctacgtacgaacgccgtacgtccgtacgtacgtagttaccgtaaggtaaacgtttttgtttacggtacgttttaaagtttcgttaccgttagaccgttaagtaaccttaaggttaactttaacgtaccggtcccgtactacggtacggtttacgggaccggacgggtaaacgttaacggaagggtaccgaacgttaaccggtaaacgtaaacgggttccgtcggtacgacgttaccgacttaacctagttaccgttcgttaaccc

SEQ ID NO: 238826 - DNA, 354 bp, Homo sapiens
  misc_feature: GYAE6OF01CNLJA.19.25.C03.1.454.CMB.1.raw
  modified_base (344)..(354): a, c, t, g, unknown or other
  misc_feature (344)..(354): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnnnnnnnnnn

SEQ ID NO: 238827 - DNA, 682 bp, Homo sapiens
  misc_feature: GYAE6OF01BDLU8.19.25.C03.1.454.CMB.1.raw
  modified_base (207)..(207): a, c, t, g, unknown or other
  misc_feature (207)..(207): n is a, c, g, or t
tcagtactctcgtgcacgaccggtgctcgatttagtagtgtagatttggggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaacncgccccaccctcgtcctgcgaggggccagtcaggagtgttagcagactaacttgcctggtaccaggacaacggaacctggaccacggcctcccgaggcccttcctctacttcgtagtgggtcaccacctcccgaccggaccgggaccacggtacggtacctccccgagtcccgtaggttccagggtcggacgtagggttcgggtacgagggactacggttacgttaccaccgttcctacgaaccctagtcgacggtccgtaacggtccctaggtacccgtagttaccgtagtaacgtttacgtttgacgttttaagtttactcgtagtcgtaaggcttaggttgtagggttacggtagggtaggggttcggtaccggttacggaaccggtaacggggacgtaagggtacgaaactacggtaaacggtagtcggcgtacgtacgacccgtattacgccttacgttcctcgtacccg

SEQ ID NO: 238828 - DNA, 397 bp, Homo sapiens
  misc_feature: GYAE6OF01CB4BE.19.25.C03.1.454.CMB.1.raw
  modified_base (362)..(397): a, c, t, g, unknown or other
  misc_feature (362)..(397): n is a, c, g, or t
tcagtactctcgtgcacgaccggtgctcgatttagtagtgtagatttgggtttgggtgcccaagctgctggacgggcacggtcaccacgctcgctgaggagtagagtcctgaaggcctcggacaccgccatcgtattactgtggccgggtagtggttatttgtactactttgactactggggccagggaaccctggtcaccgtctcctcagccgtccaccaacgggcccatccggtccttccccctggccaccctcctaccaagtagcacctctggggacacagccggccctgggctagcctgggtcaagggcctaccttcccgacgacgagtacctgagcgggctggcaaggccgcatagnnnnnnnnnnnnnnnnnnnnnnnnnnnnnnnnnnnn

SEQ ID NO: 238829 - DNA, 456 bp, Homo sapiens
  misc_feature: GYAE6OF01CRBB0.19.25.C03.1.454.CMB.1.raw
  modified_base (427)..(427): a, c, t, g, unknown or other
  misc_feature (427)..(427): n is a, c, g, or t
  modified_base (430)..(456): a, c, t, g, unknown or other
  misc_feature (430)..(456): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatcgtattactggtgggccggggtagtggttatttgtacttactttgactacgtggggccagggaccctggtccaccgtctcctcacgcctacgaaccgaacgggccctagtccgggtcccttcccccgtggccctaccccttccaccgaaggacgcctaaccgtccggtcgggggaccacgcggtccgggcccgttgggcctcggccgtggtacaacgacctaccttacccgacgagtacgtacgtggaggtcggctgggacaggcacgtanagnnnnnnnnnnnnnnnnnnnnnnnnnnn

SEQ ID NO: 238830 - DNA, 356 bp, Homo sapiens
  misc_feature: GYAE6OF01EWIUQ.19.25.C03.1.454.CMB.1.raw
  modified_base (346)..(356): a, c, t, g, unknown or other
  misc_feature (346)..(356): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacacgcggccctgggctgcctggtcaaggactacttcccacgagagtactgagcgggctggcaaggcgcatagnnnnnnnnnnn

SEQ ID NO: 238831 - DNA, 771 bp, Homo sapiens
  misc_feature: GYAE6OF01DR66K.19.25.C03.1.454.CMB.1.raw
  modified_base (209)..(209): a, c, t, g, unknown or other
  misc_feature (209)..(209): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggcctcccagataccactggaagaaatagtgatgacgcagtctccagcctaccctgtctgtcgtctcgaaggggaaacncgcccaccctctcctgcgacgggccagtcagtagttgtagcagactaagttgaccgtggtaccagacaacgaaccgtcggaccaggcctacccgacggtcctaccgtctaacttcttacggtcgggtactaccaaccgtcccgaaccggacgggccctacgttacggaccttcccgaagtcccgtaggttacctagttcgggactagggtcgggtcgtacggtaactaggttcgttaccacttccgtacctaacctagtaccacgccgacgtcccgtagtaccgtaggttacgttacgtaaggtttacgttttacgaccgttttaagtttttacgttaacggtttcggttaacgtaacggttaaccgttaaacggtttaacttaaaccggttacggttaaccgggttaccccgttaaacggttacgggttaaccggtttacccggggggaacggggttaacccgggtaaacggtaacggggttaggaaacggttaccggtaaacgtaaacggtccgtagggttacgccgtacacccggtacttacgtccggttcttaacccg

SEQ ID NO: 238832 - DNA, 334 bp, Homo sapiens
  misc_feature: GYAE6OF01E2REI.19.25.C03.1.454.CMB.1.raw
  modified_base (323)..(323): a, c, t, g, unknown or other
  misc_feature (323)..(323): n is a, c, g, or t
  modified_base (329)..(334): a, c, t, g, unknown or other
  misc_feature (329)..(334): n is a, c, g, or t
tcagtactctcgtgcacgaccggtgctcgatttagtagtgtagatttgggtttgggattcacgttgcagatgtaggtctgggtgcccaagctgctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctggggcacagcggccctgggctgcctggtcaaggactactcccacgagagtactgagcgggctggcaaggcncatagnnnnnn

SEQ ID NO: 238833 - DNA, 477 bp, Homo sapiens
  misc_feature: GYAE6OF01DMRMG.19.25.C03.1.454.CMB.1.raw
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (430)..(430): a, c, t, g, unknown or other
  misc_feature (430)..(430): n is a, c, g, or t
  modified_base (432)..(437): a, c, t, g, unknown or other
  misc_feature (432)..(437): n is a, c, g, or t
  modified_base (439)..(477): a, c, t, g, unknown or other
  misc_feature (439)..(477): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactacttttgactacgtggggccagggaccctggtcaccgtctcctcagccctccacaacgggcccagtccggtccttcccccgtgccacccctcctccaagngccaccgtcggtggggcaacnggccggcccgtgggctcggccgttcgggtacaaacggtcctaccgtttacccgacggtaagtacgttacgtaggacgggccgggtgtacggggaccgaaaggcccggacaaagttggngnnnnnngnnnnnnnnnnnnnnnnnnnnnnnnnnnnnnnnnnnnnnn

SEQ ID NO: 238834 - DNA, 366 bp, Homo sapiens
  misc_feature: GYAE6OF01A7XHG.19.25.C03.1.454.CMB.1.raw
  modified_base (354)..(366): a, c, t, g, unknown or other
  misc_feature (354)..(366): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagccacctcgtgggggcacaggccggccctgggctgcctggtacaaggactacttcccacgagagtacgtgaggcgggctggcgaaggcgacatagnnnnnnnnnnnnn

SEQ ID NO: 238835 - DNA, 848 bp, Homo sapiens
  misc_feature: GYAE6OF01AZFMO.19.25.C03.1.454.CMB.1.raw
  modified_base (215)..(215): a, c, t, g, unknown or other
  misc_feature (215)..(215): n is a, c, g, or t
tcagtactctcgtgcacgaccggtgctcgatttagtagtgtagatttgggtttgggggaggaactgctcagttaggacccagacggaaccatggaacgccccagcgcagcttctcttcctctgctactctggctcccagactaccacgtggaagaaatagtgatgacgcagtctccacgccctaccgtgtctgtcgtcctacggaaggggaaacncgcccaccctctccgtgaccgacgggaccagtcgaaggtaggttcgttacgaccagtacctaacgttacgccgtacggtaccagaccgaaacggtaaccgtcgggaccaccggtacctacccgacggtccctcctacacttcgtagtcggtccacctaccgtacccgacggaccggcctacggtcggtaaccctacccgtacggtaccgttacggttacgacggtcggtacggttacgggtcgggtacggtacgggaccttaaggtccttaccgacctttacccgaactaccctagtacgccgtaccgtacggtccgtagaaccgttagttaccgttaaggttaacgttttacctttagttaccgttttaaagtttacctttaggacccttagtaacgttaacgtttaaagttaaaccgggttaaccttacccggtccgttaccgtttaaaccggttacgggttacccgggtaccgggggaaaccggttaaaccggggtaaccgtaaagggggtaacccggtaataaaacccgggttaaacccgggtaaaaggtttccgggcgggttaaccgacccggggtttaacaaccccggttaaaccctttgtttaacccggtttccggtttaaacccc

SEQ ID NO: 238836 - DNA, 738 bp, Homo sapiens
  misc_feature: GYAE6OF01CU44V.19.25.C03.1.454.CMB.1.raw
  modified_base (206)..(206): a, c, t, g, unknown or other
  misc_feature (206)..(206): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagcccaccctgtctgtcgtctccgaggggaaangcccaccctctcctgcacgggccagtcagagtgtagcagacaactgccgtaggtaccagacaacgaaccgtggaccgacggcctccgaggcctacctcatctagtggtcgctactcccaccggagggccctacgttcggtaacctcccgacgtaccgtaggtttcacggtcggacgtacgggttcgggtccggtagggtaacacggtaaccggtttccaacttcccgtacaacccgtacgttaccgacgacccgtacggtcccttaggaccgttaagttccgttaagtaaaacgttttgttttacgaaccgttttaaggttttaaccgttaccgttacggtttaaccgaacggtttaacttaaacggtttaaacttaaaaccggttaccgtacgggttccccttaacggttacgggttaacccggtttcgggaaacggggtacggaaccggtagggtacggtacgtaaacgttaacgaaacggtacgttggtaaccgtcgtaccgtaccgtaaccgtcttgttccgtaaccg

SEQ ID NO: 238837 - DNA, 571 bp, Homo sapiens
  misc_feature: GYAE6OF01BLRO6.19.25.C03.1.454.CMB.1.raw
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (391)..(392): a, c, t, g, unknown or other
  misc_feature (391)..(392): n is a, c, g, or t
  modified_base (395)..(396): a, c, t, g, unknown or other
  misc_feature (395)..(396): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
tcagtactctcgtgcacgaccggtgctcgatttagtagtgtagatttgggtttgggtgcccaagctgctggagggcacggtcaccgatctcaggcccgacaagtccatcaggcaccgcctacctgcagtggagcagcctgaaggcctcggacaccgccatgtatactgtgccggggtatggttatttgtactactttgactactggggccagggaaccctggtccaccgtctcctcagcctccaccaagggcccatcggtccttcccctggccaccctcctccaagacgcaccgtcgtcggggcacacgcggccctgggctcgcctggtcaaggacttacttcccgacgagacgtacgtggaggcgggctggcaggcgcgagtacgngncnncgnncacgcanctncgatgctgtgtcnctancctanccgatacatctaacctgtacgttcagacggacacgtaccttaacggaaacgttagacggtcgtaaccgtcgttaccgtacgtacgtacgttacgttcgtacgtaccggtaccgtaccgtaccgtacgtacgtacgtacgtacg

SEQ ID NO: 238838 - DNA, 778 bp, Homo sapiens
  misc_feature: GYAE6OF01E3VPU.19.25.C03.1.454.CMB.1.raw
tcagtactctcgtgcacgaccggtgctcgatttagtagtgtagatttgggtttgggggaggaactgctcagttaggacccagacggaaccatggaacgccccagcgcagcttctcttcctcctgctactctggcctcccagactaccacgtggaagaaatagtgatgacgcacgtcctccacgcccaccctgtctgtcgtccgtaccggaaggggaaacaccgaccctaccccttccgtcctcggacgaacgggccagtcaggtagttgttacgacacgactaacgttacgaccgtacggtaccacgaccgaacgtaaaccgtcggacccgtacgggaccctacccgacggtacccttccctactacttcgtacggttacggtacaccgtaccgtacccgaccggaccgggtaccttacgtaccggtacctacccgacgtaccggtacggttaccgacggtacggacggtagggttcgggtacggtacggaccgtaggttacgtacctaccgttaccacccgtactacgaccgtacgaccgtacgcccgtacgtaccgtacggttacgttaaggttacgtttacgtttacgtacgttttaacgttttaccgttacgtttacgtacgaacgttacgtaacgtttaaactaacggttacgtcgtaaccgttacggtaccggttacgggtaccgggagggtaaccggacggtacgggtaggaacgtacgtaaccgaacgttacgggcgttacgaccgttcgacgaacttcgtcttcgtacc

SEQ ID NO: 238839 - DNA, 424 bp, Homo sapiens
  misc_feature: GYAE6OF01COEGZ.19.25.C03.1.454.CMB.1.raw
  modified_base (274)..(274): a, c, t, g, unknown or other
  misc_feature (274)..(274): n is a, c, g, or t
  modified_base (386)..(386): a, c, t, g, unknown or other
  misc_feature (386)..(386): n is a, c, g, or t
  modified_base (393)..(398): a, c, t, g, unknown or other
  misc_feature (393)..(398): n is a, c, g, or t
  modified_base (401)..(424): a, c, t, g, unknown or other
  misc_feature (401)..(424): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactacgtggggccaggggaaccctggtcaccgtctcctcacgcctccaccacgggccatccggtcctcccctggccnccctcctccaagacgcacctcgtcgggggcacgagccggcccctgggctcgcctggtacaacggacctaccttcccacggtagtacgtactggacggcgggctggacaggcncatagcnnnnnngcnnnnnnnnnnnnnnnnnnnnnnnn

SEQ ID NO: 238840 - DNA, 712 bp, Homo sapiens
  misc_feature: GYAE6OF01CEJRH.19.25.C03.1.454.CMB.1.raw
  modified_base (124)..(124): a, c, t, g, unknown or other
  misc_feature (124)..(124): n is a, c, g, or t
  modified_base (334)..(334): a, c, t, g, unknown or other
  misc_feature (334)..(334): n is a, c, g, or t
  modified_base (685)..(685): a, c, t, g, unknown or other
  misc_feature (685)..(685): n is a, c, g, or t
  modified_base (693)..(693): a, c, t, g, unknown or other
  misc_feature (693)..(693): n is a, c, g, or t
tcagtactctcgtgcacgaccggtgctcgatttagtagtgtagatttgggtttggggggaggaactgctcagttaggacccagacggaaccatggaagccccagcgcagcttctcttcctcctnctactctgctcccagataccactggagaaatagtgatgacgcagtctccacgccaccctgtctgtgtctccgaaggggaagacgccaccctcctcctcgcgacgggccagtcagtgtagttagcccccagacctaactagccgtacgtaccagacaagaaccgtcggaccacggcctcccgacggcctacctcctactcctagtcggtcnccactcccgaccgtacgggcctacgtacggtacctccgacgtaccgtacggtcgtaggtacggtcgtacgggttcgggtacgtagggaacgtacggtacgttacctacgtaccctaccaacctataccgaacgtacccgaacggtccctacgggtacttaacggttcctaaggttaagtttcgtttttacgaacgttttaagttttaacttcgttcggttaagacgttaacttaagttaacttaaacttacggtaccgtacttaccggtagtttacccgggtacgggacggggtaaccgggacgtaaagggtggaaacgtacgaaacgtaaacggttggtacggtcgtacnccgtaacncgttacgtcgttcgtaccc

SEQ ID NO: 238841 - DNA, 673 bp, Homo sapiens
  misc_feature: GYAE6OF01DUTNN.19.25.C03.1.454.CMB.1.raw
  modified_base (422)..(422): a, c, t, g, unknown or other
  misc_feature (422)..(422): n is a, c, g, or t
  modified_base (479)..(479): a, c, t, g, unknown or other
  misc_feature (479)..(479): n is a, c, g, or t
  modified_base (536)..(536): a, c, t, g, unknown or other
  misc_feature (536)..(536): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgcatgtattactgtggcgggtagtggttatttgtactactttgactacgtgggccaggaccctggtcaccgtctcgtcacgcctaccgaaccgaacgggtcccaagttccggttccctttccccccgtgggcccgtcccttggccttaccgaagggaacgccaacccgtccgaagacgacacgacggtccgggccccgtggggccttcggcccgtagggttaccaaacggtacctaaccgtttccccgaacggtaaggtaacggttaaccngggaacggccgggggtacttacggggaccgtaaaggggccgaacctaagttaacggnagacgacagacgtagtacgacgacgagacacacgtacgtagtacgtacgacgtatanagacgacgtacgtacgacgtacgacgtacgtagtacgtacgtacgtacgtacgacgtacgtacgtacgtacgtacgacgacgtacgacgtacacgtacgtacgtacgtacgtacgtacgtacgacgtagtacgtacg

SEQ ID NO: 238842 - DNA, 887 bp, Homo sapiens
  misc_feature: GYAE6OF01C0EEQ.19.25.C03.1.454.CMB.1.raw
  modified_base (209)..(209): a, c, t, g, unknown or other
  misc_feature (209)..(209): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagactaccacgtggaagaaatagtgatgacgcagtctccagcccaccctgtctgtgtctccggaaggggaanacgcccaccctctccgtgcgacgggcctagtcgagtacgttgtacgcaacgactaacgttcgccgtaggtaccagacaaacgaaccgtcggacccgacggccctacccgaggcccttcccgtctaacttccgttagtcggtaccaccgtaccgtaccccgaaccggaccgggtaccctaacggttcggtaaccctccccgacggtacccggtaggtttaccgaggttcgggacggtaggggtcgggttacggtagggaactaggttaccgttaccgtaccttccgtaaccctaacccgtacgttcgaaccggccgtacccgtaccgtacgggtaaccgttacggtttaacggttaacggtttaaacgttttacgggtttttaccgtaaccgttttttaaacgtttttaacggtaccgtttacggtacccgtaaacgttaacggttaaacgtttaaacgttaaccctttaacgggttacccgtacccttaaccgggttaaccggttttaccggggtaccggggtaaccggggtaaaccgggtaaaccggggtaaaggggttaacggtaaacgttaaaccggttaaacccggtaaaacgggttaccggtacggggtttaacccgacggttaaccctaaaccgggaccttttacccggttccggtttaaccgtttaacccg

SEQ ID NO: 238843 - DNA, 396 bp, Homo sapiens
  misc_feature: GYAE6OF01C2NWZ.19.25.C03.1.454.CMB.1.raw
  modified_base (373)..(396): a, c, t, g, unknown or other
  misc_feature (373)..(396): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggccaccctcctccaagagcacctctgggggcacagcggcccctgggctggcctggtcaaggactacttcccacgagagtactgagcgggctggcaggcgcatagnnnnnnnnnnnnnnnnnnnnnnnn

SEQ ID NO: 238844 - DNA, 415 bp, Homo sapiens
  misc_feature: GYAE6OF01EIWDU.19.25.C03.1.454.CMB.1.raw
  modified_base (387)..(387): a, c, t, g, unknown or other
  misc_feature (387)..(387): n is a, c, g, or t
  modified_base (394)..(415): a, c, t, g, unknown or other
  misc_feature (394)..(415): n is a, c, g, or t
tcagtactctcgtgcacgaccggtgctcgatttagtagtgtagatttgggtttgggattcacgttgcagatgtaggtctgggtgcccaagctgctgaaggcctcggacaccgccatgtattactggtggccggggttagttggttatttgtacttactttgactacgtgggccagggaaccctggtcaccgtctcctcacgccctaccaccgaacgggcccagttccggttccttccccccgtggcccacccctccctaccaagacgacctaccgtcggtgggggccacgacggcccggcccgtgggcctcggtccgtggtacgaacggtacctacctacccgagaagtacgtacgtggacggcgggcgtcggacgaagggccgtanaagtgcnnnnnnnnnnnnnnnnnnnnnn

SEQ ID NO: 238845 - DNA, 501 bp, Homo sapiens
  misc_feature: GYAE6OF01C835A.19.25.C03.1.454.CMB.1.raw
  modified_base (316)..(316): a, c, t, g, unknown or other
  misc_feature (316)..(316): n is a, c, g, or t
  modified_base (452)..(452): a, c, t, g, unknown or other
  misc_feature (452)..(452): n is a, c, g, or t
  modified_base (455)..(501): a, c, t, g, unknown or other
  misc_feature (455)..(501): n is a, c, g, or t
tcagtactctcgtgcacgaccggtgctcgatttagtagtgtagattttgggtttgggtgcccaagctgctggagggcacggtcaccatctcagccgacaagtccatcagcaccgcctacctgcagtgagcagcctgaagcctcggacaccgccatgtattactgtggccgggtagtggttatttgtactactttgactacgtggggccagggaccctggtccaccgtctcctcagccctcccaaccaacgggcccctagtccggttcccttccccctggcctaccccctccctaccgaacgacgccacccgttcgngggggccacgaggccggcccctggggcctacggtccgtggtaccgaaaggtaaccctacccgtttaccccgagaaccggtacgtaaccgtggaacgggtccgggcgtccggacggtaaacggccgtacaagtagancgnnnnnnnnnnnnnnnnnnnnnnnnnnnnnnnnnnnnnnnnnnnnnnn

SEQ ID NO: 238846 - DNA, 646 bp, Homo sapiens
  misc_feature: GYAE6OF01EZ042.19.25.C03.1.454.CMB.1.raw
  modified_base (209)..(209): a, c, t, g, unknown or other
  misc_feature (209)..(209): n is a, c, g, or t
  modified_base (224)..(224): a, c, t, g, unknown or other
  misc_feature (224)..(224): n is a, c, g, or t
  modified_base (364)..(364): a, c, t, g, unknown or other
  misc_feature (364)..(364): n is a, c, g, or t
tcagtactctcgtgcacgaccggtgctcgatttagtagtgtagatttgggtttgggggaggaacgtgctcagttaggacccagacggaaccatggaagccccagcgcagcttctcttcctcctgctactctggctcccagataccactaggagaaatacgtgactgacgcagtctccgagccaccctgtctgtgtctccgaggggaacncgcccaccctctccngcagggccagtcagtgtgttagcagctaacttagccgtaggtaccagcaacgaaccgtggcccaaggcctccccgaggtccctccgtactactcgtagtggtacgaccactcccgaacgacgggccctacgtacggtacnccccagccgtaggttcaggtcgacaggtggtcgtgggacctaggacttcgacttccacaccatcgacgctagcctagcgtagtacgtagtattacgtttacgacttagttactacgtgtactagtacgtaagttaataacggttacgtacggttacctacgtacgttacggttacgggaccggacggtaacccggtagggtacggtaacgtaacgtaaccgtaaacgggtccgttagggtaccgtacgtaacggaccctaaccgtcttccgttacgttcccg

SEQ ID NO: 238847 - DNA, 696 bp, Homo sapiens
  misc_feature: GYAE6OF01C07T0.19.25.C03.1.454.CMB.1.raw
  modified_base (221)..(221): a, c, t, g, unknown or other
  misc_feature (221)..(221): n is a, c, g, or t
  modified_base (340)..(340): a, c, t, g, unknown or other
  misc_feature (340)..(340): n is a, c, g, or t
tcagtactctcgtgcacgaccggtgctcgatttagtagtgtagatttgggtttgggggaggaactgctcagttaggacccagacggaaccatggaacgccccagcgcagctttctcttcctcctgcttactctcggcctcccagactaccactggaagaaataggtgatgacgctagtcctccacgcccacctgtctgtcgtcctaccggaaggggaaacncgccctaccctctccgtgcgacgggcctagtcgaggtagtgtagcagacctaacgttcgcctaggtaaccagacgaaacggaaccgtcggacccgaggccctacccgacgtcctacctntacgtcgtagtcggtcacactcccgacggtacggacctacgtcgtacctcccgagtaccgtaggtcacggtcggacgtagggtcggtacgtacgggactacggttcgtaccgtaactcccgtaccaacctacgtacgaccgtccgtaccgtccgttagaccgttaacgttacgtaaggttaacgtttcgttttacggaacttttaacgtttacgttcgtacgtacgaacgttaactaaagttaacgttaaacggtcgtaccgtactacggtacgtttacgggtacgggacggtaacgggtacaggtagaacgtaacgagaaacgttgcgtacgcgtacacctattactgttcgtac

SEQ ID NO: 238848 - DNA, 831 bp, Homo sapiens
  misc_feature: GYAE6OF01CBSLS.19.25.C03.1.454.CMB.1.raw
  modified_base (208)..(208): a, c, t, g, unknown or other
  misc_feature (208)..(208): n is a, c, g, or t
  modified_base (393)..(393): a, c, t, g, unknown or other
  misc_feature (393)..(393): n is a, c, g, or t
tcagtactctcgtgcacgaccggtgctcgatttagtagtgtagatttgggtttgggggagaactgctcagttaggaccagacggaaccatggaacgccccagcgcagcttctcttcctctgctactctgcctccagactaccactaggagaaatgtgatcgacgcagtcctcagcccaccttgtctgtgtacctacggaaaggggaanacgtcccctaccgtctcccgagcgtacgggacctaggtacgtaggtacgttaggtacgacgtacgaaccttaacggtcgtccgtaaggtaaccagacaaaccgtaactcggaccgacggtccaacccggcgtccgttccctatacgttcttacggtcggacctacctacgtaccccgtaacgggnggttaccctaaggttaccggtacccttaccccggtaggaacccggtttaggttaaccggtagggtaccggttaacggtcgggggttaaggggtcccggttacggaaacggttccggtttaacctaccgttacgttacctaacccggtaccaacggtttcccgaacggtcctaaaccggtcttaccggtaaccgttaggttacgtaaacggtacgttttagtttacgaagttttaacgtttaacttcgtaacgttacgaacgtttaagtaaaccgtttaagtaaggttaacccgtcgttaccgtaacgttcggggttaaccgggtttagggaacccgggttaaggtaaacggggtacgggtaacggtaacgtaccggtaaacgggtaagttaccgggttgacgtccgtacctaaccgtgttaaccgttcttaccggtcg

SEQ ID NO: 238849 - DNA, 777 bp, Homo sapiens
  misc_feature: GYAE6OF01ECRHX.19.25.C03.1.454.CMB.1.raw
  modified_base (216)..(216): a, c, t, g, unknown or other
  misc_feature (216)..(216): n is a, c, g, or t
tcagtactctcgtgcacgaccggtgctcgatttagtagtgtagatttgggtttgggggaggaactgctcagttaggacccagacggaaccatggaacgccccagcgcagcttctcttcctcctgctactctggctccagactaccacgtggaagaaatagtgatgacgcagtcctccacgccctaccctgtctgtcgtctaccggaaggggaaacncgccctaccctcctcctgcgacgggcctagtcgagtagtagtagcgagtactaacgttcgccgttacggtaccacgacgaaacgaacccgtggacccgacggtcctacccgacggtcctacctacgtacgttacgtacgtcgggtcaccgtacgtaccccgtaccggaccggtacctacggttacggtaacctccccggtaacggtccgttaacggtcgaggtccggacgtagggttcggggtacgtacgggaacctacgggttacttaccgtccgtaccctaccgtaaccgtacgttaccgacgtaccgtaccggtaccgtacgtacggttacgttaccgtaaggttaacgtttacgtttacgttaacgttttaacgtttacgtttacgttacgtacgttaacgtaaccgttaagttaacgttaacgttaccggtaccggtaccttacgtacggttaccggttaccgggacgggtaaacgggaacggtagggtaacggtacgtaacgtaacggtaacgtaggtacggtcgtacgtcgacctacgttcttcgtcgttaccg

SEQ ID NO: 238850 - DNA, 770 bp, Homo sapiens
  misc_feature: GYAE6OF01B65PM.19.25.C03.1.454.CMB.1.raw
  modified_base (202)..(202): a, c, t, g, unknown or other
  misc_feature (202)..(202): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctccagataccactggagaaatagtgatgacgcagtctccagccacctgtctgtgtctccgaggggaaancgccacctctcctgcgagggccagtcagagtgtacgcagctaacgttagccgtaggtaccagtcgaacgaaacctggaccaggtcctcccgacggtccttccgtactagttctacgtcggtcgacctactacccgaccgacgggtccctacggttacggtacctccccgaggaccgtagggttccgacggttgggactaaggggttcggggttacgtacggggaacctaggtaacggtttccaaaccggtttcctaccctaaccgtactaccggtaaccgaccgtaacggtaccgttcggtaaccgttacggttaacgtaacggtaaacggtttagtttttcggtaaactttacggtttttaacttacgttcgttaacgtagttaacctaagttaacgtttaaacttaaccgggttcgtaccttaacgttaacggttaccgggtttacgggacgggttaaccgggaaacggttaggggtaacgtaacggtaacgttaacggaaaacggttcggttaacgggttccggtacgtaaccgtacgtaaccgttacgttccgttcgttacccg

SEQ ID NO: 238851 - DNA, 541 bp, Homo sapiens
  misc_feature: GYAE6OF01BUCFB.19.25.C03.1.454.CMB.1.raw
  modified_base (189)..(189): a, c, t, g, unknown or other
  misc_feature (189)..(189): n is a, c, g, or t
  modified_base (204)..(204): a, c, t, g, unknown or other
  misc_feature (204)..(204): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtntctccgaggggaaancgccaccctctcctgcgagggccagtcagagtgttagcagcaacttgctggaccngcagaaccnggccaggctcccagctcnatctanggtncatccaccnggccatgactccagccagtcagtgctgtggctgggacagnttcatctcactatcagcagcctgcngtctagtaagtnttttagcttaagtttcttactgttacagtacaagttataactacgtcggtacctacgtaagtaccgtttacggcgggtaacggacctaaagggtcggtaacgaacgttacgaaacggtacgtggtacggcgtacgacctaaccgtactcgtcgttaccc

SEQ ID NO: 238852 - DNA, 956 bp, Homo sapiens
  misc_feature: GYAE6OF01AT9RN.19.25.C03.1.454.CMB.1.raw
tcagtactctcgtgcacgaccggtgctcgatttagtagtgtagatttgggtttgggggaggaactgctcagttaggacccaggacggaaccatggaacgccccagcgcagcttctcttacctcctgcctactctggctcccagactaccactcgggagaaattacgtgatgacgcagtcctccacgtcctacccgtgtacttggtacgtcctaccggaagggggaaaactcggcccctacccttcgtcctacggccgaacgggggcccaggttccaggtagtttacgttaagcaacgtacctaaacgtttaggacccgttaggtaacccacggaccgtaaacgtaaacccggtccggacccgtaaccggtcccttaccccggaacggttccccttccgttaacctagtttacccgtaagttcgggttaccgaccgtaacccgtaccccgaaccggtaccggggaaccctacggtttaccgggaaccccttccccgtaaccgggtcccgttaaggggtttccaacgggtttcgggacccgtagggggttccggttcgggtaacggtacgtaacggtccgtttacgaccccgtttacgtacccaacggttacgtaccgggaacctcggtaaacccgggttcctacgggtaccgtaaaacggtttccgggtaaaggtttaaaaccgtttcggtttttaccggaaaacccgtttttaggttttaaacccggtttacggttaccggtaaccgttaacgtacggttaaactttaaaccgtaacggttaaccgtcccgggttaacttaccgggtaaacgttcccggttagggaaaccgggtaccggttaacgggtaaaggttccggggaaaactttaccgggaaacctaaaccgggtacgttagggtacccggtaacgtacccgtacttaaccgtttcgtaacccgtttcccgttaaacccgg

SEQ ID NO: 238853 - DNA, 559 bp, Homo sapiens
  misc_feature: GYAE6OF01C968E.19.25.C03.1.454.CMB.1.raw
  modified_base (137)..(137): a, c, t, g, unknown or other
  misc_feature (137)..(137): n is a, c, g, or t
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (471)..(471): a, c, t, g, unknown or other
  misc_feature (471)..(471): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (509)..(559): a, c, t, g, unknown or other
  misc_feature (509)..(559): n is a, c, g, or t
tcagtactctcgtgcacgaccggtgctcgatttagtagtgtagatttggggtttgggtgacccaagctgcgtgggagggcacggtcaccatctcaagccgacaagtccatcaagccaaccgccttacctgacgaggnggagcagtcctggaacgccgacgacacgtcattgtattacgtgggacgggccggggttattggtttattcgtaacttcgtttacgacgttacggtcgggggaccaaagggttaccctgggtacctaccgtccgttaccncgaacncccgtacaaccggtacggcctacgttccggttcccctcccctaggacccctaccgtacccgttaaccgaagtccgacctaacgttccgggacggggacaccgggacggcccggtacccggttagggccttcggtaccggtaggtaaccgaaaacggcctttaaccgacccgaaggacgtaacgtaacgnggaaggtcccggagcggtaacgacgcgaaanagancgnnnnnnnnnnnnnnnnnnnnnnnnnnnnnnnnnnnnnnnnnnnnnnnnnnn

SEQ ID NO: 238854 - DNA, 757 bp, Homo sapiens
  misc_feature: GYAE6OF01DGER8.19.25.C03.1.454.CMB.1.raw
  modified_base (208)..(208): a, c, t, g, unknown or other
  misc_feature (208)..(208): n is a, c, g, or t
tcagtactctcgtgcacgaccggtgctcgatttagtagtgtagatttggggtttgggggaggaactgctcagttaggacccagacggaaccatggaagccccagcgcagcttctcttcctcctgctactctggctcccagataccactggaagaaatagtgatgacgcagtctccagccaccctgtctgtcgtctaccgaggggaaanacgcccaccctctcctgacacgggccagtcgagagtgttagcagactaacttacgcctaggtaaccagtaccaacggtaaaacccgtcggaccctaagggccctacccgacgggtcccttacctaccgtacgttcttaaacggttcggggttcgacctaccttaccccgaacccggacggggtaccctacgttacggtaaccttccccgaacgtaccgtaggttcaaggtcggacgtaggtcgggtacggtagggaactacggtacgttaccacgttacctacctaaccgtacgtacgacgtacgaccgtccgtacgtaccgtaaggtctaacggtaagtttaccgtttttacggaacctttaggttttaacgttacgttctaacgttacggtaccttaagttaaacgttaaacgttaaccttcgggtaaccctttacgtacggtttacggtttacgggaccgggtaaacggttaccggaagggttaggacgtaacgtaacgaaccgtacgtggtcgtactccggtaactaccgtacttcgtcttaccg

SEQ ID NO: 238855 - DNA, 725 bp, Homo sapiens
  misc_feature: GYAE6OF01C51IP.19.25.C03.1.454.CMB.1.raw
  modified_base (203)..(203): a, c, t, g, unknown or other
  misc_feature (203)..(203): n is a, c, g, or t
  modified_base (484)..(484): a, c, t, g, unknown or other
  misc_feature (484)..(484): n is a, c, g, or t
tcagtactctcgtgcacgaccggtgctcgatttagtagtgtagatttgggtttgggggagaactgctcagttaggacccagacggaaccatggaagccccagcgcagcttctcttcctcctgctactctggctccagataccactggagaaatagtcgatgacgcagtctccagccacctgtctgtcgtctaccgaggggaanacgccaccctctccgtgcgagggcctagtcgagtagttgtagcagcaacgttagccttaggaacccagcaacggtaacctcggaccaaggcctcccgaggtcctcccgtagaacttcttaaggttgggacctaccgtaacgtccccgaaccggtcgggtaccctaagtcgggtaacctccccgtaggacccttagggtttacacggttcgggaacgtggggttacggggtacgtaggggtaacaacgggttcgtttccgaacctccggtacctaaaccgtnttaccgaacggcaaccgtcccgtagacctacggttacgtaagtaaacgttgttttacggactttacggtttaactcgtgtaacgactacgtaagttaactaacggttacgtcgtacctacgtacggttaccgttacggggagtaaccgggtaacgtagggttaagacgtaactaacggaaaccggttacgttcgggacgttaacggtacgtaccgaccttacgttcccgttggttaacccc

SEQ ID NO: 238856 - DNA, 679 bp, Homo sapiens
  misc_feature: GYAE6OF02IY67D.19.25.C03.1.454.CMB.1.raw
  modified_base (175)..(175): a, c, t, g, unknown or other
  misc_feature (175)..(175): n is a, c, g, or t
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (236)..(236): a, c, t, g, unknown or other
  misc_feature (236)..(236): n is a, c, g, or t
  modified_base (260)..(260): a, c, t, g, unknown or other
  misc_feature (260)..(260): n is a, c, g, or t
  modified_base (383)..(383): a, c, t, g, unknown or other
  misc_feature (383)..(383): n is a, c, g, or t
  modified_base (404)..(404): a, c, t, g, unknown or other
  misc_feature (404)..(404): n is a, c, g, or t
tcagtactctcgtgcacgaccggtgctcgatttagtagtgtagatttgggttgggaagaggaagactgacggtccccaggagttcaggtgctgggcacagcggcctgggctgcctggtcaaggctacttcccaggatagtactgacggcggtctcgacgaaggcgactagtagcntgctngngtctctgcgctcgcgtcgtgcgtgacngtcncgtgctcgtcgctacgctcgtancgtgcgtactgtccgagtacggtntccgtgttaccgacgtactggtaactcggtactaagccggtaataccgggttcaacggtcctaacggttacggtacctcggtaaccgtgttaacgcgtaacgtcgtagtaacgtcgtaaccgnggttaacgtcgtaacggttcncggttaacgtcgtacgtcggtttaccgaacggtcgtaaacgtcgtcggtaacgtcggttaacgtcgtaacgtcgtacgtaccgtacgtaccgtacgtacgtaacgttccgtacgtacggtacgtaaccgtcgtacgtacgtacgtacgtacgtacgtacgtacgacgttccgtacgtaccgtagtaccgtacgtacggtacggtcttacgggtacctacggttacgtacgtaccggttacgtaccggtacgtaccggttacgtacggttaaccgg

SEQ ID NO: 238857 - DNA, 171 bp, Homo sapiens
  misc_feature: GYAE6OF02HLJL6.19.25.C03.1.454.CMB.1.raw
  modified_base (171)..(171): a, c, t, g, unknown or other
  misc_feature (171)..(171): n is a, c, g, or t
tcagtactctcgtgcacgaccggtgctcgatttagtagtgtagatttgggtttggggaagaggaagactgacggtccccaggagttcaggtgctgggcacagcggccctgggctgcctggtcaaggactacttcccacgagagtactgagcgggctggcaaggcgcatagn

SEQ ID NO: 238858 - DNA, 345 bp, Homo sapiens
  misc_feature: GYAE6OF02HDO2C.19.25.C03.1.454.CMB.1.raw
  modified_base (344)..(345): a, c, t, g, unknown or other
  misc_feature (344)..(345): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctggggcacagcggccctgggctgcctggtcaaggactacttcccacgagagtactgagcgggctggcaaggcgcatagnn

SEQ ID NO: 238859 - DNA, 174 bp, Homo sapiens; identical to SEQ ID NO: 238749
  misc_feature: GYAE6OF02H4JSZ.19.25.C03.1.454.CMB.1.raw
  modified_base (173)..(174): a, c, t, g, unknown or other
  misc_feature (173)..(174): n is a, c, g, or t

SEQ ID NO: 238860 - DNA, 214 bp, Homo sapiens
  misc_feature: GYAE6OF02GSKUH.19.25.C03.1.454.CMB.1.raw
  modified_base (175)..(214): a, c, t, g, unknown or other
  misc_feature (175)..(214): n is a, c, g, or t
tcagtactctcgtgcacgaccggtgctcgatttagtagtgtagatttgggtttgggggaaggaggtaaggactgacggtcccccaggagttcaggtgctgggcacagcggcctgggctgcctggtcaaggctacttcccacgagagtactgagcgggctgggcaaggcgcatagnnnnnnnnnnnnnnnnnnnnnnnnnnnnnnnnnnnnnnnn

SEQ ID NO: 238861 - DNA, 173 bp, Homo sapiens; identical to SEQ ID NO: 238764
  misc_feature: GYAE6OF02I7A55.19.25.C03.1.454.CMB.1.raw
  modified_base (173)..(173): a, c, t, g, unknown or other
  misc_feature (173)..(173): n is a, c, g, or t

SEQ ID NO: 238862 - DNA, 173 bp, Homo sapiens; identical to SEQ ID NO: 238764
  misc_feature: GYAE6OF02HBC0C.19.25.C03.1.454.CMB.1.raw
  modified_base (173)..(173): a, c, t, g, unknown or other
  misc_feature (173)..(173): n is a, c, g, or t

SEQ ID NO: 238863 - DNA, 187 bp, Homo sapiens
  misc_feature: GYAE6OF02ITPFX.19.25.C03.1.454.CMB.1.raw
  modified_base (173)..(187): a, c, t, g, unknown or other
  misc_feature (173)..(187): n is a, c, g, or t
tcagtactctcgtgcacgaccggtgctcgatttagtagtgtagatttgggtttgggggaagaggaagactgacggtcccccaggagttcaggtgctgggcacagcggccctgggctgcctggtcaaggactacttcccacgagagtactgagcgggctggcaaggcgcatagnnnnnnnnnnnnnnn

SEQ ID NO: 238864 - DNA, 346 bp, Homo sapiens
  misc_feature: GYAE6OF02H1CIK.19.25.C03.1.454.CMB.1.raw
  modified_base (344)..(346): a, c, t, g, unknown or other
  misc_feature (344)..(346): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcgccctgctccaggagcacctccgagagcacagcggccctgggctgcctggtcaaggactacttcccacgaagtactgagcgggctggcaaggcgcatagnnn

SEQ ID NO: 238865 - DNA, 184 bp, Homo sapiens
  misc_feature: GYAE6OF02GGAX8.19.25.C03.1.454.CMB.1.raw
  modified_base (174)..(184): a, c, t, g, unknown or other
  misc_feature (174)..(184): n is a, c, g, or t
tcagtactctcgtgcacgaccggtgctcgatttagtagtgtagatttgggtttgggggaagaggaagactgacggtcccccaggagttcaggtgctgggcacagcggccctgggctgcctggtcaaggactacttcccacgagagtactgagcgggcttggcaaggcgcatagnnnnnnnnnnn

SEQ ID NO: 238866 - DNA, 180 bp, Homo sapiens
  misc_feature: GYAE6OF02HSDRP.19.25.C03.1.454.CMB.1.raw
  modified_base (173)..(180): a, c, t, g, unknown or other
  misc_feature (173)..(180): n is a, c, g, or t
tcagtactctcgtgcacgaccggtgctcgatttagtagtgtagatttgggtttgggggaagaggaagactgacggtcccccaggagttcaggtgctgggcacagcggccctgggctgcctggtcaaggactacttcccacgagagtactgagcgggctggcaaggcgcatagnnnnnnnn

SEQ ID NO: 238867 - DNA, 346 bp, Homo sapiens
  misc_feature: GYAE6OF02IG39C.19.25.C03.1.454.CMB.1.raw
  modified_base (342)..(346): a, c, t, g, unknown or other
  misc_feature (342)..(346): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttattgtactactttgactactggggccagggaaccctggtcaccgtctcctcagcctccaccaagggcccatcggtcttccccctggcaccctcctccaagagcacctctggggcacagcggccctgggctgcctggtcaaggactacttcccacgagagtactgagcgggctggcaaggcgcatagnnnnn

SEQ ID NO: 238868 - DNA, 348 bp, Homo sapiens
  misc_feature: GYAE6OF02JX04S.19.25.C03.1.454.CMB.1.raw
  modified_base (343)..(348): a, c, t, g, unknown or other
  misc_feature (343)..(348): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctggggcacagcggccctgggctgcctggtcaaggctacttcccacgagagtactgagcgggctggcaaggcgcatagnnnnnn

SEQ ID NO: 238869 - DNA, 129 bp, Homo sapiens
  misc_feature: GYAE6OF02GQHAX.19.25.C03.1.454.CMB.1.raw
  modified_base (129)..(129): a, c, t, g, unknown or other
  misc_feature (129)..(129): n is a, c, g, or t
tcagtactctcgtgcacgaccggtgctcgatttagtagtgtagatttgggtttgggcacagcggccctgggctgcctggtcaaggactacttcccacgagagactgagcgggctggcaaggcgcatagn

SEQ ID NO: 238870 - DNA, 502 bp, Homo sapiens
  misc_feature: GYAE6OF02ILSAK.19.25.C03.1.454.CMB.1.raw
  modified_base (203)..(203): a, c, t, g, unknown or other
  misc_feature (203)..(203): n is a, c, g, or t
  modified_base (438)..(438): a, c, t, g, unknown or other
  misc_feature (438)..(438): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccagggccactggtatcccagccaggtcagtggcagtggtctgggacagagttcactctcaccatcagcagcctgcagtctgaagtattttgctagttttattacttgtcagctagtataataactgcctnagtactttcggacggaggaccagggtaggagaatacaaacgaactgtaggctgcaccatctgtc

SEQ ID NO: 238871 - DNA, 523 bp, Homo sapiens
  misc_feature: GYAE6OF02HA59Z.19.25.C03.1.454.CMB.1.raw
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtactcccagccaggttcagtggcaggtgggtctgggacaggagttcactctcaccatcagcagcctgcagtctgaagtatttgctagttttattactgtcagtctagttataataactcggtcctacagtacgtttcggacggtagggaccgtagggtggaagagtacgaaacgaacgttgtggctggaccacgtatctgtcc

SEQ ID NO: 238872 - DNA, 567 bp, Homo sapiens
  misc_feature: GYAE6OF02HDLDF.19.25.C03.1.454.CMB.1.raw
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaagagccacctctcctgcagggccagtcagagtgttagcagcaacttagcctggtaccagcagaaacctggccaggctcccaggctcctcatctatggtgcatcccaccgagggccacgtggtactcccagccaggttcagtgcagtgggtctgggacaggagttcactctcacatcacgcacgcctgcagtctagaagtatttgcttagtttattacttgtctagtctagtaattaactaacgtcggtaccttacgaacgtacgtttacggacgggtaaggggaccgtaagggtaggtacggtaacgtaccgaaacgtaaccgtaggtacggtcgtacggaccgtaacccgtagttcctcggttacc

SEQ ID NO: 238873 - DNA, 377 bp, Homo sapiens
  misc_feature: GYAE6OF02JXYCL.19.25.C03.1.454.CMB.1.raw
  modified_base (369)..(377): a, c, t, g, unknown or other
  misc_feature (369)..(377): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggtgccagggaaccctggtcaccgtctcctcagcctccaccaagggcccatcggtcttccccctggcacctcctccaagagcacctctggggcacagcggccctgggctgcctggtcaaggactacttcccacgagagtactgagcgggctggcaaggcgcatagnnnnnnnnn

SEQ ID NO: 238874 - DNA, 529 bp, Homo sapiens
  misc_feature: GYAE6OF02JAQ21.19.25.C03.1.454.CMB.1.raw
  modified_base (206)..(206): a, c, t, g, unknown or other
  misc_feature (206)..(206): n is a, c, g, or t
  modified_base (380)..(380): a, c, t, g, unknown or other
  misc_feature (380)..(380): n is a, c, g, or t
tcagtactctcgtgcacgaccggtgctcgatttagtagtgtagatttgggtttgggggtagggaacgtgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttgcctggtaccagcagaaacctggccaggctcccaggcctcctcatctatggtgcatcccaccgagggcccatggtactccccagcccaggttcagtggctaggtgggtctgggacaggagttcacttcnccaccatcagcagcctgcagtctagaagtattttgcttagtttacttactgtcagctaagtataaatactggcctagacgtacgttcggacggagggaccaggtggagctacaaacgtacgtgtaggctcgacaccgtattcgtagttc

SEQ ID NO: 238875 - DNA, 395 bp, Homo sapiens
  misc_feature: GYAE6OF02F8XH8.19.25.C03.1.454.CMB.1.raw
  modified_base (367)..(367): a, c, t, g, unknown or other
  misc_feature (367)..(367): n is a, c, g, or t
  modified_base (373)..(395): a, c, t, g, unknown or other
  misc_feature (373)..(395): n is a, c, g, or t
tcagtactctcgtgcacgaccggtgctcgatttagtagtgtagatttgggtttgggtgcccaagctgctggagggcacggtcaccatctcagccgacaagtccatcagtcaccgcctacctgcagtggagcagcctgaaggcctcggacaccgccatgtattactgtggccggggtagtggttatttgtactactttgactacctggggccagggtaaccctggtcaccgtctcctcagcctccaccaaggcccatcggtcttccccctggcaccctcctccaagagcacctctgggggcacagcggccctgggctgccgtggtcaaggactacttcccacgagagtactgagcggctggcaaggcncatagnnnnnnnnnnnnnnnnnnnnnnn

SEQ ID NO: 238876 - DNA, 205 bp, Homo sapiens
  misc_feature: GYAE6OF02FXBHO.19.25.C03.1.454.CMB.1.raw
  modified_base (174)..(205): a, c, t, g, unknown or other
  misc_feature (174)..(205): n is a, c, g, or t
tcagtactctcgtgcacgaccggtgctcgatttagtagtgtagatttgggtttgggggaagaggaagactgacggtcccccaggagttcaggtgctgggcacagcggccctgggctgccctggtcaaggactacttcccacgagagtactgagcgggctggcaaggcgcatagnnnnnnnnnnnnnnnnnnnnnnnnnnnnnnnn

SEQ ID NO: 238877 - DNA, 209 bp, Homo sapiens
  misc_feature: GYAE6OF02IOD5C.19.25.C03.1.454.CMB.1.raw
  modified_base (176)..(209): a, c, t, g, unknown or other
  misc_feature (176)..(209): n is a, c, g, or t
tcagtactctcgtgcacgaccggtgctcgatttagtagtgtagatttgggtttggggggaagaggaagactgacggtcccccaggagttcaggtgctgggcacagcggccctgggctgccctggtcaaggactacttcccacgacgagtactgagcgggctggcaaggcgcatagnnnnnnnnnnnnnnnnnnnnnnnnnnnnnnnnnn

SEQ ID NO: 238878 - DNA, 375 bp, Homo sapiens; identical to SEQ ID NO: 238797
  misc_feature: GYAE6OF02H84YX.19.25.C03.1.454.CMB.1.raw
  modified_base (371)..(375): a, c, t, g, unknown or other
  misc_feature (371)..(375): n is a, c, g, or t

SEQ ID NO: 238879 - DNA, 632 bp, Homo sapiens
  misc_feature: GYAE6OF02IYOP1.19.25.C03.1.454.CMB.1.raw
  modified_base (203)..(203): a, c, t, g, unknown or other
  misc_feature (203)..(203): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggcctcccaggcctcctcatctagtggtgcatcccaccagggcccacgtggtactcccagccaggttcagtggcaggtgggtctgggacaggattcactctcaccatcagcacgtcctgcagtctaggaattatttcgacttagttttatacgttgtactagactaagttaacttaagtaacgtcggtaccttagtaacggttaccggtttaccgggacggggtaacggggtaacccgtaaggggttacgggtaacggtaacgttaaacccggtaaaaccggtaacggttacgggttacgggtaccgttaccgggtaacccgtaaccgttaccgtttaccggtttaccgtttacccg

SEQ ID NO: 238880 - DNA, 507 bp, Homo sapiens
  misc_feature: GYAE6OF02HZ09C.19.25.C03.1.454.CMB.1.raw
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (325)..(325): a, c, t, g, unknown or other
  misc_feature (325)..(325): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagccttgtaccagcaagaaacctggccaggctcccaggctcctnatctatggtncatccaccagggccactggtacncccagccaggttcagtggcaggtgggtctgggacaggagttcactctcaccatcagcacgcctgcagtctagaagtattttgctagtttattactgtcagcagtaataataacgtgcctcagtacttcggcgagggacgaggtggagagtacgaaacgactgtcgcgtcgacacgatctgtc

SEQ ID NO: 238881 - DNA, 378 bp, Homo sapiens
  misc_feature: GYAE6OF02HROMB.19.25.C03.1.454.CMB.1.raw
  modified_base (371)..(378): a, c, t, g, unknown or other
  misc_feature (371)..(378): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnnnnnnn

SEQ ID NO: 238882 - DNA, 350 bp, Homo sapiens
  misc_feature: GYAE6OF02GGGHC.19.25.C03.1.454.CMB.1.raw
  modified_base (346)..(350): a, c, t, g, unknown or other
  misc_feature (346)..(350): n is a, c, g, or t
tcagtactctcgtgcacgaccggtgctcgatttagtagtgtagatttgggtttgggtggcccaagctgctggacgggcacggtcgacctacgctgtctgtagggagtagagtcctgaaggcctcggacaccgccatgtattactgtggccgggtagtggttatttgtactactttgactactgggccagggaaccctggtcaccgtctcctcagcctccaccaagggcccatcgtcttccccctggcaccctcctccaagagcacctctggggcacagcggccctgggctgcctggtcaaggactacttcccacgagagtactgagcggctggcaaggcgcatagnnnnn

SEQ ID NO: 238883 - DNA, 348 bp, Homo sapiens
  misc_feature: GYAE6OF02ITCVR.19.25.C03.1.454.CMB.1.raw
  modified_base (343)..(348): a, c, t, g, unknown or other
  misc_feature (343)..(348): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactggggccagggaaccctggtcaccgtctcctcagcctccaccaagggcccatcggtcttccccctggcaccctcctccaagagcacctctggggcacagcggccctgggctgcctggtcaaggactacttcccacgagagtactgagcgggctggcaaggcgcatagnnnnnn

SEQ ID NO: 238884 - DNA, 376 bp, Homo sapiens
  misc_feature: GYAE6OF02J21SO.19.25.C03.1.454.CMB.1.raw
  modified_base (370)..(376): a, c, t, g, unknown or other
  misc_feature (370)..(376): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccgggtagtggttattgtactactttgactactggggccagggaaccctggtcaccgtctcctcagcctccaccaagggcccatcggtcttccccctggcacccctcctccaagagcacctctgggggcacagcggccctgggctgcctggtcaaggactacttcccacgagagtactgagcgggctggcaaggcgcatagnnnnnnn

SEQ ID NO: 238885 - DNA, 173 bp, Homo sapiens; identical to SEQ ID NO: 238764
  misc_feature: GYAE6OF02IKDCK.19.25.C03.1.454.CMB.1.raw
  modified_base (173)..(173): a, c, t, g, unknown or other
  misc_feature (173)..(173): n is a, c, g, or t

SEQ ID NO: 238886 - DNA, 506 bp, Homo sapiens
  misc_feature: GYAE6OF02HS6YE.19.25.C03.1.454.CMB.1.raw
  modified_base (361)..(361): a, c, t, g, unknown or other
  misc_feature (361)..(361): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccagggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcaggtgggtctgggacagngttcactctcaccatcagcagcctgcagtctgagtatttgctagttttattacttgtcagtcagtataatacgtgcctcacgtcgtttcggcggtacggacgagggtggagagtacgaaacgactgtgctgccacgtatcgtgtc

SEQ ID NO: 238887 - DNA, 386 bp, Homo sapiens
  misc_feature: GYAE6OF02GJQ7F.19.25.C03.1.454.CMB.1.raw
  modified_base (372)..(386): a, c, t, g, unknown or other
  misc_feature (372)..(386): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggtgccagggaaccctggtcaccgtctcctcagcctccaccaaggcccatcggtcttccccctggcaccctcctccaagagcacctctgggggcacagcggccctgggctgcctggtcaaggactacttcccacgacgagtactgagcgggctggcaaggcgcagtagnnnnnnnnnnnnnnn

SEQ ID NO: 238888 - DNA, 347 bp, Homo sapiens
  misc_feature: GYAE6OF02IWPGB.19.25.C03.1.454.CMB.1.raw
  modified_base (344)..(347): a, c, t, g, unknown or other
  misc_feature (344)..(347): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctggggcacagcggccctgggctgcctggtcaaggactacttcccacgagagtactgagcgggctggcaaggcgcatagnnnn

SEQ ID NO: 238889 - DNA, 345 bp, Homo sapiens
  misc_feature: GYAE6OF02IJ0IP.19.25.C03.1.454.CMB.1.raw
  modified_base (344)..(345): a, c, t, g, unknown or other
  misc_feature (344)..(345): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccatggaaccctggtcaccgtctcctcagcctccaccaagggcccatcggtcttcccctggcaccctcctccaagagcacctctgggggcacagcggccctgggctgcctggtcaaggactacttcccacgagagtactgagcgggctggcaaggcgcatagnn

SEQ ID NO: 238890 - DNA, 341 bp, Homo sapiens
  misc_feature: GYAE6OF02FMH35.19.25.C03.1.454.CMB.1.raw
  modified_base (341)..(341): a, c, t, g, unknown or other
  misc_feature (341)..(341): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactgggccaggaaccctggtcaccgtctcctcagcctccaccaagggcccatcggtccttcccctggcaccctcctccaagagcacctctggggcacagcggccctgggctgcctggtcaaggactacttcccacgagagtactgagcgggctggcaaggcgcatagn

SEQ ID NO: 238891 - DNA, 503 bp, Homo sapiens
  misc_feature: GYAE6OF02HKMHB.19.25.C03.1.454.CMB.1.raw
  modified_base (395)..(395): a, c, t, g, unknown or other
  misc_feature (395)..(395): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccccttctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtgcagtgggtctgggacagagttcactctcacatcagcagcctgcagtctagaagtntttgactagtttattactgtcagctagtataataactgcctacagtacgtttcggcggagggaccgaggtggagagtacgaacgacgtgtaggctgcacatctgtctc

SEQ ID NO: 238892 - DNA, 513 bp, Homo sapiens
  misc_feature: GYAE6OF02IVFPN.19.25.C03.1.454.CMB.1.raw
  modified_base (203)..(203): a, c, t, g, unknown or other
  misc_feature (203)..(203): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccagggccactggtactcccgagccgaggttcaggtgcaggtggtctgggacagagttcactctcaccatcacgcacgcctgcagtctagtaacgtattttgacttagtttattactgtacagctagtataatacgtgtactcagtacttcggcggacggacaggtggagtagtacaaacgacgtgtcgctgacaccattctgttc

SEQ ID NO: 238893 - DNA, 448 bp, Homo sapiens
  misc_feature: GYAE6OF02H17BP.19.25.C03.1.454.CMB.1.raw
  modified_base (440)..(448): a, c, t, g, unknown or other
  misc_feature (440)..(448): n is a, c, g, or t
tcagtactctcgtgcacgaccggtgctcgatttagtagtgtagatttgggtttgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnnnnnnnn

SEQ ID NO: 238894 - DNA, 369 bp, Homo sapiens
  misc_feature: GYAE6OF02HX2M6.19.25.C03.1.454.CMB.1.raw
  modified_base (346)..(369): a, c, t, g, unknown or other
  misc_feature (346)..(369): n is a, c, g, or t
tcagtactctcgtgcacgaccggtgctcgatttagtagtgtagatttgggtttgggtgcccgaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctggggcacagcggccctgggctgcctggtcaaggactacttcccacgagagtaactgagcgggctggcaaggcgcatagnnnnnnnnnnnnnnnnnnnnnnnn

SEQ ID NO: 238895 - DNA, 382 bp, Homo sapiens
  misc_feature: GYAE6OF02IPHLY.19.25.C03.1.454.CMB.1.raw
  modified_base (371)..(382): a, c, t, g, unknown or other
  misc_feature (371)..(382): n is a, c, g, or t
tcagtactctcgtgcacgaccggtgctcgatttagtagtgtagatttgggtttgggtgcccgaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggcctgggctgcctggtcaaggactacttcccacgagagtactgagcgggctggcaaggcgcatagnnnnnnnnnnnn

SEQ ID NO: 238896 - DNA, 521 bp, Homo sapiens
  misc_feature: GYAE6OF02I20KK.19.25.C03.1.454.CMB.1.raw
  modified_base (203)..(203): a, c, t, g, unknown or other
  misc_feature (203)..(203): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccgagggcccactggtactcccagcctaggttcaggtggcaggtgggtctgggacagagttcactctcaccatcagcagcctgcagtctagaagtatttgacttagtttattactgtcagtctagtataatacgtgcctcgagtacgttcggacggagggaccgagggtggagagtaccgaacgtaacgtggtaggtctcgccacagtctgtcc

SEQ ID NO: 238897 - DNA, 592 bp, Homo sapiens
  misc_feature: GYAE6OF02GBG2R.19.25.C03.1.454.CMB.1.raw
  modified_base (204)..(204): a, c, t, g, unknown or other
  misc_feature (204)..(204): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccagggggaaangccaccctctcctgcagggccagtcagagtgttagcagcaacttagcctggtaccagcagaaacctggccaggctcccaggctcctcatctagtggtgcatccaccagggcccatggtactcccagccaggttcagtggcagtggtctgggacagagttcactctcaccatcagcagcctgcagtctgaagtattttgcttagtttattacttgtcagtctagttaataaacttaacgtcggtacccttcgtaacgtaccgttttccgggacgggtaacggggacccgtaaggggtacgggaagtaacgtaaccgtaaaaccggtaaaccgttagggttacgggtccgttacggaccgtaacccgtacgttaccgttacggtttaccc

SEQ ID NO: 238898 - DNA, 375 bp, Homo sapiens
  misc_feature: GYAE6OF02G6GQU.19.25.C03.1.454.CMB.1.raw
  modified_base (370)..(375): a, c, t, g, unknown or other
  misc_feature (370)..(375): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggctacttcccacgagagtactgagcgggctggcaaggcgcatagnnnnnn

SEQ ID NO: 238899 - DNA, 375 bp, Homo sapiens
  misc_feature: GYAE6OF02GUQPR.19.25.C03.1.454.CMB.1.raw
  modified_base (369)..(375): a, c, t, g, unknown or other
  misc_feature (369)..(375): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttccacaagagtactgagcgggctggcaggcgcatagnnnnnnn

SEQ ID NO: 238900 - DNA, 629 bp, Homo sapiens
  misc_feature: GYAE6OF02H8H4L.19.25.C03.1.454.CMB.1.raw
  modified_base (354)..(354): a, c, t, g, unknown or other
  misc_feature (354)..(354): n is a, c, g, or t
  modified_base (392)..(392): a, c, t, g, unknown or other
  misc_feature (392)..(392): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccagggaagagccacctctcctgcagggccacgtcagagtgttagcagacaacttagctcggtacagcagaaacctggcagctcccaggctcctcatctatggtgcatccaccagggccatggatcccagccaggttcagtggcaggtgggtctgggacagngttcactctcacatcagcacgcctgcagtctgaaagtnttttgactaggttttattacgtgttacaggacctaaggtttactaaaataaccgttaggggtccctactaacggttacccgtttttcggggaaccggggtaacggggtaacccgtaacggggttaagggtacgggtaaacttaacccggtaaaaaccggtaaccggttaaggttccggggtaaccgttacgggaacccctaaccccgtaagtttaccgtttaccggttttaacccgg

SEQ ID NO: 238901 - DNA, 620 bp, Homo sapiens
  misc_feature: GYAE6OF02HSJ6H.19.25.C03.1.454.CMB.1.raw
  modified_base (217)..(217): a, c, t, g, unknown or other
  misc_feature (217)..(217): n is a, c, g, or t
tcagtactctcgtgcacgaccggtgctcgatttagtagtgtagatttgggttgggggaggaactgcctcagttagggacccagacggaaccatgggaagcccagcggccagcttctcttcctccgtgcctactctggctcccaggatacccacgtggacgaaatagtgatgacgcagtctcccagccaccctgtcctgtcgtctccaggggtaaacngccgacctctcctgcacgggccagttcaggacgtgttacgacagtcaacttaggcctggtaccagcagaacctggaccagggactccccaggcctcctcatctatggtcgcattccaccagggccgactggtactacccgtagccgaggttcaaggttcgggactaggttgggggtactaggggactaggtacgtttcacctacgtactaaccgatacgacgtcgacgcctcgctagtctagtagtactttagtcttagtttatacttagtactagtactagttataatacgtcggacctacgacgtacggttcggaacggtacggaccgtaaggttggaacgacgtacgaaacggtaactacggtacgtacgttacgtacctacctacgttacctcgttacc

SEQ ID NO: 238902 - DNA, 568 bp, Homo sapiens
  misc_feature: GYAE6OF02F4VCC.19.25.C03.1.454.CMB.1.raw
  modified_base (300)..(300): a, c, t, g, unknown or other
  misc_feature (300)..(300): n is a, c, g, or t
  modified_base (382)..(382): a, c, t, g, unknown or other
  misc_feature (382)..(382): n is a, c, g, or t
  modified_base (397)..(397): a, c, t, g, unknown or other
  misc_feature (397)..(397): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatcatggtncatccacagggccactggtactcccagccaggttcagtggcaggtgggctgggacagagttcactctcaccatcagcagccngcagtcgtagaagtnttttcgacttaagttttattacgtgtacagctaagtataacgttactcgggtacctcgtaagtccgtttcgggacgggtaacgggaaccaggggttcggaagtaactaccgaaacggtaacgttcggtacggtaccttgggaccctaaccgtacgttcgttacggttaccg

SEQ ID NO: 238903 - DNA, 367 bp, Homo sapiens
  misc_feature: GYAE6OF02FIYOQ.19.25.C03.1.454.CMB.1.raw
  modified_base (345)..(367): a, c, t, g, unknown or other
  misc_feature (345)..(367): n is a, c, g, or t
tcagtactctcgtgcacgaccggtgctcgatttagtagtgtagatttgggtttgggtgcccgaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctggggcacagcggccctgggctgcctggtcaaggactacttcccacgagagtactgagcgggctggcaaggcgcatagnnnnnnnnnnnnnnnnnnnnnnn

SEQ ID NO: 238904 - DNA, 587 bp, Homo sapiens
  misc_feature: GYAE6OF02JBU7S.19.25.C03.1.454.CMB.1.raw
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagcccaccctctcctgcagggccagtcagagtgttagcagcaacttagcctggtaccagcagaacctggccaggcctcccaggcctcctcactctatggtgcactccaccgagggccacgtggtactccccagccaggttcaggtggctaggtcgggtcgtgggacaggtagttcactcctacaccatcagcacgcctgcagtctagtagtatttgcttagtttattacgtgtactaagtattatagtagtcgtacgtcctaccgttccggttgggtacgtacgtacgtttcggaccggtacggggtaccgtaagggttacgtaacggtaaccgtaaaccggtaacgttacggtacggtacgtacggacctaccgtattaccg

SEQ ID NO: 238905 - DNA, 360 bp, Homo sapiens
  misc_feature: GYAE6OF02FJ0OZ.19.25.C03.1.454.CMB.1.raw
  modified_base (354)..(360): a, c, t, g, unknown or other
  misc_feature (354)..(360): n is a, c, g, or t
tcagtactctcgtgcacgaccggtgctcgatttagtagtgtagatttgggtttgggcccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttccccacgagagtactgagcgggctggcaaggcgcatagnnnnnnn

SEQ ID NO: 238906 - DNA, 362 bp, Homo sapiens
  misc_feature: GYAE6OF02I88PV.19.25.C03.1.454.CMB.1.raw
  modified_base (356)..(362): a, c, t, g, unknown or other
  misc_feature (356)..(362): n is a, c, g, or t
tcagtactctcgtgcacgaccggtgctcgatttagtagtgtagatttgggtttgggcccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttcccccctggccaccctcctccaagacgcacctctgggggcacagcggccctgggctgcctggtcaaggactacttcccacgagagtactgagcgggctggcaaggcgcatagnnnnnnn

SEQ ID NO: 238907 - DNA, 587 bp, Homo sapiens
  misc_feature: GYAE6OF02IC28W.19.25.C03.1.454.CMB.1.raw
  modified_base (205)..(205): a, c, t, g, unknown or other
  misc_feature (205)..(205): n is a, c, g, or t
  modified_base (297)..(297): a, c, t, g, unknown or other
  misc_feature (297)..(297): n is a, c, g, or t
tcagtactctcgtgcacgaccggtgctcgatttagtagtgtagattttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgttagcagcaattgcctggtaccagcagaacctggccaggcctccaggctctcatctatggtncatccaccgagggcctacgtggtactccccgagccgtaggttcaggtcggacaggtgggtctagggacaggtcgttccacgttctacaacctatcagcacgctgcagtctagaatgttttgacttagtttattactgtacagtctaagttaataaacgttacgtacggtacctacgtacgttacgtttcgggaccggaagggtaccgtaagggtaggtaagtaacgttaaccgaaaacggtaacgttaggtcggtactacggacctaaccgtacgttaccgttcgttacc

SEQ ID NO: 238908 - DNA, 377 bp, Homo sapiens
  misc_feature: GYAE6OF02JF57E.19.25.C03.1.454.CMB.1.raw
  modified_base (372)..(377): a, c, t, g, unknown or other
  misc_feature (372)..(377): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggccaccctcctccaagagcacctctgggggcacagcggccctgggctgcctggtcaaggactacttcccacgagagtactgagcgggctggcaaggcgcatagnnnnnn

SEQ ID NO: 238909 - DNA, 383 bp, Homo sapiens
  misc_feature: GYAE6OF02HY8LQ.19.25.C03.1.454.CMB.1.raw
  modified_base (377)..(383): a, c, t, g, unknown or other
  misc_feature (377)..(383): n is a, c, g, or t
tcagtactctcgtgcacgaccggtgctcgatttagtagtgtagatttgggtttgggtgccccaagcttctggagggcacggtcaccatctcagccgacaagtccatcagcaccgccctaccctgcagtggagcagcctgaaggcctcggacaccgccatgtattactgtggccggggtagtggttatttgtactactttgactactggggccagggaaccctggtcaccgtctcctcagcctccaccaagggccccatcggtcttccccctggcaccctcctccaagagcacctctgggggcacagcggccctgggctgcctggtcaaggactacttccccacgagagtactgagcggggctggcaaggcgcatagnnnnnnn

SEQ ID NO: 238910 - DNA, 358 bp, Homo sapiens
  misc_feature: GYAE6OF02F7OQD.19.25.C03.1.454.CMB.1.raw
  modified_base (352)..(358): a, c, t, g, unknown or other
  misc_feature (352)..(358): n is a, c, g, or t
tcagtactctcgtgcacgaccggtgctcgatttagtagtgtagatttgggtttgggcccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctggggcacagcggccctgggctgcctggtcaaggactacttcccacgagagtactgagcgggctggcaaggcgcatagnnnnnnn

SEQ ID NO: 238911 - DNA, 366 bp, Homo sapiens
  misc_feature: GYAE6OF02JLQ0R.19.25.C03.1.454.CMB.1.raw
  modified_base (344)..(366): a, c, t, g, unknown or other
  misc_feature (344)..(366): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagacgcacctctggggcacagcggccctgggctgcctggtcaaggactacttcccagagagtactgagcgggctggcaaggcgcatagnnnnnnnnnnnnnnnnnnnnnnn

SEQ ID NO: 238912 - DNA, 347 bp, Homo sapiens; identical to SEQ ID NO: 238888
  misc_feature: GYAE6OF02F40O4.19.25.C03.1.454.CMB.1.raw
  modified_base (344)..(347): a, c, t, g, unknown or other
  misc_feature (344)..(347): n is a, c, g, or t

SEQ ID NO: 238913 - DNA, 377 bp, Homo sapiens
  misc_feature: GYAE6OF02G2DWO.19.25.C03.1.454.CMB.1.raw
  modified_base (370)..(377): a, c, t, g, unknown or other
  misc_feature (370)..(377): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggctacttcccacgagagtactgagcgggctggcaaggcgcatagnnnnnnnn

SEQ ID NO: 238914 - DNA, 173 bp, Homo sapiens; identical to SEQ ID NO: 238764
  misc_feature: GYAE6OF02H7NTM.19.25.C03.1.454.CMB.1.raw
  modified_base (173)..(173): a, c, t, g, unknown or other
  misc_feature (173)..(173): n is a, c, g, or t

SEQ ID NO: 238915 - DNA, 351 bp, Homo sapiens
  misc_feature: GYAE6OF02I224S.19.25.C03.1.454.CMB.1.raw
  modified_base (346)..(351): a, c, t, g, unknown or other
  misc_feature (346)..(351): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtccttccccctggccaccctcctccaagagcacctcgtggggcacagcggccctgggctgcctggtcaaggactactcccacgagagtactgaggcggctggcaaggcgcatagnnnnnn

SEQ ID NO: 238916 - DNA, 387 bp, Homo sapiens
  misc_feature: GYAE6OF02GGOWX.19.25.C03.1.454.CMB.1.raw
  modified_base (375)..(387): a, c, t, g, unknown or other
  misc_feature (375)..(387): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatccggtcttccccctggccacccctcctccaagagcacctcgtgggggcacagcggccctgggctgcctggtcaaggactacttcccacgagagtactgagcggctggacaaggcgcatagnnnnnnnnnnnnn

SEQ ID NO: 238917 - DNA, 179 bp, Homo sapiens
  misc_feature: GYAE6OF02GM722.19.25.C03.1.454.CMB.1.raw
  modified_base (135)..(179): a, c, t, g, unknown or other
  misc_feature (135)..(179): n is a, c, g, or t
tcagtactctcgtgcacgaccggtgctcgatttagtagtgtagatttgggtttgggcacagcggccctgggctgcctggtcaaggtactacgttcccacgagagtactgagccgggctgggcaaggcgcactagnnnnnnnnnnnnnnnnnnnnnnnnnnnnnnnnnnnnnnnnnnnnn

SEQ ID NO: 238918 - DNA, 208 bp, Homo sapiens
  misc_feature: GYAE6OF02F07TU.19.25.C03.1.454.CMB.1.raw
  modified_base (180)..(208): a, c, t, g, unknown or other
  misc_feature (180)..(208): n is a, c, g, or t
tcagtactctcgtgcacgaccggtgctcgatttagtagtgtagatttgggtttgggggggaagagggaagactgacggtccccccaggagttcaggtgctgggcacagcggccctgggctgccctggtcaaggactacgttcccacgagagtacctgagcgggctggcaaggcgcatagnnnnnnnnnnnnnnnnnnnnnnnnnnnnn

SEQ ID NO: 238919 - DNA, 411 bp, Homo sapiens
  misc_feature: GYAE6OF02JAX85.19.25.C03.1.454.CMB.1.raw
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
  modified_base (391)..(391): a, c, t, g, unknown or other
  misc_feature (391)..(391): n is a, c, g, or t
  modified_base (399)..(411): a, c, t, g, unknown or other
  misc_feature (399)..(411): n is a, c, g, or t
tcagtactctcgtgcacgaccggtgctcgatttagtagtgtagatttggtttgggtgcccaagctgctggagggcgacggtcaccatctcagccgacaagtccatcagcaccgcctacctgcagtggagcagcctgaagcctcggacaccgccatgtattactgtggccggggtagtggttatttgtactactttgactactggggccagggaaccctggtcaccgtctcctcagcctccaccaacgggcccatcgggtccttccccctggcgccctgcctccgaggngccaccgtccgagacnctacaggccggccccgtgggacctgccgtagggtccaagggcctacctccacgagacgttactgacgtcgggctgggacaacgggcncgatacgnnnnnnnnnnnnn

SEQ ID NO: 238920 - DNA, 384 bp, Homo sapiens
  misc_feature: GYAE6OF02H9Q3Z.19.25.C03.1.454.CMB.1.raw
  modified_base (372)..(384): a, c, t, g, unknown or other
  misc_feature (372)..(384): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacgagcggccctgggcctgcctggtcaaggactacttccacgagagtactgagcgggctggcaaggcgcatagnnnnnnnnnnnnn

SEQ ID NO: 238921 - DNA, 366 bp, Homo sapiens
  misc_feature: GYAE6OF02GH7ME.19.25.C03.1.454.CMB.1.raw
  modified_base (356)..(366): a, c, t, g, unknown or other
  misc_feature (356)..(366): n is a, c, g, or t
tcagtactctcgtgcacgaccggtgctcgatttagtagtgtagatttgggtttgggcccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggccaccctcctccaagagcacctctgggggcacagcggccctgggctgcctggtcaaggactacttccccacgagagtactgagcgggctgggcaaggcgcatagnnnnnnnnnnn

SEQ ID NO: 238922 - DNA, 455 bp, Homo sapiens
  misc_feature: GYAE6OF02IEB98.19.25.C03.1.454.CMB.1.raw
  modified_base (449)..(455): a, c, t, g, unknown or other
  misc_feature (449)..(455): n is a, c, g, or t
tcagtactctcgtgcacgaccggtgctcgatttagtagtgtagatttgggtttgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcacgcctccaccaagggcccatcggtcttccccctggccaccctcctccaagacgccacctcgtgggggcacacgcggccctgggctgcctggtcaagggacctacttcccacgagtagtactgagcgggctggcgaaggcgcatgnnnnnnn

SEQ ID NO: 238923 - DNA, 394 bp, Homo sapiens
  misc_feature: GYAE6OF02H0IWN.19.25.C03.1.454.CMB.1.raw
  modified_base (378)..(378): a, c, t, g, unknown or other
  misc_feature (378)..(378): n is a, c, g, or t
  modified_base (384)..(394): a, c, t, g, unknown or other
  misc_feature (384)..(394): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaccctggtcaccgtctcctcagcctccaccaaggcccatccggtcttccccctggccacccctcctccaagacgccaccgtcgtgggggccacacggccggcccctgggctcgcctgggtacaaggacctactcccacgagagtactgaggcgggctggcaggcncatagnnnnnnnnnnn

SEQ ID NO: 238924 - DNA, 336 bp, Homo sapiens
  misc_feature: GYAE6OF02FG4GP.19.25.C03.1.454.CMB.1.raw
  modified_base (330)..(336): a, c, t, g, unknown or other
  misc_feature (330)..(336): n is a, c, g, or t
tcagtactctcgtgcacgaccggtgctcgatttagtagtgtagatttgggtttgggattcacgttgcagatgtaggtctgggtgcccaagctgctgaaggcctcggacaccgccatgtattactgtggccggggtagtggtatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnnnnnn

SEQ ID NO: 238925 - DNA, 407 bp, Homo sapiens
  misc_feature: GYAE6OF02I3N42.19.25.C03.1.454.CMB.1.raw
  modified_base (371)..(372): a, c, t, g, unknown or other
  misc_feature (371)..(372): n is a, c, g, or t
  modified_base (374)..(375): a, c, t, g, unknown or other
  misc_feature (374)..(375): n is a, c, g, or t
  modified_base (377)..(407): a, c, t, g, unknown or other
  misc_feature (377)..(407): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtgccggggtatggttattgtactactttgactactggggccagggaaccctggtcaccgtctcctcagcctccaccaagggcccatcggtcttccccctggccaccctcctccaagagcacctctgggggcacagcggccctgggctggcctggtcaaggactacttcccacgagagtactgagcgggctggcaaggcgcagtagnngnngnnnnnnnnnnnnnnnnnnnnnnnnnnnnnnn

SEQ ID NO: 238926 - DNA, 399 bp, Homo sapiens
  misc_feature: GYAE6OF02JCYR3.19.25.C03.1.454.CMB.1.raw
  modified_base (384)..(399): a, c, t, g, unknown or other
  misc_feature (384)..(399): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcctccccctggccaccctcctaccaagagccacctcgtgggggcacaggccggcccgtggctcgcctggtcaaggacctacctcccacgagacgtactggagccgggctcggcaagggcgcatagnnnnnnnnnnnnnnnn

SEQ ID NO: 238927 - DNA, 370 bp, Homo sapiens
  misc_feature: GYAE6OF02F3NXQ.19.25.C03.1.454.CMB.1.raw
  modified_base (348)..(370): a, c, t, g, unknown or other
  misc_feature (348)..(370): n is a, c, g, or t
tcagtactctcgtgcacgaccggtgctcgatttagtagtgtagatttgggtttgggtggcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctggggcacagcggccctgggctgcctggtcaaggactacttccccagagagtacctgtagcggctggcaaggcgacatagcnnnnnnnnnnnnnnnnnnnnnnn

SEQ ID NO: 238928 - DNA, 649 bp, Homo sapiens
  misc_feature: GYAE6OF02IDPC1.19.25.C03.1.454.CMB.1.raw
  modified_base (204)..(204): a, c, t, g, unknown or other
  misc_feature (204)..(204): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcgagggccagtcagagttgttagcagcaacttagcctttgtaccagcaagaaacctggccaggcctccaggctcctcatctatggtgcatccaccgagggccctacgttcggtactcccgagcccgtaagttcgaaggtggcagggttcggggtctggggaacagggtacgtttaccaccgtcctaccacctatcgagcacgtcctgctagttcaggtaacgttagttttacgtacttaagtttttacttacgttcgttcgtaagtacgtaagttaacttaaacgttaacgttcggtaccttacgtacgttaccgtttacgggtaccgggtaacgggaccgtaaggggtacggtaacggaacttaacgaaaacggtaaccgttaggtggtaccgttacggacctaaccgtacgtttccgttacgttacccg

SEQ ID NO: 238929 - DNA, 365 bp, Homo sapiens
  misc_feature: GYAE6OF02GHXPF.19.25.C03.1.454.CMB.1.raw
  modified_base (351)..(365): a, c, t, g, unknown or other
  misc_feature (351)..(365): n is a, c, g, or t
tcagtactctcgtgcacgaccggtgctcgatttagtagtgtagatttgggtttggggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagacgcacctctgggggcacagccggcccctgggctgcctggtcaaggactacttcccacgagacgtactgacgcgggctggcaaggcgcatagnnnnnnnnnnnnnnn

SEQ ID NO: 238930 - DNA, 572 bp, Homo sapiens
  misc_feature: GYAE6OF02GO7FU.19.25.C03.1.454.CMB.1.raw
  modified_base (207)..(207): a, c, t, g, unknown or other
  misc_feature (207)..(207): n is a, c, g, or t
  modified_base (313)..(313): a, c, t, g, unknown or other
  misc_feature (313)..(313): n is a, c, g, or t
  modified_base (422)..(422): a, c, t, g, unknown or other
  misc_feature (422)..(422): n is a, c, g, or t
  modified_base (452)..(452): a, c, t, g, unknown or other
  misc_feature (452)..(452): n is a, c, g, or t
  modified_base (479)..(479): a, c, t, g, unknown or other
  misc_feature (479)..(479): n is a, c, g, or t
tcagtactctcgtgcacgaccggtgctcgatttagtagtgtagatttgggtttgggggaggaactgctcagttaggacccagacggaaccatggaacgccccagcgcagcttctcttcctcctgctactctggctcccagataccactggagaaatagtgatgacgcagtctccagcccaccctgtctgtgtctccgaaggggaaancgcccaccctctcctgcaggccagtcagagtgtagcagctaacttagccgtggtaccagacaagaaacctggaccaggcctcccgaggcctcctcatctagtggtncatcccacgagggcccacgtggactcccagtccaggttcagtgacaggtggtctgggacagtagttcacgtctacaccatcagccagccgtgcgtagtctagtaagttntttagacttaagtttacttactgtctagtntaagttaataacgtacgtcgtacctanacgttcgttaccggacgggtaagaccgtagggtggaacgtaactaacgaaaccgtagttagcggtactacgaccctaactagttcgtagttcc

SEQ ID NO: 238931 - DNA, 698 bp, Homo sapiens
  misc_feature: GYAE6OF02G5EBM.19.25.C03.1.454.CMB.1.raw
  modified_base (203)..(203): a, c, t, g, unknown or other
  misc_feature (203)..(203): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanacgccaccctctcctgcagggccagtcagtagtgttagcagcaacttagcctggtaccagcacgaaacctggccaggcctccaggctcctcatctagtggtcgctatcccgaaccgacggggccctaacgttcgggtaactcccgagtcccgtaaggtttcaggtggcgtagggttcgggtctagggactaggtacgttccaccttctaccgaacctctacgacggaccgtaacggtcccgttacggccgttacggttcgtacgttaaaggtttacgttttacgacgtttaagtttttaacgttacgttgttacctaacgtacgttaagttaaacgttaaacgttaaccgtacggtaccttacgtacgttacggtttaccgggacgggtaacgggaacccggtaagggtacggtaaacgtaacgtaaaccgtaaacggtaacgttacggtcggtaccgtacggtacccgtaccgttacttccgttacgtttaccg

SEQ ID NO: 238932 - DNA, 356 bp, Homo sapiens
  misc_feature: GYAE6OF02GUZY2.19.25.C03.1.454.CMB.1.raw
  modified_base (342)..(356): a, c, t, g, unknown or other
  misc_feature (342)..(356): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccgggtagtggttatttgtactactttgactactgggccagggaaccctggtcaccgtctcctcagcctccaccaagggcccatcggtcttccccctggcaccctcctccaagagcacctctggggcacagcggccctgggctgcctggtcaaggactacttcccacgagtagtactgagcggctggcaaggcgcatagnnnnnnnnnnnnnnn

SEQ ID NO: 238933 - DNA, 338 bp, Homo sapiens
  misc_feature: GYAE6OF02IPWY9.19.25.C03.1.454.CMB.1.raw
  modified_base (330)..(338): a, c, t, g, unknown or other
  misc_feature (330)..(338): n is a, c, g, or t
tcagtactctcgtgcacgaccggtgctcgatttagtagtgtagatttgggtttgggattcacgttgcagatgtaggtctgggtgcccaagctgctgaaggcctcggacaccgccatgtattactgtggccgggtagtggttatttgtactactttgactactggggccagggaaccctggtcaccgtctcctcagcctccaccaagggcccatcggtcttccccctggcaccctcctccaagagcacctcgtgggggcacagcggcctggctgcctggtcaaggactacttcccacgagagtactgaggcgggctggcaaggcgcatagnnnnnnnnn

SEQ ID NO: 238934 - DNA, 383 bp, Homo sapiens
  misc_feature: GYAE6OF02FU6II.19.25.C03.1.454.CMB.1.raw
  modified_base (372)..(383): a, c, t, g, unknown or other
  misc_feature (372)..(383): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcataggnnnnnnnnnnnn

SEQ ID NO: 238935 - DNA, 682 bp, Homo sapiens
  misc_feature: GYAE6OF02H2G9D.19.25.C03.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaangccacctctcctgcagggccagtcagagtgtagcagcaacttagcctggtaccagcaagaacctggccaggcctccgaggcctctacatctatggtnacactcccaacgacgggcccagtcggtactcccgagccgtaaggttcaggttcggaccgtaggtcgggtacgtagggaactaggactttccaacgttccgtacaacccgtaagtccgaaggtaccctaacggtcccgtacggtaccgtaacgtttaccgtaaggtaaaacgtttcgttttacggaacctttaaggtttttaacttacggttcgttacaacggtactaaacggttaactaaagttaccgtcgtaccctagtacgttaaccgtttacgggacgggtaacgggtaaccgtagggtacggagtaacgttaaaccgaaacgtaacgttggttaccggtccgttaacgaccgtaacctacggttacgtcccttacg

SEQ ID NO: 238936 - DNA, 348 bp, Homo sapiens
  misc_feature: GYAE6OF02IR93C.19.25.C03.1.454.CMB.1.raw
  modified_base (341)..(348): a, c, t, g, unknown or other
  misc_feature (341)..(348): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctggggcacagcggccctgggctgcctggtcaaggactactcccacgagagtactgagcggctggcaaggcgcatannnnnnnn

SEQ ID NO: 238937 - DNA, 179 bp, Homo sapiens
  misc_feature: GYAE6OF02HEIG9.19.25.C03.1.454.CMB.1.raw
  modified_base (174)..(179): a, c, t, g, unknown or other
  misc_feature (174)..(179): n is a, c, g, or t
tcagtactctcgtgcacgaccggtgctcgatttagtagtgtagatttgggtttgggggaagaggaagactgacggtccccccaggagttcaggtgctgggcacagcggccctgggctgcctggtcaaggactacttcccacgagagtactgagcgggctggcaaggcgcatagnnnnnn

SEQ ID NO: 238938 - DNA, 727 bp, Homo sapiens
  misc_feature: GYAE6OF02IBMOL.19.25.C03.1.454.CMB.1.raw
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagacgccaccctctcctgccgagggccagtcagagtgttagcagcaacttagcctggtaccagcaacgaaaccgtcggtccacggtcctacccgtacggccttccccgtactactccttaagttcggtgtcctactccgacccgacgggacctacgtacggtacgtccccgagtcccgtaggttccaggttacggctagggttcgggttcgtacgggacgtacggtacgttaccgacttacctaccctaaccgataccgacgtacgacgtccgtgaccgtacgttcgtaggttaacgttactttttcgacgtttaagttttacttacgttcgttacgtacgtacgttaacggttaaacttaaacgtacccgttagggtaccctttacggtaaccgttaccggttacggggtaccggaacggggtaaccgtaaggggttcggtaaacgtaaggtaacccgttaaaacgggtacgttacgggtacgtccggttaggacccttaacggtactttccgtacggttaccc

SEQ ID NO: 238939 - DNA, 355 bp, Homo sapiens
  misc_feature: GYAE6OF02IH004.19.25.C03.1.454.CMB.1.raw
  modified_base (348)..(355): a, c, t, g, unknown or other
  misc_feature (348)..(355): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccaccaagggcccatcggtcttccccctggccaccctcctccaagagccacctctggggcacagcggccctgggctgcctggtcaaggactacttcccacgagagtactggagcggggctggcaaggcgcatagnnnnnnnn

SEQ ID NO: 238940 - DNA, 418 bp, Homo sapiens
  misc_feature: GYAE6OF02HGJ94.19.25.C03.1.454.CMB.1.raw
  modified_base (405)..(418): a, c, t, g, unknown or other
  misc_feature (405)..(418): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgactactggggccagggaccctggtcaccgtctcctcacgcctccaccaacgggcccagtccggtccttccccctggccacccctcctccaagacgccacctcgtgggggccacgagccggccccgtgggctggccgtggtaccgaaggactaccttcccgacgagagtacgtggacggccggggctgggacgaagggcgacacgtagnnnnnnnnnnnnnn

SEQ ID NO: 238941 - DNA, 582 bp, Homo sapiens
  misc_feature: GYAE6OF02GJ391.19.25.C03.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (300)..(300): a, c, t, g, unknown or other
  misc_feature (300)..(300): n is a, c, g, or t
  modified_base (402)..(402): a, c, t, g, unknown or other
  misc_feature (402)..(402): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaacctggccaggctcccaggcctcctnatctatggncactcccaccgagggcccacgtggtactcccagccaggttcagtcggcaggtgggtctagggactagacgttcacttctcacctatcacgcgagacctgacncgtctggtaagtagtttgtacttacgttttattactgttcacgtatagttaataataacgtcgtccttacgtacgtacgtttcggacggtacgggaaccgtagggtacggtaagacgtaacgtaaacggtaacgttacggtagtacggtacgaccgtaaccgtagttacgttcgttaccg

SEQ ID NO: 238942 - DNA, 675 bp, Homo sapiens
  misc_feature: GYAE6OF02HS6CP.19.25.C03.1.454.CMB.1.raw
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagcccaccctctcctgcagggccagtcagagtgttagcagctaacttagcctggtaccagcaagaaacctggaccaggcctcccgaggtcctcctcatctagtggtcgcactcccgaccgacgggcctacgtacggtacctcccgaggtcccgtaggttcgaaggtcgggacgtaggggtcgggtacgttacgggacgtaggtacgtttcaaccttcgtaccacctacgtccgaacggcctaacgccccgttaggaccctagttcgtacggtaaagtttagttttagacttaagtttttactacgttgtacgtacgtactaagttaacttaaacgttacgtacgtaccgtacgtacggttaccgtttacggaacgggtaccgggtacgtacgggtaggaacgtacgtaaccggtaaacggtacgttacgggacggtactaccggacctaccgtacgttactacggttaccc

SEQ ID NO: 238943 - DNA, 697 bp, Homo sapiens
  misc_feature: GYAE6OF02HSRTT.19.25.C03.1.454.CMB.1.raw
  modified_base (190)..(190): a, c, t, g, unknown or other
  misc_feature (190)..(190): n is a, c, g, or t
  modified_base (206)..(206): a, c, t, g, unknown or other
  misc_feature (206)..(206): n is a, c, g, or t
  modified_base (241)..(241): a, c, t, g, unknown or other
  misc_feature (241)..(241): n is a, c, g, or t
  modified_base (307)..(307): a, c, t, g, unknown or other
  misc_feature (307)..(307): n is a, c, g, or t
  modified_base (359)..(359): a, c, t, g, unknown or other
  misc_feature (359)..(359): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggaagaaatagtgatgacgcagtctccagcctacctgtctgtntctacgaaggggaaancgcccacctctcctgcagggccagtcagagtgtancagcctaaattcgccgttaggaccagcaagtaaaccgtggaccaggtcctacccgaggccttcctnactcgtaagttcggcactactccgaaccgagggtccctaagtcggttaaccncccgaacgccgttaaggttcgaggtacggacgtagggttcggttacggtacggaactacggttacgttacctaccttccgtaaccaacctataccgaacgtaccgacgtaccgtacgacgtacgttacgtaagttaacgttacgttacgtaacgtttaacgttttacgttagttacgtacgtagtacgtaaagttaaacttaaacgtacgtaccgtaccttacgtaacgttaccggtacgggaacggaacggtaaccgtagggtacggaagtaacgtaaacgtaaaccggtagttacggtacgtacgtacgtacctaaccgtcgttacgtacgttacc

SEQ ID NO: 238944 - DNA, 485 bp, Homo sapiens
  misc_feature: GYAE6OF02I2C3D.19.25.C03.1.454.CMB.1.raw
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (417)..(418): a, c, t, g, unknown or other
  misc_feature (417)..(418): n is a, c, g, or t
  modified_base (422)..(485): a, c, t, g, unknown or other
  misc_feature (422)..(485): n is a, c, g, or t
tcagtactctcgtgcacgaccggtgctcgatttagtagtgtagatttgggtttggggtggcccaagctgctggagggcacggtcaccacgctgctgagggagtagagtcctgaaggcctcggacaccgccatgtattactggtggccgggggtagtggttattttgtacttactttgactacgtgggggccacgggaaccctggtcaccggtctcctcagcctccaccgaaggggccccagtccgggtccttcccccctgggcctacccctcctccaagcgccaccctcgtgggggcacgacggccggccctggggcctgcccgttggtaccaaggtacttaccgttccccaacggagacgtactgggacggcgggtcgtgggacgaacgggtcgccgaagtacggntcgtncgtanncgtnnnnnnnnnnnnnnnnnnnnnnnnnnnnnnnnnnnnnnnnnnnnnnnnnnnnnnnnnnnnnnnn

SEQ ID NO: 238945 - DNA, 375 bp, Homo sapiens
  misc_feature: GYAE6OF02F9RFZ.19.25.C03.1.454.CMB.1.raw
  modified_base (351)..(352): a, c, t, g, unknown or other
  misc_feature (351)..(352): n is a, c, g, or t
  modified_base (354)..(375): a, c, t, g, unknown or other
  misc_feature (354)..(375): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcagcctccatcaagggcccatcggtcttccccctggcaccctcctccaagagcacctctgggggcacagccggccctgggctacgcctggtcaaggacctacttccccagagagtactgagcgggctggcaaggcgcagtagcnngnnnnnnnnnnnnnnnnnnnnnn

SEQ ID NO: 238946 - DNA, 352 bp, Homo sapiens
  misc_feature: GYAE6OF02HC3OT.19.25.C03.1.454.CMB.1.raw
  modified_base (342)..(352): a, c, t, g, unknown or other
  misc_feature (342)..(352): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattaatgtggccggggtagtggttatttgtactactttgactactggggccagggaaccctggtcaccgtctcctcagcctccaccaagggccatcggtctcccctgcaccctactccaagagcacctctggggcacacgcggccctgggctgcctggtcaaggactacttcccacgagagtactgagcgggctggcgaaggcgcatagnnnnnnnnnnn

SEQ ID NO: 238947 - DNA, 545 bp, Homo sapiens
  misc_feature: GYAE6OF02GS6IV.19.25.C03.1.454.CMB.1.raw
  modified_base (203)..(203): a, c, t, g, unknown or other
  misc_feature (203)..(203): n is a, c, g, or t
  modified_base (313)..(313): a, c, t, g, unknown or other
  misc_feature (313)..(313): n is a, c, g, or t
  modified_base (455)..(455): a, c, t, g, unknown or other
  misc_feature (455)..(455): n is a, c, g, or t
  modified_base (470)..(470): a, c, t, g, unknown or other
  misc_feature (470)..(470): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtcgtagcagcaattgcctggtaccagcagaaacctggccaggctaccccaggtcctcctcatctatcggtgcatcccacngggccactggtatcccagccaggttcagtggcagtgggtctgggacaggtacttcactctccacatcagcagtaccctgactaggtcctgaagtctttgacttaagtttctaactgtacagtcagtaatataactgccgttnagtaccgtttacggnggaacggacgaggttaggtacgaattaccaaacggtactggtacgacggtacgaccgacctacgtcgtagttccc

SEQ ID NO: 238948 - DNA, 716 bp, Homo sapiens
  misc_feature: GYAE6OF02I9AI4.19.25.C03.1.454.CMB.1.raw
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagagccaccctctcctgcgagggccagtcagagtgttagcagcaacttagcctggtaccagcagaaccgtggccacggcctcccacggtctcctcatcctagtggtgcactaccaccgacggcccacgtcggtacctcccgacggaccctaggttcctagggggtcgtacgtagggttcgggttcgtagggacgtacggtacctttacacgttccctacaaccctctaccgacggacctaacggacgttggggacctccgttaggtacgttgttattttacggactttaacggttttacgttaccgtcggttacgtaacggtcggtttaacgttaggtacgggtttacggtagggtacgggggttcggttaacccgggttaccgggaaccgggttaaacggggaccgtttaaggggacggttaacgtaaaccgaacgggtaaccgttcgggtaccgtacgttaccggaaccgtaccggttaacttcccggtttcgttacccgttcgtttaacccg

SEQ ID NO: 238949 - DNA, 554 bp, Homo sapiens
  misc_feature: GYAE6OF02FNKG8.19.25.C03.1.454.CMB.1.raw
  modified_base (151)..(151): a, c, t, g, unknown or other
  misc_feature (151)..(151): n is a, c, g, or t
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactgganaaatagtgatgacgcagtctccagccaccctgtctgtgtctccgaggggaaangccaccctntcctgcagggccagtcagagtgttagcagcaacttagcctggtaccagcagaaacctggccaggctcccaggcctcctcatctatggtgcatccacgagggcctacgtggtactcccagtccaggttccagtcggcagtggtctgggacagtagttcactctcacctntcancagtccngtctagtctaggaagtatttcgattagtttattacgtgtacaagtaagttaataaactacgtggtacctacgtagttaccgttacggaccggtacggaccgtagggtacgagtacgtaaccgaaagacgtggtgactcggaccacgtctcttacgtccttac

SEQ ID NO: 238950 - DNA, 660 bp, Homo sapiens
  misc_feature: GYAE6OF02I30N2.19.25.C03.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
tcagtactctcgtgcacgaccggtgctcgatttagtagtgtagatttgggtttgggggagggaactgctcagttaggacccagacggaaccatggaagccccagcgcagcttctcttcctcctgctactctggctcccagataccactggagaaatagtgatgacgcagtctccagcccaccctgtctgtgtctccgagggaaangccaccctntcctgcagggccagtcagagtgttagcagcaacttgcctggtaccagacagaacctggaccaggcctcccgaggcctaccgtcacttctaagtggtcgcacgtcccaccgacggcccaacgttggtacctccccgaggtcccgtagggttacccaggttcggacctagggttcggtacgtgggaacgaggtacgtctaccgctaccgacagtcgacgcacgtcctacgctagtctacggaagtttacgtttgacttaggttttacttacgttacgctacggcgtaggttaccggttacgttctaccgtcccgtaacggttccgggttaccgaccggtaaacggggtacctaagggttacgtaaactaccggaaaacggttaccggttaggtccggttacgacgtaacccgtacgtaaccgttcgttacggttcccttaagttcccg

SEQ ID NO: 238951 - DNA, 363 bp, Homo sapiens
  misc_feature: GYAE6OF02G1I5O.19.25.C03.1.454.CMB.1.raw
  modified_base (328)..(328): a, c, t, g, unknown or other
  misc_feature (328)..(328): n is a, c, g, or t
  modified_base (346)..(346): a, c, t, g, unknown or other
  misc_feature (346)..(346): n is a, c, g, or t
  modified_base (352)..(363): a, c, t, g, unknown or other
  misc_feature (352)..(363): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactggggccagggaccctggtctccgtctcgtcagcctccaccgaagggcccatccggtccttccccctggccgccctgcctcccaggacgcaccctccgagacgcacagtcggccctgggctgctggtacaaggactactcccagagagtacngagcggctggcaagggcncatagnnnnnnnnnnnn

SEQ ID NO: 238952 - DNA, 403 bp, Homo sapiens
  misc_feature: GYAE6OF02HEAK8.19.25.C03.1.454.CMB.1.raw
  modified_base (376)..(403): a, c, t, g, unknown or other
  misc_feature (376)..(403): n is a, c, g, or t
tcagtactctcgtgcacgaccggtgctcgatttagtagtgtagatttgggtttgggtgcccaagctgctggagggcacggtcaccacgctgctgagggagtagagtcctgaaggctcggacaccgccatgtattactgtggccggggtagtggttatttgtactactttgactacgtggggccagggaaccctgggtcaccgtctcctcacgcctaccaccaagggcccagtccggtccttccccctggccaccctcctccaagaacgcacctcgtggggcacacggcggccctcgggctcggcctggtcaaggtacctaccttcccacgagtaacgtactcggagtcggggctgggaccaaggccgacatacggnnnnnnnnnnnnnnnnnnnnnnnnnnnn

SEQ ID NO: 238953 - DNA, 508 bp, Homo sapiens
  misc_feature: GYAE6OF02JKYPR.19.25.C03.1.454.CMB.1.raw
  modified_base (451)..(451): a, c, t, g, unknown or other
  misc_feature (451)..(451): n is a, c, g, or t
  modified_base (453)..(508): a, c, t, g, unknown or other
  misc_feature (453)..(508): n is a, c, g, or t
tcagtactctcgtgcacgaccggtgctcgatttagtagtgtagattttgggtttgggtgcccaagctgctgggagggcacggtcaccatctcagccgacaagtccatcagcaccgcctacctgcagtggagcagcctgaaggcctcggacaccgccatgtattactggtgggccggggtagtggttatttgtacttactttgactacgtggggccgagggaaccctggtccaccgttctcctcacgccctccaaccgaacgggccccattccggtccttccccccgtggccctacccctcctaccaagacgcccacctcggtcgggggacacgcggccggcccgtgggctcgccgtggtaccgaacggtaccttacccgttaccccgaacgtaggtacgttaccgaggacgggccgggtcggtcggacgaaacgggcctacgacgtaggcncnnnnnnnnnnnnnnnnnnnnnnnnnnnnnnnnnnnnnnnnnnnnnnnnnnnnnnnn

SEQ ID NO: 238954 - DNA, 843 bp, Homo sapiens
  misc_feature: GYAE6OF02GHOJ7.19.25.C03.1.454.CMB.1.raw
  modified_base (210)..(210): a, c, t, g, unknown or other
  misc_feature (210)..(210): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggcctcccagactaccacgtggaagaaatagtgatgacgcagtcctccacgcccaccctgtctgtcgtctcgaagggaancgcccaccctctcctgcgacggccagtcgagtagtgtagcagactaaacgttcggccgttacggtaccaggaccgaaacgaaaccgtcggacccgacggtccctccccgacggtcctccctactacttacgtacggtggtacgacctaaccgtaccccgaaccggacggggtcccctaacggttacggtaaccctaccccgtaacggtaccccgttaagggttccgtaagggtcgggtacgtaaggggttccggggttacggtacggggtaaacgtacgggttaccggttaccctaacccgttaccgtacccgtaaacccgtagttacccgacggtaccctacggtccccgtacggacccttaaggttaccgtaagggttaaacggttttacgttttacggtaaacttttaaggtttttaaccgttaccggttacgttaaccgtaacggttaacgttaaacgtttaaacgttaaaccggttaaccggtccgggttaacccttaccgggttaacggtttaaccgggttccggggaaacggttaacggggtaaccggtaaggggttacggaacgtaacgtaaacccgaaacggttacgtggtacgcgtacaccgtacctcgttacgtcgttaccg

SEQ ID NO: 238955 - DNA, 594 bp, Homo sapiens
  misc_feature: GYAE6OF02GVBIX.19.25.C03.1.454.CMB.1.raw
  modified_base (204)..(204): a, c, t, g, unknown or other
  misc_feature (204)..(204): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttagcagcaacttagcctggtaccagcagaaacctggccaggctcccgaggcctcctcatcatggtgcatccaccgagggccacgtggtactcccgagcccaggttcaggtggcctaggtcgggtctagggacaggtacgttccacgttctaccaaccctaattccgaacgccacgtaccctggacctagtcctaggtaaagtcttttagcgttaagtttattacgtcgtacagtactaagttaataaactacgtggtccctagtacgttaccgtttcgggacggacgggtaccgagggtcgaagtaacgtaacgaaaccgtaactggtacgtcacggaccactacgttctgttacc

SEQ ID NO: 238956 - DNA, 355 bp, Homo sapiens
  misc_feature: GYAE6OF02G9X07.19.25.C03.1.454.CMB.1.raw
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (259)..(260): a, c, t, g, unknown or other
  misc_feature (259)..(260): n is a, c, g, or t
  modified_base (266)..(266): a, c, t, g, unknown or other
  misc_feature (266)..(266): n is a, c, g, or t
  modified_base (328)..(355): a, c, t, g, unknown or other
  misc_feature (328)..(355): n is a, c, g, or t
tcagtactctcgtgcacgaccggtgctcgatttagtagtgtagatttgggtttgggcccaggtcaccatctcagccgacaagtccatcagcaccgcctacctgcagtggagcagcctgaaggcctcggacaccgccatgtattactgtggccggggtagtggttatttgtactactttgactacgtggggccagggaaccctggtcaccgtctcctcagcctcaccaggccatcgtctcccctgcncctctcagncacnngggcanagcgcctggctgctgtcaaggctactcccagagagtactgagcggtctggcaggcgcatagnnnnnnnnnnnnnnnnnnnnnnnnnnnn

SEQ ID NO: 238957 - DNA, 399 bp, Homo sapiens
  misc_feature: GYAE6OF02FS13X.19.25.C03.1.454.CMB.1.raw
  modified_base (354)..(354): a, c, t, g, unknown or other
  misc_feature (354)..(354): n is a, c, g, or t
  modified_base (370)..(399): a, c, t, g, unknown or other
  misc_feature (370)..(399): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattactgtggccggggtagtggttatttgtactactttgacttactggggccagggaaccctggtcaccgtctcctcagcctccaccaagggccatcggtctcccctggccaccctcctccaagagcacctctcggggcacagcggccctggctgcctggacacgactacctaccgacgagtagtactgaggcggntgcgaagcgacagtannnnnnnnnnnnnnnnnnnnnnnnnnnnnn

SEQ ID NO: 238958 - DNA, 718 bp, Homo sapiens
  misc_feature: GYAE6OF02I3A2E.19.25.C03.1.454.CMB.1.raw
  modified_base (209)..(209): a, c, t, g, unknown or other
  misc_feature (209)..(209): n is a, c, g, or t
  modified_base (535)..(535): a, c, t, g, unknown or other
  misc_feature (535)..(535): n is a, c, g, or t
tcagtactctcgtgcacgaccggtgctcgatttagtagtgtagatttgggtttgggggaggaactgctcagttaggacccagacggaaccatggaacgcccagcgcagcttctcttcctctgctactctggctccagataccactggaagaaataggtgatgacgcagtctccagccacctgttctttagtcctaccgaagggggaaancgccctacccttctccgtagcacgtcctccgaacgccgaaagtaacttaacgcccgaaggtccgtaccttaacgtaactacgttaccgccgtttacgggaacccaggaccgaaggaaccgcccgttcgggaccctaacgggtcccttcccggtaaggtttcccctaacgtacttccgttaacgtccggtaccggttacgggtaccccagggtaccgggcctacgtcggcctaacgtaccaagtacgtaggtccgaggtggcgtagggtcggtacgtacggataccgtacttcgacttcacgtactagtactgcaacgtcgtgtacncgtagaacgttagtcgagttagtgttactcgtcagacgttgaacgttggtactaacgttctaccgttcggttacggtaccgttaccggaacgtacgggttaacggtaacggtaacgttaaaccggcggttaaaccgtacggttgggtaccgtactaaccggacctacgttacgttcggttaac

SEQ ID NO: 238959 - DNA, 781 bp, Homo sapiens
  misc_feature: GYAE6OF02JNPH9.19.25.C03.1.454.CMB.1.raw
  modified_base (152)..(152): a, c, t, g, unknown or other
  misc_feature (152)..(152): n is a, c, g, or t
  modified_base (244)..(244): a, c, t, g, unknown or other
  misc_feature (244)..(244): n is a, c, g, or t
  modified_base (293)..(293): a, c, t, g, unknown or other
  misc_feature (293)..(293): n is a, c, g, or t
tcagtactctcgtgcacgaccggtgctcgatttagtagtgtagatttgggtttgggggagggaactgctcagttaggacccagacggaaccatggaagccccagcgcagcttctcttcctcctgctactctggctcccagataccactgganaaatagtgatgacgcagtctccagccaccctgtctgtgtcctccgaggggaagacgccctaccctctcctgcagggccagtcagagtgttancagcaacttgccgtacggtacagacaagaaaccgtcggccgacggtccncccgagcctacctcatctagtggtcgacacgtaccaaccaccggggtcccacgttacgggtcctaccccgaaggtccctacgggtttacgacggtcggtcgtacgggttcgggtaccggtgggaactaagggtattccgacctcgtaccactagcctacgaccgtacgtcctacggaccgtacgttaccgtaaggttaacggtttacgttttacggtacgtttaacggtttttacgtttacgttacggtaccgtacgtaaccgttaacgttaaaccggttaacgttaaaaccgttccgggttaccccgttacgttaaccgggttaacccgggttttaccggggaacgggggttaaccgggtaaacccgggtaggggtaccgggtaacggtaaacccggttaaccgtaaacggggtaacggttcggggttaaacggtacgtaccggtaacccggtacccgttaaggtttaccggttcggtttaacccgg

SEQ ID NO: 238960 - DNA, 507 bp, Homo sapiens
  misc_feature: GYAE6OF02GYXPD.19.25.C03.1.454.CMB.1.raw
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (458)..(507): a, c, t, g, unknown or other
  misc_feature (458)..(507): n is a, c, g, or t
tcagtactctcgtgcacgaccggtgctcgatttagtagtgtagatttgggtttggggtgcccaagctgctggagggcacggtcaccacgctgctgagggagtagagtcctgaaggcctcggacaccgccatgtattactgtggccggggtagtggttatttgtactactttgactactggggccagggaaccctggtcaccgtctcctcacgcctccaccgaacgggcccagtccggtcctttcccccgtgggcccacccccttccctaccgaaacgacgacccacccgtccggtggggggccaaccgacgcccggtcccccgtggggcctcggtcccgttgggtaccgaaacgggtacccttacccgtttacccccgaacggaaggtaccgccgttagggacgggcccggggtccgtacgggaccggaacgggtccggacgagttaggntncgagcnnnnnnnnnnnnnnnnnnnnnnnnnnnnnnnnnnnnnnnnnnnnnnnnnn

SEQ ID NO: 238961 - DNA, 765 bp, Homo sapiens
  misc_feature: GYAE6OF02FFWWU.19.25.C03.1.454.CMB.1.raw
  modified_base (208)..(208): a, c, t, g, unknown or other
  misc_feature (208)..(208): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactcgtggctcccagataccactggagaaatagtgatgacgcagtcctccagcccaccctgtctgtcgtctccgaaggggaancgtccaccctcgtcctgccgagggtccagtcagagtcgttagcagcaacgttgcctggtaccagccagaacctggaccacggccttacccgaggtcctccctacaagtttcctaagtcgggtacacctacgtcccgaaccggaggggtcccaacggttaggtacctccccgagtcccgaagggtttccaggttcggggcctaacgggttcgggttaccgagggtaacctaggacgtttacgaaccttcgtaccacctagtacgacgctaacgtccctaggtaccctaggtacctaggtaaacgttcgtttttacgaccgtttacgttttaagtttacccgtaggttacccgaaggtcccgttaaaagtttaaaccgtaacgtttaaacccgtacggggtaacccttacgttaacggttaacccggttttaccgggggaccgggttaacggggaacccggtaagggttccggaagttaacccgtaaccggtaaaccggtaaccgttgggtaaccgtaccggtacgtacccgaccttacggttctttaccggttacccc

SEQ ID NO: 238962 - DNA, 682 bp, Homo sapiens
  misc_feature: GYAE6OF02IJTMS.19.25.C03.1.454.CMB.1.raw
  modified_base (152)..(152): a, c, t, g, unknown or other
  misc_feature (152)..(152): n is a, c, g, or t
  modified_base (212)..(212): a, c, t, g, unknown or other
  misc_feature (212)..(212): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (464)..(464): a, c, t, g, unknown or other
  misc_feature (464)..(464): n is a, c, g, or t
  modified_base (495)..(495): a, c, t, g, unknown or other
  misc_feature (495)..(495): n is a, c, g, or t
tcagtactctcgtgcacgaccggtgctcgatttagtagtgtagattgggtttgggggtagggaacgtgctcagttaggacccagacggaaccatggaagcccagcgcagcttctcttcctctgctactctggctcccagataccactggaanaaatagtcgatcgacgcagtctccagcctaccctgtctagttgtactccgaaggggaaanacgccacccttctcctggacgacgggccagtccgagtagtaggttacgaccgagactaaacttcgggacccttgggttaaccacggacctaagaaaaccgtgggacctagggccttacccgaggtccttcctactaggtccttaggtcgcgacaactcccgacacggggcccttaacgtggtaccttcccacggtacgaggttcaaggtcggactggcgggttcnggaacnggtctacgctcctacgaactntccacgctacgctcgactgtcgtacgtagtnttacgtacgttaacttttagttttacgacttaaagtacgtaccgttacttaacccttaccctacgtaccgttacggtaccggtacgtaaccggtagtacgggtataccgtcacggtacgaacgttacggtcggtaccgttacggacctacggtacgttccgttaccgtctttaccgtaccgttaccc

SEQ ID NO: 238963 - DNA, 456 bp, Homo sapiens
  misc_feature: GYAE6OF02F8C9Y.19.25.C03.1.454.CMB.1.raw
  modified_base (428)..(456): a, c, t, g, unknown or other
  misc_feature (428)..(456): n is a, c, g, or t
tcagtactctcgtgcacgaccggtgctcgatttagtagtgtagatttgggtttgggtgcccaagctgctggagggcacggtcaccatctcagccgacaagtccatcagcactgcctacctgcagtggagcagcctgaaggcctcggacaccgcatgtattactgtggccgggtagtggttatttgtactactttgactactggggccagggaaccctggtcaccgtctcctcacgcctccaaccgaagggcccatccggtccttcccccgtggccacccgtcctaccaacgacgccaccgtcgtcggggggcacgacggccggccccgtggggccgtcgccgtacgggtaccaacgggtacccttaccgttccccaacggtagaacgttacgtggacggccgggctacgggcaagggcgtacatacgnnnnnnnnnnnnnnnnnnnnnnnnnnnnn

SEQ ID NO: 238964 - DNA, 631 bp, Homo sapiens
  misc_feature: GYAE6OF02F77FF.19.25.C03.1.454.CMB.1.raw
  modified_base (503)..(503): a, c, t, g, unknown or other
  misc_feature (503)..(503): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcacgggccagtcagagtgttagcagcaacttgcctggtaccagcaagaaaccgtggacccaggcctacccgaggcctccgtcatctagtggtcgctactccaccgagggcctagtcggtactcccgagtacccgtaggttccaggtcggacgtaggttcgggtcgtgggaacctagtacggttaccacttcctaccgtaaccattaccgacgcctacggcctacggcgtaagttccgtaagtaagttcttttcggactttaagtttacttacgttcgtacgtanacgttaagttacttaaacgtcgtacggtcctacgtacgtaccggtttcggacggtaacggtacgagggtgaacgtacgaacgaaacggtctaggtacggtcagtacccgacgtcgttactcgttaccg

SEQ ID NO: 238965 - DNA, 567 bp, Homo sapiens
  misc_feature: GYAE6OF02FK6QY.19.25.C03.1.454.CMB.1.raw
  modified_base (426)..(426): a, c, t, g, unknown or other
  misc_feature (426)..(426): n is a, c, g, or t
  modified_base (449)..(449): a, c, t, g, unknown or other
  misc_feature (449)..(449): n is a, c, g, or t
  modified_base (462)..(462): a, c, t, g, unknown or other
  misc_feature (462)..(462): n is a, c, g, or t
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
  modified_base (475)..(475): a, c, t, g, unknown or other
  misc_feature (475)..(475): n is a, c, g, or t
  modified_base (478)..(478): a, c, t, g, unknown or other
  misc_feature (478)..(478): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (502)..(502): a, c, t, g, unknown or other
  misc_feature (502)..(502): n is a, c, g, or t
  modified_base (517)..(517): a, c, t, g, unknown or other
  misc_feature (517)..(517): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattacgtgtcggcggggtagtggttatttgtactactttgactacgtgggcagggacctgtcacgtctctcagcctccaccaacgggcctacgtcggtccttcccctggccaccctcctacaacgacgcaccgtcgtcggggactacgacggccggtcccgtcgggctcggtccgtacggtcctaaacgggaccttacccgttacccgacggacgtacgttacgtggtacggcgggtcgtcggccaaacgggccgactacgtacgtcngtcacgataccggtgacgtcgtntcgagtcgatcgngtcgngcgngacntantagtatatactngntnagacgcgngtgcgtagacgagcncgcgtgcgtacgacgactacgctcgcgtcgtcgactntacncgtacgtcg

SEQ ID NO: 238966 - DNA, 672 bp, Homo sapiens
  misc_feature: GYAE6OF02HHGO3.19.25.C03.1.454.CMB.1.raw
  modified_base (206)..(206): a, c, t, g, unknown or other
  misc_feature (206)..(206): n is a, c, g, or t
  modified_base (246)..(246): a, c, t, g, unknown or other
  misc_feature (246)..(246): n is a, c, g, or t
  modified_base (316)..(316): a, c, t, g, unknown or other
  misc_feature (316)..(316): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagngtccaccctctcctgccgagggccagtcagtagtgttacncagcaacttagcctggtaccagcacgaaacctggaccaggcctccaggtcctcctcgatctagtggtacncctatcccgaccgacgggccctacgtcggttaacctcccgagtacccgtaggttcaggtcggactaggtcgggtgtacgggactaggtacgttacacgttctaccgactacgtacgacgctacgcctcgacgtacgttacgtagtaacgttacgttttagaccgtttaagttttacgtttacgacgttacgacgtaccgttaaagttacttaaacgttacgtccggtaccttacgtaacggtttacgtttacgggacgggtaacgggtaccggtaagggtacggaacgtaacgtaacggaaacgtacggttacgacggtcgtacggaaccctaccggtagttccgttagttacccg

SEQ ID NO: 238967 - DNA, 830 bp, Homo sapiens
  misc_feature: GYAE6OF02G3XO8.19.25.C03.1.454.CMB.1.raw
tcagtactctcgtgcacgaccggtgctcgatttagtagtgtagatttgggtttgggggaggaactgctcagttaggacccagacggaaccatggaagccccagcgcagcttctcttcctcctgctactctggctcccagactaccacgtggaagaaatacgtgatagacgctagtctaccgacgacccaccgtgttccgtgtcgtcctacggaaaggggaaacgaccggtaccctaccctctaccgtcggacgaacggggtacctacggtacgaggtaggttacggttaacgactacggaactaacgttacgccgttacggtaaccaaggaccaacggtaaaccgtcggaccgacggacccgttaccggacgtccttacctagtacttaccgtaagtacgggtctaacctaccgtacccgaaccgggaccgggtacctaacgttacgggtaaccctaccccggtacgtaacccgttaacgggtttcgaacggttacgacggtacgggttacggggtcggtacggaacggtacgtacggttaccctacgttaccgtaccgtaacacgtaccgacggtacgtacggtcctacgtaccgtacgttacgtaggttaacggttatttaccgtagtttaacgttttacgtacgtttaccgaagttacgacgttaaacgttacgtaaacgttacgtaccgtacgtaacgtaccgttaaccgggtacggaaccggggtaacgttaacggacggggttacgtaacggtaacgtaacccggaaacggtcggttacggtacggtaccggtctaacccggttaactcgtttacgccggttac

SEQ ID NO: 238968 - DNA, 819 bp, Homo sapiens
  misc_feature: GYAE6OF02GX54Q.19.25.C03.1.454.CMB.1.raw
tcagtactctcgtgcacgaccggtgctcgatttagtagtgtagatttgggtttgggggaggaactgctcagttaggacccagacggaaccatggaagccccagcgcagcttctcttcctcctgctactctggcctcccagactaccactggaagaaatagtgatgacgcagtctccagccctaccctgtcttgtgttccgtacgaaaggggtaagacgtccacccttctaccgtcgcgacgggacctacgtactaaggtagttagttaacgcgacggtacctaaacgttagtccgtacggtaaccacgaccaacggtaaaaccgtcgaccgacggtcctaccccggaggtcccttacccgtactaacgtacgttaacgttaggtccgtaccgtacctacccgaaaccggtaccgggaacccctaaccgtcgggttaaaccctcccgaacggtacccgtacgggtttacaacggttcgggacgtacgggtacgggttacccggagggtaccctaaggtacgttaacccgttaccgttccgtaaacctttaacccgaagttccgaacggtacccggtacggtacccggttacggtaacccgtacggttaaacgtaacggtttaaggttacttttacggttaaccgtttaacggttttaaccttacgttacgtaactacggtaattaaccgtaaattaacgtaccggtaccgtctaccgtaacgtttacggtacggtacggtaacgggtaatacgggtaagtaacgaacgttaaacgaacgtacgtacgttagcttacggactacgtattcccgtagttccg

SEQ ID NO: 238969 - DNA, 411 bp, Homo sapiens
  misc_feature: GYAE6OF02GI0HK.19.25.C03.1.454.CMB.1.raw
  modified_base (237)..(237): a, c, t, g, unknown or other
  misc_feature (237)..(237): n is a, c, g, or t
  modified_base (356)..(356): a, c, t, g, unknown or other
  misc_feature (356)..(356): n is a, c, g, or t
  modified_base (379)..(380): a, c, t, g, unknown or other
  misc_feature (379)..(380): n is a, c, g, or t
  modified_base (385)..(411): a, c, t, g, unknown or other
  misc_feature (385)..(411): n is a, c, g, or t
tcagtactctcgtgcacgaccggtgctcgatttagtagtgtagatttgggtttgggtgcccaagctgctggagggcacggtcaccatctcagccgacaagtccatcagcaccgcctacctgcagtggagcagcctgaaggcctcggacaccgccatgtattacgtgtggccgggtagtggttatttgtacttacttgactacgtggggccagggaaccctgggtcacccgtctcctnagcctccaaccaagggcccatcggtccttcccccgtggccacccctcctcccaagacgccacctccgtggggggccacagccgccctgggctgcctggtcaaggactcttcccagacgngtactgagcggctggcaagggcnntacgnnnnnnnnnnnnnnnnnnnnnnnnnnn

SEQ ID NO: 238970 - DNA, 404 bp, Homo sapiens
  misc_feature: GYAE6OF02FYA3S.19.25.C03.1.454.CMB.1.raw
  modified_base (329)..(329): a, c, t, g, unknown or other
  misc_feature (329)..(329): n is a, c, g, or t
  modified_base (362)..(370): a, c, t, g, unknown or other
  misc_feature (362)..(370): n is a, c, g, or t
  modified_base (372)..(404): a, c, t, g, unknown or other
  misc_feature (372)..(404): n is a, c, g, or t
tcagtactctcgtgcacgaccggtgctcgatttagtagtgtagatttgggtttgggcccaggtcaccatctcagccgacaagtccatcagcaccgcctacctgcagtggagcagcctgaagggcctcggacaccgccatgtattactgtggccgggggtagtggttatttgtactactttgactactggggccagggaaccctggtcaccgtctcctcagcctccaccaagggcccatcggtccttccccctggccacccctcctccaagacgccacctcgtgggggcacagcgcccgtggctcgctggtcaaggactactcccacganacgtactgaggcgggctggcaaggcgcagtagnnnnnnnnnannnnnnnnnnnnnnnnnnnnnnnnnnnnnnnnn

SEQ ID NO: 238971 - DNA, 800 bp, Homo sapiens
  misc_feature: GYAE6OF02FNE3X.19.25.C03.1.454.CMB.1.raw
  modified_base (352)..(352): a, c, t, g, unknown or other
  misc_feature (352)..(352): n is a, c, g, or t
tcagtactctcgtgcacgaccggtgctcgatttagtagtgtagatttggggtttgggggaggaactgctcagttacggacccagacggaaccatggaagccccagcgcagcttctcttcctcctgctactctggctcccagataccactggagaaatagtgatgacgcagtctccagcccaccctgtcctgtgtctaccgaaggggaaacgacgccctacccctctccgtggccgacgggtaccagtacgagtagttgtagacgacgacaacgttacgccgttacggtaccagacaacgtaaccgtcggaccacggccctacccgaggcccttcctcgtactcgtagtggtnccgactaccggaccggtacggacctacgtacgtccacccgacgccgtacggtacgaggtcggtacggtgggttcggtacgggtcgggaagtacggtacgttacctaccgttccgtacctaaccggtacgtaccgacgtacgtaccgtccgtggtacccgtacggttacgttaagggttaacggttttaagtttacggttacggtttaaacgtttttaccgttttacggttacgtaagtaacgttacgtaaaacgggtttaacgttaaacgttaccgggttacgtaccgttaacggttacggttaccggttaaacggggacggggtaacggttaaccggggtaagggtacgggtaacggttaaacgtaaaccgggtaaacgtaccgggttacgtaccggtaccgttaaccggaaccgttaccgttaccggttacgttaccgtttacccg

SEQ ID NO: 238972 - DNA, 724 bp, Homo sapiens
  misc_feature: GYAE6OF02IQDNP.19.25.C03.1.454.CMB.1.raw
  modified_base (208)..(208): a, c, t, g, unknown or other
  misc_feature (208)..(208): n is a, c, g, or t
  modified_base (247)..(247): a, c, t, g, unknown or other
  misc_feature (247)..(247): n is a, c, g, or t
  modified_base (418)..(418): a, c, t, g, unknown or other
  misc_feature (418)..(418): n is a, c, g, or t
tcagtactctcgtgcacgaccggtgctcgatttagtagtgtagatttgggtttgggggaggaactgctcagttaggacccagacggaaccatggaagccccagcgcagcttctctcctcctgctactctggcctcccagtataccactggagaaatgtgatgacgcagtctccgagcccaccgtgtctgtcgtctccgagggtaaacntcccgccctctccgtgcagggccagtcagacgtcgttanccgagactacgtagccgtagtaccagaccaacgtaaccgtggacccaagggtccccacccgtaggtccccttactactaacgttccggtaacgttcggtacgcctaaccgtcccgaaccgtacggaccctacgtcgggtacctccccgagtacccgtaaggttcagggttnaccggtagtcgggtacgtgggtaactggacttcaccgtctaccctaactgccgacgtccgtaacggcctaggtacgacggttctacggtaacggtttatttagggaaccgttttgttttaacgttaccgttacgacgtaacgttacctagttaacctaagtaccgtaggacccctttggaccggtttaccggtttacgggaaccgtaaggggttaaccgtcgggttaaggttacgaccttaaaccggaaacggttacgccgggttagaactcgtaccgtacttaccgggttccctaggttaccccg

SEQ ID NO: 238973 - DNA, 658 bp, Homo sapiens
  misc_feature: GYAE6OF02J2ZBX.19.25.C03.1.454.CMB.1.raw
  modified_base (158)..(158): a, c, t, g, unknown or other
  misc_feature (158)..(158): n is a, c, g, or t
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
  modified_base (205)..(205): a, c, t, g, unknown or other
  misc_feature (205)..(205): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
  modified_base (441)..(441): a, c, t, g, unknown or other
  misc_feature (441)..(441): n is a, c, g, or t
  modified_base (490)..(490): a, c, t, g, unknown or other
  misc_feature (490)..(490): n is a, c, g, or t
  modified_base (592)..(592): a, c, t, g, unknown or other
  misc_feature (592)..(592): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactcctggcctcccagtaactaccgactggaanaaatagtgatgacgcagtctcagccacctgctgctcncgagggancnccacctntcngcgacgggtcagtcagtacgtgttacgctagcgtaactgccgttcgacacgcaagacctggaccgtacgcgtacccgaggtccttccaactcgttagcggtcgtacncctaacgcccncggtaaggccctaaccgngtaccgtcccngtaccgtaggtctaacgggnggtcctagggtccggngggttacgaacgttcgacgttccaacggtcctacaaccggtcncgaaccgtcgtacgcgtactgtacgttacggtattggttacgttaccgntttaacgtttacgtttacttaaccgtaattaacttattttaagttctttacgttacggttccggttacgtaccggttcgaacggtaacgtaacgtacgggtnaaccttgaacgtaaccgtagcggtaggtccgacgtcctacggtacttcgtaccgttacgttcgtac

SEQ ID NO: 238974 - DNA, 665 bp, Homo sapiens
  misc_feature: GYAE6OF02HK361.19.25.C03.1.454.CMB.1.raw
  modified_base (205)..(205): a, c, t, g, unknown or other
  misc_feature (205)..(205): n is a, c, g, or t
tcagtactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcgacgggccagtcagagtgttacgcagactaacttagcctaggtaccagcaacgaaacctggccaaggcctccgacggtcctcctctatctagtggtcgacactccaccgcggcctacgtcggtactccgacgccgacggttcaggtcggacgtaggtcgggtcgtagggaactaggtacgttcctactcctacacctagtacgacgacgacgtccgtgcgtacgtcgtaaggtaacttacgttttcgactttaaggtttacttacgtcgtacgacgtactaaggttaacttaacgttaacgtcggttacctacggtacgttacggtttaccgggacgggtaacgggtaaccgtaggggttagaacggttaaccgtaaccgtaaacggtaacggttcggtacggtacgttaccggacctaaccgttacgttccgttcgtttacccg

SEQ ID NO: 238975 - DNA, 379 bp, Homo sapiens
  misc_feature: GYAE6OF02GI8B8.19.25.C03.1.454.CMB.1.raw
  modified_base (268)..(268): a, c, t, g, unknown or other
  misc_feature (268)..(268): n is a, c, g, or t
  modified_base (360)..(379): a, c, t, g, unknown or other
  misc_feature (360)..(379): n is a, c, g, or t
tcagtactctcgtgcacgaccggtgctcgatttagtagtgtagatttgggtttgggtgcccaagctgctggagggcacggtcaccacgctgctgagggagtagagtcctgaaggcctcggacaccgccatgtattactgtggccggggtagtggttatttgtactactttgactactgggccagggaacccctggtcaccgtctcctcagcctccaccaacgggcccatccggtccttcccccgtggccacccctccctaccaagacnccacctcgtggggcacagcgcccgtggcctgcctggtacaacggactaccttcccacgagagtactgaggcggctggcgaaggcgcagtagnnnnnnnnnnnnnnnnnnnn

SEQ ID NO: 238976 - DNA, 511 bp, Homo sapiens
  misc_feature: GYAE6OF01A6MRV.4.18.B07.1.454.CMB.1.raw
  modified_base (503)..(503): a, c, t, g, unknown or other
  misc_feature (503)..(503): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtccttcagcacagcctacttggaggtgagcaggctgagatctgacgacacggccgtgtattactgtgcgagaggaggaagacttggagtcggatacgagctagtggttaagnggtaacgg

SEQ ID NO: 238977 - DNA, 516 bp, Homo sapiens
  misc_feature: GYAE6OF01D5I8F.4.18.B07.1.454.CMB.1.raw
  modified_base (378)..(378): a, c, t, g, unknown or other
  misc_feature (378)..(378): n is a, c, g, or t
  modified_base (508)..(508): a, c, t, g, unknown or other
  misc_feature (508)..(508): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctgagtgaaggtctcctgcaaggcttctggatacaccttcaccggctactatatccactgggtgcgacaggcccctggacaagggcttgagtggatgggacgatcaaaccctaacgaccggtgacaacaaacaacgcacagaagttcagggcaggtcacangacaggacacgtcttcagcacagcctacgttggaggtgagcgaggctgagatcgtagacgacgacggcgtgtactagtgtgcgagaggaggagtagttggagtacggatacgaggctaggtaggtaaagnggtaacgg

SEQ ID NO: 238978 - DNA, 509 bp, Homo sapiens
  misc_feature: GYAE6OF01DP8OT.4.18.B07.1.454.CMB.1.raw
  modified_base (486)..(486): a, c, t, g, unknown or other
  misc_feature (486)..(486): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (503)..(503): a, c, t, g, unknown or other
  misc_feature (503)..(503): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacgatcaaccctaacaccggtgcacaaacaacgcacagagttcgagggcgaggtcacatagaccgagggacaccgtccttcagcacacgcctacgttggaggtgagcaggctgagatcgtgacgacgacggccgtgtacttacgtgtgcgagagaggaagattgagtcganacgngntggtaggtagngtacgg

SEQ ID NO: 238979 - DNA, 768 bp, Homo sapiens
  misc_feature: GYAE6OF01DCFBS.4.18.B07.1.454.CMB.1.raw
tcagagcactgtagcacgaccggtgctcgatttagtcgctgcgtaagggggagcgatcacccagcaaccacatctgtcctctagagaatcccctgagagctccgttcctcaccatggactggacctggaggatcctcttcttggtggcagcagccctcaggagcccactccccaggtacagttggtgcagtctggggctgaggtgaagaagcctggggcctcagtgaaggtctcctgcaaggcttctggatacaccttcaccggctactatactccacgtgggtacgccgacacggtccccttggaccgaagggcttaggacggttggagtaggggaccggactaccgaaaccccgtaacgaccgggttcggaccaaccgaaaaccgaaaccggcaaccgaaacggtaaacggttttaccgaacggggcctaaggggtacccaaccgtaagtcggaacccgaacgggtaacctaccggttaccttacgaacggctaaccgaacggtacccttaacgtttagggaacgggttacggaacggccgtaacgggtccgttaggtaacggtacgttacccgttacgggaaacccgtaacgggtaccgggttaccggttagtttaacggtttaaccgtagggttacggacccgggtaaagggtaacgggaacgggtaaaacggtaaccggtttagggtaaaccgggttaccgggtaaacttaccggtacgttacgttgggttaacgggtttaaacggaacgggtttaaaccggg

SEQ ID NO: 238980 - DNA, 512 bp, Homo sapiens
  misc_feature: GYAE6OF01EBNF4.4.18.B07.1.454.CMB.1.raw
  modified_base (503)..(503): a, c, t, g, unknown or other
  misc_feature (503)..(503): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtccttcagcacagcctacttggaggtgagcaggctgagatctgacgacacggccgtgtattactgtgcgagagaggaagacttggagtcggatacgagctggtaggttaagnggtaacggg

SEQ ID NO: 238981 - DNA, 560 bp, Homo sapiens
  misc_feature: GYAE6OF01B2DMH.4.18.B07.1.454.CMB.1.raw
  modified_base (487)..(487): a, c, t, g, unknown or other
  misc_feature (487)..(487): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtctggggctgaggtgaagagccgtggggcctcgagtgaaggtctcctgcaaggcttcgtggatacaccttcaccggctactatactccacgtgggtgcgacacggcccctggacaagggcttgagtggagtgggacgatcaacctaacgacggtgacaacaaacacgcaacagtaacgttcgagggacagggtcaaccagtacggaccgagggactaccgtccttacagcacgacgtacctacgttaggaggtgagcgaggctgagatcgtagacgacgacggccgtagttacttacgnggtgacgaggaaggaaggaagtagtaggacgtacggaatacgacgcgttaggtacggttaaaggtggtaacgg

SEQ ID NO: 238982 - DNA, 663 bp, Homo sapiens
  misc_feature: GYAE6OF01AFV9M.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccgaggtacagttggtgcagtcgtggggctggaggtagaagacgccgtggggcctcgagtgaacggtctccgtgacgaaggtccttacgtggactaccacccttaccgaccggtactactatactccgacgtgggtcgcgaccgacggccccgtaggacgaagggtcgttggaggtggacgtacgggacgacgtacccaacccgtaacgaccgggtagaaccaacgaaaccacgacaacgaagtaacgttcgacgggacgacgggtacaccgtagtaccgaccgacggacctaccgtcctacgacgacacgacgtaccgttacggtgggaggtgacgcgaggtcgtagacgacgtacgacggtaccggacgtaccggtcgttagtaacgttacgtggtacggacggaaggaacggtagggtaacgttacggttaggacgggttaccgaagtaccggtaggtacgttagggttaaggttaacggacggttaaccgg

SEQ ID NO: 238983 - DNA, 669 bp, Homo sapiens
  misc_feature: GYAE6OF01C21IP.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcgtagtcgtgggctggaggtagaagaacgccggtcgggcctcgagtgaagtcctcgtgacgaaggtcttcgaggtactaccaccttaccgaccggtctaacttatactccacgtgggtgaccgacgaccggtccccgtaggaaccgtaacgggtcttaggaggttagggagtcggggaacggactacccgaaaaccccgttaaccgaccgggtacgacaaaccaaaaccgaacgacaacgaagttaacgtttacgacgggcgaacggtacacctaagtacgaccgaagggaacctaccgttccttacgacgacaacacgtacctacgttgggaggtgacgacgaggctggaatcgtcgtacggaaccggacgaccggtcgttagttaacttacgtgtacgacgaggtaggaaggtaacggtacgtttaggacggtacggtaacttacgacgttacgtaggttaagggtaaggtggttaaaccggg

SEQ ID NO: 238984 - DNA, 679 bp, Homo sapiens
  misc_feature: GYAE6OF01CY2AK.4.18.B07.1.454.CMB.1.raw
  modified_base (254)..(254): a, c, t, g, unknown or other
  misc_feature (254)..(254): n is a, c, g, or t
  modified_base (568)..(568): a, c, t, g, unknown or other
  misc_feature (568)..(568): n is a, c, g, or t
tcagagcactgtagcacgaccggtgctcgatttagtcgctgcgtaagggggagcatcacccagcaaccacatctgtcctctagagaactcccctgagagctccgttcctcaccatggactggacctggaggatcctcttcttggtggcagcagcctcgaggacgcccactcccaggtacagttggtgcagtcgtggggctgaggtgaagagccgtgggcctcgagtgaacggtctccgtgacgaaggtcttcgnggactacctaccttcgaccggtactaactatactccacgtgggtcgaccgtacgaccgggccccgtaggaccgaagggtcttaggaggtggagtgggacgtataccaaccgtaacgcggtacggacaaacgaaacaacgtcaacgtaagtaacgttacgagggacgacgggtaccacgtagtacggaaccgaagggaacctaccgttcctacgacgacaacgtacgtccttacggttgggacggttgacgacgaggtctaggaagtacgtcgacggaacccggacgtaccgggccgttaagttacgtttacggnggttacgacggaagggaacggaacggtaaacggtacggtttaggaacggttaccgggtaactacggtaaggtacgttagggtttaacgggtaaaggtcgggttaaaccggg

SEQ ID NO: 238985 - DNA, 546 bp, Homo sapiens
  misc_feature: GYAE6OF01EYIMO.4.18.B07.1.454.CMB.1.raw
  modified_base (538)..(538): a, c, t, g, unknown or other
  misc_feature (538)..(538): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttctggatacaccttcaccggctactatatccactgggtgcgacacggccccgtggacgaagggcttggagtggatgggacggataccgaaccctaacgaccggtggaccaacaaacaacgcaacgagtaacgtttcgagggacagggtacacatcgaccaggacacgtcttcagcacagcctacgtggaggtgagcgaggctgagtatctaggacgacgacggcgtgttacttacgtgtacgcgagagagggtaagacgttagaggtcgaatacgtaggcttagggtaggttaagnggtaacgg

SEQ ID NO: 238986 - DNA, 556 bp, Homo sapiens
  misc_feature: GYAE6OF01DIC8K.4.18.B07.1.454.CMB.1.raw
  modified_base (415)..(415): a, c, t, g, unknown or other
  misc_feature (415)..(415): n is a, c, g, or t
  modified_base (548)..(548): a, c, t, g, unknown or other
  misc_feature (548)..(548): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaacggtctcctgcaaggcttctggatacaccttcaccggctactatatccacgtgggtgcgacacggcccctggacgaagggcttggagtggagtgggacggataccaacctaacgaccggtcggacaacaaacgaacgacaacaagaacgtttcgaagggcagggtcacatcgaccaggacacgtcctcancacacgcctagtgaggtgagcaggctagagatctaggaccgacgacggcccgttagtacgtttacgtgtcggacggaggaagagggaacgtagttaggacgtacggataccgagacgttagtacggttaaagnggtacggg

SEQ ID NO: 238987 - DNA, 793 bp, Homo sapiens
  misc_feature: GYAE6OF01BV1MX.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactccccgagtactaggttggtcgacgtagtcggtcgggtcgtagggaggtaggaaaggaaccgtccgggtcggggtccctacgtaggtaggtaacggttccttccgtgacgaacggttccttcggtaggtactacccttaccttaccggacccggtaccttaacttaattacctacccgtacggttggggtcgaccgacggacccggtccccggtaggaacggacgggtcgttaggtacgggtaggtagggtacggggaacgtactaaccccgtaaaaccccgtaaccggtaccggggtcggaccaaaccaaaaccgaccgtacaacgaaggttaacgttacggacgggtacggtacgggtacccaacctacgtaccgaaccggtacgggaaccgtacccgtttacctacgacgacccgaacgaccgtaccttacggtagggtacggtaggacgacggacggtcgtaggaacgtacgttcggacggtaaccggaccgtacccggtcgttagttactacggttggtaccggacgaaggaagggaaggtaacgttacggttacgggtacgggtacggtaactacggtacgtacggttagggttaacgggttaacggtaagggtaacccgg

SEQ ID NO: 238988 - DNA, 510 bp, Homo sapiens
  misc_feature: GYAE6OF01D7S8Y.4.18.B07.1.454.CMB.1.raw
  modified_base (503)..(503): a, c, t, g, unknown or other
  misc_feature (503)..(503): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtgacacaaacacgcacagaagttcagggcaggtcaccatgacagggacacgtccttcagcacacgcctacttggaggtgagcaggctgagatcagacgacgacggccgttagtacgttactggtgcgagagaggaagtagtgagtcggatacgagctagtggtaagnggtacgg

SEQ ID NO: 238989 - DNA, 504 bp, Homo sapiens
  misc_feature: GYAE6OF01B38V2.4.18.B07.1.454.CMB.1.raw
  modified_base (280)..(280): a, c, t, g, unknown or other
  misc_feature (280)..(280): n is a, c, g, or t
  modified_base (497)..(497): a, c, t, g, unknown or other
  misc_feature (497)..(497): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtncgacaggcccctggacaagggctgagtggatggacggatcaacctaacacggtgcacaaacacgcacagaagttcagggcagggtcacatgaccagggacacgtccttcagcacagcctacttggagtgagcaggctgagatctagacgacgacggccgtagtaacgttactgtgacgagaagaggaagatggagtcggatacagctagtggtaagngtaacgg

SEQ ID NO: 238990 - DNA, 532 bp, Homo sapiens
  misc_feature: GYAE6OF01BHQFX.4.18.B07.1.454.CMB.1.raw
  modified_base (523)..(523): a, c, t, g, unknown or other
  misc_feature (523)..(523): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaaccctaacaccggtggacacaaacaacgcacagagttcgagggcagggtcacatgaccaggacacgtccttcagcacagcctatgggaggtgagcaggctgagatctagaccgacgaccggtccgtgtattactggtgtcgagaaggaggaaagtacgttggtaggtcgggaatacgaggtcttaggtaggttaaaggnggttaacgg

SEQ ID NO: 238991 - DNA, 566 bp, Homo sapiens
  misc_feature: GYAE6OF01CR0SH.4.18.B07.1.454.CMB.1.raw
  modified_base (559)..(559): a, c, t, g, unknown or other
  misc_feature (559)..(559): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctgaggtgaagagccgtggggcctcgagtgaaggtctccgtgcaaggcttcgtggatacaccttcaccggctactatactccacgtggtcgcgacacggcccctaggacgaaggcttggagtggagtgggacgataccaaccgtaacgaccggtgacaacaaacgaacgacaacagaacgttcgacgggacacgggtacaaccagtacgaccgacggactacgtccttacgacgacacgacgcctacgtggaggtgagcgaggcgtagagagtcgagaccgacgacggtccgttagtacttacgtgtggacgaggagaggacgtagtggagtacggatacgacgtacgtaggttaggtaaggnggtacgg

SEQ ID NO: 238992 - DNA, 556 bp, Homo sapiens
  misc_feature: GYAE6OF01BUDA4.4.18.B07.1.454.CMB.1.raw
  modified_base (547)..(547): a, c, t, g, unknown or other
  misc_feature (547)..(547): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttctggatacaccttcaccggctactatatccacgtgggtgcgacacggccccgtggacgaagggtcttggagtggagtgggacggatccaaaccctaacgaccggtggacaacaaacaacgcacagaagtttcgagggcagggtacacatcgaccgagggacacgtcctcagacacgacgacctacgttgggaggtgagcgaggctgagatcgtagaccgacgacggtcgttgtacttacgtgtggcgaggagaagggaacgagttaggacggtacggagtacgtagcgttaggtaggttaaagnggttaacgg

SEQ ID NO: 238993 - DNA, 505 bp, Homo sapiens
  misc_feature: GYAE6OF01BC9UQ.4.18.B07.1.454.CMB.1.raw
  modified_base (244)..(244): a, c, t, g, unknown or other
  misc_feature (244)..(244): n is a, c, g, or t
  modified_base (497)..(497): a, c, t, g, unknown or other
  misc_feature (497)..(497): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcnggatacaccttcaccggctactatatccactgggtgcgacaggcccctggacaagggcttgagtggatgggacgatcaacctaacacggtggacacaaacaacgcaacagaagtttcagggcagggtcacatgaccagggacacgtccttcagcacagcctactggaggtgagcaggctgagatctgacgacacggccgtgtactactgtgacgagagaggaagagttgagtcgatacagctaggtagtaagnggtaacgg

SEQ ID NO: 238994 - DNA, 535 bp, Homo sapiens
  misc_feature: GYAE6OF01C3588.4.18.B07.1.454.CMB.1.raw
  modified_base (331)..(331): a, c, t, g, unknown or other
  misc_feature (331)..(331): n is a, c, g, or t
  modified_base (431)..(431): a, c, t, g, unknown or other
  misc_feature (431)..(431): n is a, c, g, or t
  modified_base (526)..(526): a, c, t, g, unknown or other
  misc_feature (526)..(526): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacgatcaaccctaacncggtggcacaaacaacgcacagaagttcgagggcagggtcacgatgaccagggacacgtccttcagcacagcctacgttggaggtgagcgaggctagagntcgtgaccgacgaccggcctagttacttacgtgtcggacggaggaggaacgggaagtacgttaggaggtcggatacgaggactgggtagtaaggngttaacggg

SEQ ID NO: 238995 - DNA, 511 bp, Homo sapiens
  misc_feature: GYAE6OF01BZ8IA.4.18.B07.1.454.CMB.1.raw
  modified_base (395)..(395): a, c, t, g, unknown or other
  misc_feature (395)..(395): n is a, c, g, or t
  modified_base (488)..(488): a, c, t, g, unknown or other
  misc_feature (488)..(488): n is a, c, g, or t
  modified_base (504)..(504): a, c, t, g, unknown or other
  misc_feature (504)..(504): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggccctggacaagggcttgagtggatgggacggatcaaccctaacgaccggtgcacaaacaacgcacagaagtttcagggcagggtcaccatgaccgaggacacgtcctnagcacacgcctacgtggaggtgagcaggctgagatcgagacgacgacggcgttgtattactgtggcgagagaggagtatggagtcggatacgngtcgtagtggttaagngtaacgg

SEQ ID NO: 238996 - DNA, 543 bp, Homo sapiens
  misc_feature: GYAE6OF01C1HY5.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagctggggcctcagtgaaggtctcctgcaaggcttctggatacaccttcaccggctactatatccactgggtgcgacaggcccctggacaaggcttgagtggagtggacgataaaccctaagaccggtggcaacaaacaacgcaacagaagtttcagggcagggtcaacgatgaccgagggacacggtccttcagcacagcctacgtggagtgagcaggctgagatctgacgacgacggtccgttagtattaccgtgtgcggtaagacggaaggaacgtacgttaggaagtcggaacgtaacgaggtcgttaggtaggttaaggaaggtggtaaccg

SEQ ID NO: 238997 - DNA, 601 bp, Homo sapiens
  misc_feature: GYAE6OF01DQBMX.4.18.B07.1.454.CMB.1.raw
  modified_base (246)..(246): a, c, t, g, unknown or other
  misc_feature (246)..(246): n is a, c, g, or t
  modified_base (453)..(453): a, c, t, g, unknown or other
  misc_feature (453)..(453): n is a, c, g, or t
  modified_base (590)..(590): a, c, t, g, unknown or other
  misc_feature (590)..(590): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggtcttcgnggatacaccttccaccggctactatatccacgtgggtgccgacaggccccctggacgaaggggcctttaggaggtgggagttggggaaccgggacttaccgaaacccctaacgacccgggtggaccaaccaaaacgaaccgcaacaagtaaacggtttcgagggcgaggggtcaaccgagtacgaccgagggaccaccgtcccttanacggcacgacgcctacgttgggaggtgagcaggctgagtatcgtgacgacgacggtccgtgtacttacgtgtcgcgagagagggaacgtacgttggacggtacggataccgtaggtacgttagggtaggttaaaggnggttaaccggg

SEQ ID NO: 238998 - DNA, 544 bp, Homo sapiens
  misc_feature: GYAE6OF01AENAM.4.18.B07.1.454.CMB.1.raw
  modified_base (537)..(537): a, c, t, g, unknown or other
  misc_feature (537)..(537): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacacggcccctggacaagggcttggagtggagtgggacggataccaaccctaacgaccggtgacacaaacaacgcaacagaacgtttcgagggcagggtcaccagtcgaccgagggacacgtccttacacgcacacgcctacgttgggagtgagcgaggctaggagagtcgtaggacgacgaccggtcgtgtacttacgtggtgcgagagaggtaagacgttaggagtacggatacgagtctaggtaggttaagnggtacgg

SEQ ID NO: 238999 - DNA, 526 bp, Homo sapiens
  misc_feature: GYAE6OF01B6Z6I.4.18.B07.1.454.CMB.1.raw
  modified_base (395)..(395): a, c, t, g, unknown or other
  misc_feature (395)..(395): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacacggcccctggacaagggcttgagtggagtgggacggatcaacctaacaccggtggcacaaacaacgcacagaagttcagggcagggtcacatcgaccgaggacacgtctnacgcacacgcctacgtggagtgagcgagcgtgagacgtcgtagacgacgaccggcgttagtattacgtgtgcgaggagaggaagtagtaggaggtacggagtacgagtcgtaggtagggtaagaggtacgg

SEQ ID NO: 239000 - DNA, 513 bp, Homo sapiens
  misc_feature: GYAE6OF01BTQOL.4.18.B07.1.454.CMB.1.raw
  modified_base (504)..(504): a, c, t, g, unknown or other
  misc_feature (504)..(504): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacacctttcaccggctactatatccactggtgcgacaggcccctggacaagggcttgagtggatgggacggatcaaccctaacaccggtggcacaaacaacgcacagaagtttcagggcagggtcaccatgaccagggacacgtccttcagcacagcctacttggaggtgagcgaggctagagatctgacgacacggccgtgtattactgtgcgagagaggaagagttgagtcggatacgagctaggtggttaagnggttaacgg

SEQ ID NO: 239001 - DNA, 527 bp, Homo sapiens
  misc_feature: GYAE6OF01E4G9Y.4.18.B07.1.454.CMB.1.raw
  modified_base (441)..(441): a, c, t, g, unknown or other
  misc_feature (441)..(441): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttggagtggatgggacggatcaaccctaacaccggtggcacaaacaacgcacgagaagtttcgagggcagggtcaccgatcgacgaggacacgtccttacacgcacagcctacgttgaggtgagcgaggctgagatcgngacgacgacggccgtgtatacgtgtgcgagagaggaagtacgtggtacgtcggaatacgagtctagtacgggtagaggttaacggg

SEQ ID NO: 239002 - DNA, 515 bp, Homo sapiens
  misc_feature: GYAE6OF01BLD94.4.18.B07.1.454.CMB.1.raw
  modified_base (460)..(460): a, c, t, g, unknown or other
  misc_feature (460)..(460): n is a, c, g, or t
  modified_base (470)..(470): a, c, t, g, unknown or other
  misc_feature (470)..(470): n is a, c, g, or t
  modified_base (506)..(506): a, c, t, g, unknown or other
  misc_feature (506)..(506): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacgatcaacctaacaccggtggcacaaacaacgcacagaagtttcagggcagggtcaccatgaccagggacacgtcctcagcacagcctactggaggtgagcaggctgagatctgaccgacacgggccgttagtatactgtgcgngagagggaanacgttggagtcggatacgagcgtaggtaggttaagnggtaacggg

SEQ ID NO: 239003 - DNA, 523 bp, Homo sapiens
  misc_feature: GYAE6OF01BUB5D.4.18.B07.1.454.CMB.1.raw
  modified_base (429)..(429): a, c, t, g, unknown or other
  misc_feature (429)..(429): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagccgtgggcctcagtgaaggtctcctgcaaggtcttcgtggatacaccttcaccggctactatatccactggtgcgacagcccctgaacaggcttgagtggatgggacggatcaacctacgaccggtggcacaaacaacgcacagaagttcgagggcagggtcaccagtgaccgaggacacgtccttcagcacagcctacgttggaggtgagcgaggctgagntcgagacgacgacggaccgtgtagttactgtgtcgagaggaggaagtattggacgtcggaatacgagtcgtaggtaggttaaggaggtaacggg

SEQ ID NO: 239004 - DNA, 529 bp, Homo sapiens
  misc_feature: GYAE6OF01BO3US.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtcctcctgcaggcttctggatacaccttcaccggctactatatccactgggtgcgacaggcccctggacaagggcttggagtggagtgggacggatccaacccgtaacaccggtggcacaaacacgcacagaagtttcagggcagggtcaccgatgacagggacacgtccttcagcacagcctactggagtgagcgaggctggagatctgacgacgacggccgtagtattacgtgtgcgtagaggaggaacgtagttggacggtacggatacgaggcttaggaggtttaagaggttaacggg

SEQ ID NO: 239005 - DNA, 695 bp, Homo sapiens
  misc_feature: GYAE6OF01A9FDQ.4.18.B07.1.454.CMB.1.raw
  modified_base (245)..(245): a, c, t, g, unknown or other
  misc_feature (245)..(245): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtgggctgaggtgaagagccgtggggcctcagtgaaggtctcctgcaaggcttcgnggatacaccttcaccggctactatactccacgtggtgcgacacggccccgtaggacgaaggcttggagtggagtgggaacgactaccgaaacccgtaacgaccgggtcgacaaaccgaaaacgaaccgaccaaacgaacggtaaacgtttacggaaggggaccgaacggggttccaaaccgaagtacggaacccgagggaaccgtaccgttccttaccgacgaccaaccgacggacccttaacggttcgggaagggttcgaacgtacgacgggtacgtaggaagtacgtaccgtaggaacccgaaccggtaccgggtaccgtttaggtaacgtttacgaggttggaccggtaaggaaggtaacgggtaaggtaccgttagggtaacggtacggtaaagtaacggtacggtacgttaagggttaagggtttaaagggaagggttaaccggg

SEQ ID NO: 239006 - DNA, 513 bp, Homo sapiens
  misc_feature: GYAE6OF01EQIYI.4.18.B07.1.454.CMB.1.raw
  modified_base (399)..(399): a, c, t, g, unknown or other
  misc_feature (399)..(399): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (505)..(505): a, c, t, g, unknown or other
  misc_feature (505)..(505): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctctttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaaccctaacaccggtgacacaaaacaacgcacagtaacgttcagggcagggtcacatgaccaggacacgtctcancacagcctactggaggtgagcagctgagtatctgacgacgacggccgtgtattacgtgngngagagaggaagattggagtcggatacgagtctaggtcggtaaagnggtaacgg

SEQ ID NO: 239007 - DNA, 665 bp, Homo sapiens
  misc_feature: GYAE6OF01CB4H3.4.18.B07.1.454.CMB.1.raw
  modified_base (246)..(246): a, c, t, g, unknown or other
  misc_feature (246)..(246): n is a, c, g, or t
  modified_base (442)..(442): a, c, t, g, unknown or other
  misc_feature (442)..(442): n is a, c, g, or t
tcagagcactgtagcacgaccggtgctcgatttagtcgctgcgtaaggggagcatcacccagcaaccacatctgtcctctagagaatcccctgagagctccgttcctcaccatggactggacctggaggatcctcttcttggtggcagcagcctcaggacgcccactcccaggtacagttgtgcagtctggggctgaggtgaagagccgtggggcctcgagtgaaggtctcctgcgaaggcttcgnggactaaccaccttcgaccggcttaactataactcccaacgttggggtcgaccgaacgaacgggccccctaggaacaaaggggtcctttaggaagttgggaacttcggggaacggtatacccgaaaccgtaaccgaccgggtcggaccaaacaaaacgaacgctaacaaggtacgttcaagggcagggtccaacgntacggaacgagggactacgtccttacacgtacacgacgtcctaagttggaaggtcgaagtcgaacggcgtagagtacgtactacggaccgaaccgtaaccggtacggtagtttaacgttaccgtggtacggtacgtacggtaaaggacgggtaaacgtacgttagggtaacgtacgggaacttaacgagtcggttaggtaaggttaaagggacgtttaacggg

SEQ ID NO: 239008 - DNA, 632 bp, Homo sapiens
  misc_feature: GYAE6OF01ANBDG.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagacgccgtggggcctcgagtgaacggttctcctgcgaaggtcttcgtggactaccaccttcgaccggtctactatactccacgtgggtcgcgacgcggccccgtggacgaagggcttggaggtggagtcgggacgataccgaaccgtaacgaccggtggacaacgaaacacgacaacaggtaagttcgacgggcgacgggtacaccgagtacggaccgagggacctaccgttcctaccgacgtacacgacgtaccttacgtgggacggtgacggcgaggctagacgtactcgtacgaccgacgtaccggtcgttagtacgttacgtcggtcggacgtaggaaggtaacgggaacgttaccggttaggaacggttacggtaacgtaacgtacggtcggttagggtacggttaaggtaaggttaccgg

SEQ ID NO: 239009 - DNA, 635 bp, Homo sapiens
  misc_feature: GYAE6OF01CMHLI.4.18.B07.1.454.CMB.1.raw
  modified_base (297)..(297): a, c, t, g, unknown or other
  misc_feature (297)..(297): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggagcccactcccaggtacagttggtgcagtcgtggggctgaggtgaagaagccgtggggcctcgaagtgaaggtctcctgcgaaggcttcgtaggatacgtaccttcgaccggtctaactatactccaacgtgggtcncgacgacggcccctaggacaaggcttgagtggagtgggacgagtaccaacctaacgacggtcgacaacaaacgacgacaacagtaacgttcagggacagggtacacgagtacgaccgagggactacggtccttacgacgccaacgacgaccgttacgtagggagggtcgacggtaccgagggtaccttaggaagtacttaccggacggaccggtaaccgacccgggtacgtacgttaacgttaccgtggtacgcggtaaacgtagggaaggacgtaacgttacggtaggtacggtaagtacgtacggtcttagggttaggttaaaggtgttaaccggg

SEQ ID NO: 239010 - DNA, 620 bp, Homo sapiens
  misc_feature: GYAE6OF01CXM3M.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcaggacgcccactcccaggtacagttggtgcagtcgtggggctggaggtgaagagccgtggggcctcgagtgaaggtctccgtgacaaggtcttcgtggataccaccttcgaccggctaactatactccagtgggtcgcgacgacggcccctaggacgaagggtcttggaggtggagtcgggacgataccaacccgtacgacggtcgacaacaaacaacgcacgaagtacgttcgagggacagggtaccaacgagtacggaaccgacgggaactacggtccttacgacgaccaacgacgtaccgttacgttgggaggtacgacgtacggaggtctagacgtatacgtacgacgaccggacggtaccgtagtaacttacgtggagcggaagtaagggacggtaagtacgtggtacggtacggtaatacgtagtacgttaggttaacgggtaagtcggttaacggg

SEQ ID NO: 239011 - DNA, 544 bp, Homo sapiens
  misc_feature: GYAE6OF01ANW4S.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcgtggatacaccttcaccggctactatactccatggttgcgacacggcccctggacaagggcttgagtcggatgggacgatcaaccgtacaccggtggacacaaacacgacacgagtagttcagggcaggtcacatgaccaggacacgccttacgacgtacacacgcttacgtggagtgacgcgagtcgtgagatcgtagaccgacgaccggtcgtagtacttacgtgcggtacgaggagacggtaagtacgttaggacgtcggtaatacgacgtcgtaggttaacggttagaggttaacgg

SEQ ID NO: 239012 - DNA, 529 bp, Homo sapiens
  misc_feature: GYAE6OF01EGG9M.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttcgtggatacaccttcaccggctactatatccactggtgcgacaggcccctggacaagggcttgagtggagtgggacggatcaaccctaacgaccggtgcacaaacacgcacagagttcagggcaggtcaccatcgacagggacacgtccttcagcacagacctacgttggaggtgagcaggctagagatcgtgacgacgaccggtccgtgtacttacgtgtgacgagaggaggaagtagttaggagtacggatacgagcgttaggtcggttaaggaggttaacggg

SEQ ID NO: 239013 - DNA, 607 bp, Homo sapiens
  misc_feature: GYAE6OF01BSNI5.4.18.B07.1.454.CMB.1.raw
  modified_base (250)..(250): a, c, t, g, unknown or other
  misc_feature (250)..(250): n is a, c, g, or t
  modified_base (395)..(395): a, c, t, g, unknown or other
  misc_feature (395)..(395): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctgaggtgaagaagccgtggggcctcgagtgaaggtctccgtgcaaggcttcgnggatacaccttcaccggctactatactccacgtgggtgcgacacggccccgtggacgaagggcttggagtggagtgggacggataccaaaccctaacgaccggtgcaacaaacaacgcaacagaagttcgagggcagggtcacancgaccgaggaccacgtccgttcgagtcaacgacgacctacgttagggacggtagagcgagggctaggaacgtagtacgtagaacggacgaccgggtccgttagttacgttacgtggtacggacgtaggaaggaaggtaacgtacgttaggtacggtacggtaacgtacggtacggtacgttaagggttaggttaaaggtgggttaaaccggg

SEQ ID NO: 239014 - DNA, 705 bp, Homo sapiens
  misc_feature: GYAE6OF01D12R8.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctgggaggatcctcttcttggtggcagcagcctcaggacgcccactcccgaggtacagttggtgcagtcgtggggctgaggtgaagagccgtgggcctgagtgaaggtctcctgcaaggtcttctaggatacctaccttccgaccggctaactatactccacgtgggtcgccgacgacggccccgtgggaccgaaggggtcttaggaggtgggagtggggacggactccgaaacccgtacgaccggtggacaacaaacaacgacaacgaggtaaacgtttcggagggacgagggtaccaccaagacgaaccggaacgggtaccaccgttcccttcaacggcaaccgacggtacccttacggttcgggagggtacgacggacgagggcgttaggagtacgttacgtacgaaccggaccggtaccggtcccgttagttaacgtttacggtggtacggtaccggaagggaacggtaaacgggtaaacggttacggttaggtaaacgggttaccggtaaagttaacccggtagggttaccgggttaggggtttaaaggggtttaaggtaacggggttaaacccggg

SEQ ID NO: 239015 - DNA, 576 bp, Homo sapiens
  misc_feature: GYAE6OF01ELZD7.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagaagccgtggggcctcgagtgaaggtctcctgcaaggtcttcgtggatacaccttcgaccggctactatactccacgtgggtgcgacacggcccctggacgaagggcttggagtggagtgggacgatacgaaaccctaacgaccggtggacaacaaacgacgacaacgaagtaacgttcgaggcgacgggtcaccagtcgacgaggacacgtctcgagcacgagctacgtaggaggtgagcgaggctaggagtacgtacgtacgacgacgacgggtccgttagtaacgttaccgtagtggaccggtaggaaggtaagggtaagtaccgttagacggtacgagtacgagtcgtagtaggttagtaggtacgg

SEQ ID NO: 239016 - DNA, 602 bp, Homo sapiens
  misc_feature: GYAE6OF01DTZSQ.4.18.B07.1.454.CMB.1.raw
  modified_base (246)..(246): a, c, t, g, unknown or other
  misc_feature (246)..(246): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttcgnggatacaccttcaccggctacctatactccacgtgggtgcgacacggcccctgggacagggcttgagtggatgggacgataccaaccctaacgaccggtggacaacaaacaacgacacaagtaacgttcgaggggcagggtcaaccgatacgacgagggaccaccgtccttcacgcacgacgtacctacgttagggaggtgagtcgacggtctaggagctacgtacggaaccggaccgaccgggtccggttagttaatttcgtaggttggaccggaggaggaacgggtaaacgtacgttaggaggttacggaagtaacgtagacgttagggttaagggttaaggtaggttaaccgg

SEQ ID NO: 239017 - DNA, 520 bp, Homo sapiens
  misc_feature: GYAE6OF01B51C4.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactggtgcgacaggcccctggacaagggcttgagtggatgggacggatcaaccctaacaccggtggcacaaacaacgcacagaagtttcagggcagggtcaccatgaccagggacacgtcctcagcacagcctacttggaggtgagcaggctgagatctgacgacgacggccgttgtattacgtgtgcgagaggaggaagagttaggaggtcggagtacgagactggtaggttaaggaggttaacggg

SEQ ID NO: 239018 - DNA, 540 bp, Homo sapiens
  misc_feature: GYAE6OF01AO65I.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaaggcttgagtggatgggacggatcaaccctaacaccggtggcacaaacaacgcacagaagttcagggcagggtcaccgtgacgacggacgacgtccttctacgacacacgacctaccgttaggaggtggagcgaggcgtgagagtctgacgacgacgtccggtagtagttactgtgcgagaggaggaaggtacgttgaggtacggagtacgagacgtagtagggttaaggtaggtaggtaccg

SEQ ID NO: 239019 - DNA, 516 bp, Homo sapiens
  misc_feature: GYAE6OF01EJC7R.4.18.B07.1.454.CMB.1.raw
  modified_base (459)..(459): a, c, t, g, unknown or other
  misc_feature (459)..(459): n is a, c, g, or t
  modified_base (509)..(509): a, c, t, g, unknown or other
  misc_feature (509)..(509): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaaggggcttgagtggatgggacggatcaaccctaacaccggtggcacaaacaacgcacagaagtttcagggcagggtcaccatgaccagggacacgtccttcagcacagcctacttggacggtgagcaggctgagatctgacgacgacggccgtgtattacgngtgacgagagaggaagacttggagtcggatacgagcgtaggtggttaagnggtacgg

SEQ ID NO: 239020 - DNA, 851 bp, Homo sapiens
  misc_feature: GYAE6OF01DXQE2.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtactagttggtgcgaggtctggggctggaggtgaagagccgtggggcctcgaggtgaacggtctcctgacgaaggtcttcgtggtaactaccgtaccgttaccgaccggtaccttaacttactaactcccgtaccgttggggtacgtccggaaccgacgggtcccccgtagggtaaccgaaacggggtcgttaggacggttggaggttacggggacggtaacgtacccgaaacccgtaaccggtaccgggtacggaccgaaaccgaaaaccgaaacgaccaacgtaacgtaaacggtttaccggaagggtaccgacggggtaccaaccgtaacgttacggaacccggaacgggtaaccgtaaccggttacccgttacgacggtaaccaaccgtacgtacccgttaacggttagggtacggtacggaacggtacgacgggtcgtaacggtacgtaacggtccggtaacggaaccggtaaccgggtaaccgggttacccggttaacggtttaaccgtttaaccgggttacggttacgggaacgggtaacgggtaaacgggtaaacgggtaaacggttaacgggttacgggtaaacgggttaccgggtaaacgttaaccgggtaacggttaccggttaagggtttaaccgggtttaaagggtaacgggtttaacccgggg

SEQ ID NO: 239021 - DNA, 517 bp, Homo sapiens
  misc_feature: GYAE6OF01BA08O.4.18.B07.1.454.CMB.1.raw
  modified_base (499)..(499): a, c, t, g, unknown or other
  misc_feature (499)..(499): n is a, c, g, or t
tcagagcactgtagcacgaccggtgctcgatttagtcgctgcgtaagggggagcatcacccagcaaccacatctgtcctctagagaatccccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggagtgggacggatcaaccctaacgaccggtggcacaaacacgacacagaagtttcagggcagggtcaccgatgaccagggacacgtccttacagcacacgacctacgttggaggtgagcgaggctaggagatcgtagacgacgacggccgtgtatactgtgtcgagagaggagtagtgaggtcgatacngctagtggtagagtacgg

SEQ ID NO: 239022 - DNA, 526 bp, Homo sapiens
  misc_feature: GYAE6OF01DU40Q.4.18.B07.1.454.CMB.1.raw
  modified_base (518)..(518): a, c, t, g, unknown or other
  misc_feature (518)..(518): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatactccactgggtgcgacaggcccctggacaagggcttgagtggatgggacgatcaaaccctacaccggtggacaacaaacaacgcacagaagttcagggcgagggtcaacatagaccgagggacacgtccttcagcacacgcctacgttggaggtgagcgaggctggagatctagaccgacacggcgttagtattactgtcgcgagaggaggaagtagtgagtacggatacgagactaggtacggtaagnggtaacgg

SEQ ID NO: 239023 - DNA, 614 bp, Homo sapiens
  misc_feature: GYAE6OF01BJO98.4.18.B07.1.454.CMB.1.raw
  modified_base (246)..(246): a, c, t, g, unknown or other
  misc_feature (246)..(246): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtctggggctggaggtgaagagccgtgggcctcagtgaagtcctcctgcaaggcttcgnggatacaccttcaccggctactatactccacgtgggtgcgacgacggccctggacgaagggctaggagtggagtgggacgactacgaacctaacgaccggtcggacaacgaaacaacgcacaagtaagttcgacgggacgacgggtcaaccgagacgaaccgagggtaccgaccgtccttacgacgcaacgacgtcctacgtagggaggtagacgacgaggacgtgacgtagtcgtacgacggacgtaccgggtaccgttagttaacgttacgtggtacggacggaaggaaggtaagggtacgtaacgtgggtacggtacggataacggtacgtacggtaggttagggttaaaggtgggttaaaccgg

SEQ ID NO: 239024 - DNA, 528 bp, Homo sapiens
  misc_feature: GYAE6OF01BPHW4.4.18.B07.1.454.CMB.1.raw
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (474)..(474): a, c, t, g, unknown or other
  misc_feature (474)..(474): n is a, c, g, or t
  modified_base (503)..(503): a, c, t, g, unknown or other
  misc_feature (503)..(503): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagaagccgtggggcctcgagtgaaggtctcctgcaaggcttcgtggatacaccttcaccggctactatactccactgggtgcgacacggcccctggacgaagggcttgagtggagtgggacgatacaaccctaacgaccggtggacaacgaaacaacgacacgagaagttcgagggcagggtcacatacgaccgaggacacgtcctgacgcacacgcctacgtggagtgagcgaggcgngagntcgagacgacgacggcgtgtactagngtgcgagagaggagtagtggacgtacganacgtagctaggtagtagaggtacgg

SEQ ID NO: 239025 - DNA, 594 bp, Homo sapiens
  misc_feature: GYAE6OF01A04DX.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagagccgtggggcctcagtgaaggtctcctgcaggcttcgtggataccaccttcacccggctactatactccacgtgggtcgcgacacgggcccctggacaagggtcttgaggtggagtgggacgataccaaccgtaacgaccggtgacaacgaaacacgacaacagtaacgttcgagggacagggtccaccgatacgaccgaggaccacgtcctacacgcacgacgtcgttaccgtgggtaagtggaggtacggctaggagtactcggtacgacgtacgcgggtaccgttagttagttaccgtggtacggacggacggaggaaggtaacgtacgttaggaggtacggagtaacgcggtacgttaggttaggttaacggaggtggtaccg

SEQ ID NO: 239026 - DNA, 574 bp, Homo sapiens
  misc_feature: GYAE6OF01ANYYA.4.18.B07.1.454.CMB.1.raw
  modified_base (403)..(403): a, c, t, g, unknown or other
  misc_feature (403)..(403): n is a, c, g, or t
  modified_base (480)..(480): a, c, t, g, unknown or other
  misc_feature (480)..(480): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttctggatacaccttcaccggctactatatccactgggtgcgacaggcccctggacaagggcttgagtggagtgggacggatacaaccctaacgaccggtggcaacaaacaacgcacagaagttcgaggcacgggtcaccatcgaccgagggacacgtcctnagcacagcctacgtggaggtgacgcaggtctagagtactcgtcggaacgaccgacggtcccgttagtaactttacgngttcggacggaggtaaggagggtaaacgtaccgtttaggacggttcggaacttacggaggttacttagggtagggttaaaggtggttaaccggg

SEQ ID NO: 239027 - DNA, 574 bp, Homo sapiens
  misc_feature: GYAE6OF01D6SGH.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcgagtgaaggtctcctgcaaggcttcgtggataccaccttcaccggctactatatccactgggtgcgacacggccctggacaagggcttgagtggagtgggacggatcaaacctaacgaccggtgaccaacaaaaccaacgcaacagaacggtttcagggcagggtcaccgatcgacagggacacgtcctcgagcacacgctacgtggaggtgagacgaggctagacgagtcgtacgacgacgtacggacgttgttaacttacgtggtgacggtaggaggaagggtaacgtagttaggtacggtacgggaacgtaacgacggtcgttagggttagggttaaaggtggttaaccggg

SEQ ID NO: 239028 - DNA, 730 bp, Homo sapiens
  misc_feature: GYAE6OF01ETBR7.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctggaggtgaagaagccgtggggcctcgagtgaaggtctcctgcgaaggtcttcgtggactacaccttcaccggctactatactccacgtgggtgcgacacggcccctggacgaagggcttggaggtggagtgggacggataccgaaacccgtaacgaccgggtgaccaacaaaaccgaacgacaacgaacggtaaacgtttcgaaggggtaccgaacggggtaccaacccgtaagtacggaacccgtaacggggaacctacccgttaccgttacgaacggtaccaaccgacggtacccgttaacgttacggggacggttacggacggacgagggtccgtaggacgtaacgtcgtaacggaccggtaaccgtaccgggtaccgttacggttaacgtttaccggtaggtacgggtaccgggaaggtaaacgggtaagggaaacggttaacgtttagggtaacggttaccgggtaacgttaaccggtacggttaccggttaagggttaacgggtttaaaggagggtttaaaccggg

SEQ ID NO: 239029 - DNA, 513 bp, Homo sapiens
  misc_feature: GYAE6OF01D47QU.4.18.B07.1.454.CMB.1.raw
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactggtgcgacaggcccctggacaagggcttgagtggatgggacggatcaacctaacaccggtggcacaaacaacgcacagaagtttcagggcagggtcaccatgaccagggacacgtccttcagcacagcctacttggaggtgagcgaggctgagatctgacgacacggccgtgtattacgtgtgcgagagagggaagagttggngtcgganacgagctaggtggttaagaggtaacggg

SEQ ID NO: 239030 - DNA, 774 bp, Homo sapiens
  misc_feature: GYAE6OF01C9EF2.4.18.B07.1.454.CMB.1.raw
  modified_base (765)..(765): a, c, t, g, unknown or other
  misc_feature (765)..(765): n is a, c, g, or t
tcagagcactgtagcacgaccggtgctcgatttagtcgctgcgtaagggggagcatcacccagcaaccacatctgtcctctagagaatcccctgagagcctccgttcctcaccatggactggacctggaggatcctcttcttggtggcagcagcctcaggacgcccactcccgaggtacagttggtgcagtcgtggggctggaggtgaagagccgtgggcctgagtgaaggtctcgtgacaaggtcttacgtggtactaccgtaccttccgaccggtctaacttactactccgacggtcggggtcgaccggaccgacggtcccccgtagggaaccgtaacggggtcctttagggagggttgggaacggttacgggggaaccggtaacgtaacccgtaaaaccccgtaaccggtaacccgggtacggaacccaaaaccgaaaaaccgaaccggaccgaaaaccgtaacgggttaaaacggtttccggaaccgggggtaccgtaaacgggggttacccaaacccgtaagtaccggaacccggaacgggtaccctaaccggttccctacgacgaccgtaaccgacggtacccgtttaaggttagggaacgggtacgacggacgtacgggtctaggaacgacgttccgacgggacccgaacggtaccggtccgttagtacgttacgtggtacggacgaagggaaggtaaggtaacgtaggttaggacggttacggagtaacgaggtacgttagggttaagggttaaggnggtaaccgg

SEQ ID NO: 239031 - DNA, 651 bp, Homo sapiens
  misc_feature: GYAE6OF01EMNJ4.4.18.B07.1.454.CMB.1.raw
  modified_base (516)..(516): a, c, t, g, unknown or other
  misc_feature (516)..(516): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgccccactcccgaggtactagttggtgcaggtcgtggggctggaggtagaagaacgccgtggggcctacgaggtagaaggttcctccgtgacgaaggtcttcgtaggactacctacccttcgaccggtctacgtactactccgtacgtgggtgaccggtaccgaccggccccgtagggaacgtaacgggtcttaggaggtggagtacgggacgactaccgaaacccgtaccgaccggtgaccaacgaaacgacgcaacgagtaacgttcgacgggacgacgggtaccaacgagtacggaccgaacggacctaccgtcctacgaacgccaacgacgaccttagtgggagtgacgngacggcgaggacagtcgagacgacgtaccggtcgttagtagttacgtgtacggaggagaaggtaggtaacgtagttaggaacggtacggactaacgtacgttcgttaagggttaggtaaagtcgggttaaaccgg

SEQ ID NO: 239032 - DNA, 565 bp, Homo sapiens
  misc_feature: GYAE6OF01ED6E8.4.18.B07.1.454.CMB.1.raw
  modified_base (558)..(558): a, c, t, g, unknown or other
  misc_feature (558)..(558): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagaagccgtggggcctcagtgaaggtctcctgcaaggcttctggatacaccttcaccggctactatactccacgtgggtgtgacacggccccgtggacgaaggggcttggaggtggagtgggacggataccaaccgtaacgaccggtggaccaacaaaacacgcaacagtaagttcgagggcagggtcaccgatcgaccgagggacacgtccttcagcacgacgcctacgtgggaggtgacgcgaggctagagtactcgtacgacggacgacggccgttagttacttacgtaggtcgcggaggaggaaggtacgtagttggacgtacggatacgagtacgtaggttaggtaagnggtacgg

SEQ ID NO: 239033 - DNA, 577 bp, Homo sapiens
  misc_feature: GYAE6OF01AKX02.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctggggcctcagtgaaggtctcctgcaaggcttctggatacaccttcaccggctactatatccacgtgggtgcgacaggcccctggacaaggcttgagtggatgggacgatccaacccgtaacgaccggtggacaacgaaaacaacgcaacagaacgtttcgagggcagggtcacatgaccgaggaccacgtcctcagcacacgcctagtggaggtgagtcaggctagagatcgtaggaccgtacgaccggtccgttagttacgttacgtcggtcggacggtaggaacggtaagggaaacgtacgttagggaacgttacgggaattaacgacggtcgttaggttacgggttaaaggtagggttaacggg

SEQ ID NO: 239034 - DNA, 729 bp, Homo sapiens
  misc_feature: GYAE6OF01BD9BF.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagaagccgtggggcctcgagtgaacggtctccgtgcgaaggtcttcgtgatacaccttcaccggctactatactccactgggtgcgacgacggccccgtaggacgaagggtccgttaggaggtgggaagtggggaacggagttaccgaaaccctaacgacccgggtacgggacaaccgaaaaccgaaacgaccgaacgaaacggtaaacggttttacgaacggggacgtaacggggtaccaaaccgtaacgttacggaacccgaacgggtaaccgtaacccggttacccgttaccgtagaaccgtaccgaacggtacccttaacggttacgggtaagggtacggtaggccgaaggtcgttagaacgtagtacgacggaacggaccgtaaccgggtaccgttagttaacgttacgttaggtcggtaccggtaaggaacggtaaggtaacggaagtttacgggaacggtacgggtaagtaacgtacggtacgtaggtttaagggttaaacggtaaggttaaaccggg

SEQ ID NO: 239035 - DNA, 552 bp, Homo sapiens
  misc_feature: GYAE6OF01D9VWT.4.18.B07.1.454.CMB.1.raw
  modified_base (320)..(320): a, c, t, g, unknown or other
  misc_feature (320)..(320): n is a, c, g, or t
  modified_base (543)..(543): a, c, t, g, unknown or other
  misc_feature (543)..(543): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagccgtggggcctcagtgaaggtctcctgcaaggcttcgtggatacaccttcaccggctactatatccactgggtgcgacacggcccctggacgaggcttgagtggatgggaganacaaccctacgaccggtgacaacgaaacacgcacagtaagttcgagggcagggtcacgatcggaccgacgggaccacggtccttcgacgacacgacgcctacgttgggacggtgacgcgaggctgagatcgtagacgccgtacggtcgtagtattacgtggtcgacgaggaaggaggtaacgtagttggaggtacggatacgtgtacgttaggttagtaaggnggtaaccgg

SEQ ID NO: 239036 - DNA, 670 bp, Homo sapiens
  misc_feature: GYAE6OF01DOAVC.4.18.B07.1.454.CMB.1.raw
  modified_base (251)..(251): a, c, t, g, unknown or other
  misc_feature (251)..(251): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctggaggtgaagaagccgtggggcctcgagtgaaggtctcctgcgaaggtcttcngatacaccttccaccgctactatatccacgtggtgccgacgacggccccgtaggacaagggctttaggaggtgggagtaggggaacggtaactacccgaaaacccctaacgacccgggtaggaccaaacaaaaccaaacgaccaacgaagtaaacggtttcgagggcgacgggtaccacctagtacgaccgaagggtacaccgtaccttcaacgaccacacgtaccttagtacgggaggtagcgtacgaggtctagacgtataccgtacggaccgaacgtaccgggtaccgttgtttaacgttaccgtgggttcggacggtaagggtaggaagggtaaagtaacggtttagggaacggttacgggtaataaccggtaggtaccgttagggttaacgggttaaaggtaggttaaaccggg

SEQ ID NO: 239037 - DNA, 549 bp, Homo sapiens
  misc_feature: GYAE6OF01DZI84.4.18.B07.1.454.CMB.1.raw
  modified_base (244)..(244): a, c, t, g, unknown or other
  misc_feature (244)..(244): n is a, c, g, or t
  modified_base (409)..(409): a, c, t, g, unknown or other
  misc_feature (409)..(409): n is a, c, g, or t
  modified_base (440)..(440): a, c, t, g, unknown or other
  misc_feature (440)..(440): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcnggatacaccttcaccggctactatatccactgggtcgcgacacggcccctggacaaggggtcttggagtggagtgggacggatccaaaccctaacgaccggtgacaacgaaacaacgcacaagtaagttcgagggcagggtcacatgaccgagggacacgtcctnacgcacacgcctagtgggaggtgagcaggcncgagctcgtgaccgacgacggtcgtgttaatcgtgtgcgagaggaaggaacgtagttggagtaccggataaccgaggtacgttagggttagggttaaagtggtaacggg

SEQ ID NO: 239038 - DNA, 543 bp, Homo sapiens
  misc_feature: GYAE6OF01CW2S9.4.18.B07.1.454.CMB.1.raw
  modified_base (485)..(485): a, c, t, g, unknown or other
  misc_feature (485)..(485): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagaagccgtggggcctcagtgaaggtctcctgcaaggcttcgtggatacaccttcaccggctactatatccactgggtgcgacacggcccctggaccgaagggcttgagtggagtgggacgatcaaaccctaacgaccggtgcaacaaacaacgacacagtaacgttcaggggcagggtcaccatcgacgagggacacgtccttcagcacagtcctacgttggaggtgacgcgaggcgtagagatcgagacggacgacggccgttgtaattcgtggtcgnggagagacggtaagacgttggagtcggaatacgacgcgtaggttaggtaagtggtacg

SEQ ID NO: 239039 - DNA, 551 bp, Homo sapiens
  misc_feature: GYAE6OF01BRXS7.4.18.B07.1.454.CMB.1.raw
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctgggaggatcctcttcttggtggcagcagcctcaggagcccactcccaggtacagttggtgcagtcgtggggctggaggtgaagaagccgtggggcctcgagtgaaggtctccgtgcgaaggcttcgtggatacacctttcaccggctactatactccactgggtncgacncggccctggacaagggcttgagtggatgggacgatcaaccgtaacacggtggacacaaacaacgcacagaagtttcagggcagggtcacgatgaccaggacacgtccttcgagcacgacgcctacgtgggaggtgaggcgaggcgtggagacgtctcggacgacgacggccgttagtacttacgtgtagcgaggaaggaggagtagttaggaggtcggatacgaggtctaggttaggttaaaggtggttaaacggg

SEQ ID NO: 239040 - DNA, 533 bp, Homo sapiens
  misc_feature: GYAE6OF01BXUKI.4.18.B07.1.454.CMB.1.raw
  modified_base (220)..(220): a, c, t, g, unknown or other
  misc_feature (220)..(220): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctnagtgaaggtctcctgcaaggcttctggatacaccttcaccggctaactatatccactgggtgcgacaggcccctggacgaagggcttggaggtggagtgggacggatcaacccgtaacaccggtcggacaacaaaacaacgacaacaagtaatttcgagggcgagggtcacatgacaggacacgtccttacagacacagccctagtggaggtgacgcgaggcgtgagatctggacgacgacggtccgtagtatactgtgcgagaggaagagtatggagtacggatacgagctaggtaggttaagaggtaacgg

SEQ ID NO: 239041 - DNA, 537 bp, Homo sapiens
  misc_feature: GYAE6OF01BMMTS.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggagtgggacggatcaaccctaacgaccggtggcaacaaacaacgcacagaagtttcagggcaggtcacatgaccaggacacgtccttacgagaccacgacgaccttacgttgggaggtggagcagggctgagactcgtgacgacgacgggtccgtagttacttacgtgtggacgaggagaggaagtagttggagtcggatacgagtctaggtaggttaagagtacggg

SEQ ID NO: 239042 - DNA, 555 bp, Homo sapiens
  misc_feature: GYAE6OF01AX1G8.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacgaagggcttgagtggagtgggacggataccaacccgtaacgaccggtggaccaacaaacaacgcacagaagtttcgagggcagggtcaccagtcgaccgacgggactaccgtcctacacgccacgacgaccttacgttgggaggtgagcgaggctagagtatcgtagacgacgaccggtcgttgtacttacgtggtgacgagaggaaggagtacgtggacggtcggagtacgagtcgtaggttaggttaagaggtacgg

SEQ ID NO: 239043 - DNA, 647 bp, Homo sapiens
  misc_feature: GYAE6OF01BSMQX.4.18.B07.1.454.CMB.1.raw
  modified_base (251)..(251): a, c, t, g, unknown or other
  misc_feature (251)..(251): n is a, c, g, or t
  modified_base (561)..(561): a, c, t, g, unknown or other
  misc_feature (561)..(561): n is a, c, g, or t
tcagagcactgtagcacgaccggtgctcgatttagtcgctgcgtaagggggagcatcacccagcaaccacatctgtcctctagagaactcccctgagagctccgttcctcaccatggactggacctggaggatcctcttcgttggtggcagcagcctcgaggacgcccactcccaggtacagttggtgcagtcgtggggctggaggtgaagagcgtggggctgagtgaaggtctcctgacgaggtcttcgnggatacaccttcgaccggtctaactatactaccacgtgggtcgacgacgacggcccgtaggacgaacgggtcttaggaggtggaggtacgggacgactaccaaaccgtaacgaccggtacgacaacaaacgaacgcaacgaggtaagtttacgaggggacgtagggtacaaccgagtacggaaccgacgggacctacgtccttacgagacccgaacgacgtacccgtaagtcgggaacggtgacggacgacgggtactggaacgtataccggagaccggaacgtaccgggacgttagttacgtagtcggngaccggaagagggaaggtaacggtagttaggcggtaggtacgtaacggtagtcgttaagggttagttaaagggtaggttaaccggg

SEQ ID NO: 239044 - DNA, 675 bp, Homo sapiens
  misc_feature: GYAE6OF01DFFTW.4.18.B07.1.454.CMB.1.raw
  modified_base (252)..(252): a, c, t, g, unknown or other
  misc_feature (252)..(252): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagaagccgtggggcctcgagtgaaggtctccgtgacaagggtcttcgnggactacacctttcaccggctactatactccacgtgggtgcgacgaggcccctggacgaagggtcttgaggtggagtgggacggataccaaaccccgtaagacccgggtgcaacaaacgaaacgcaacaaggtaaacgtttcgacgggtcgaaggggtccaactacgtacggaaccgaaggggaaccacccggttaccttcgaacgacccgaacaacggtacccttaacgtttcgggggaggttacgggaacgcgacgggacgttagaaggtactaccgtacggaacccgaacgtaaccgggccggttacgttagtttaccgtggtacggacggaaggacggtaaagggtaaggtaccgttaggaacggtacgggtaataacggtagtacgttaggttaacgggtaaggtaggttaaaccggg

SEQ ID NO: 239045 - DNA, 594 bp, Homo sapiens
  misc_feature: GYAE6OF01CR5ZA.4.18.B07.1.454.CMB.1.raw
  modified_base (246)..(246): a, c, t, g, unknown or other
  misc_feature (246)..(246): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggagatcctcttcttggtggcagcagcctcaggagcccactcccaggtacagttggtgcagtctggggctgaggtgaagaagccgtggggcctcgagtgaaggtctcctgcaaggcttcgnggataccacttcaccggctactatatccacgtgggtgcgacgacggcccctggacaagggtctggagtggagtgggacgactacaacctaacgaccgtggcaacaaacacgacacagtaagttcgagggcagggtcacgatcgaccgaggacaccgtcctcagcaacacgtacctcgttggaggtgagcgacggtgagagtacgtccaggtaaccgacgtaccggtcggttacgtacgttactaggtggaacggaggtaaggtaagggaaacgtacgtttacgggaacggttccgggtaagttaacgacggtacgttaggttaagggtaaacggtaggttaaaccggg

SEQ ID NO: 239046 - DNA, 744 bp, Homo sapiens
  misc_feature: GYAE6OF01DT0G6.4.18.B07.1.454.CMB.1.raw
  modified_base (248)..(248): a, c, t, g, unknown or other
  misc_feature (248)..(248): n is a, c, g, or t
tcagagcactgtagcacgaccggtgctcgatttagtcgctgcgtaagggggaggcatcacccagcaaccacatctgtcctctagagaatcccctgagagctccgttcctcaccatggactggacctggaggatcctcttcttggtggcagctagcctcaggagtcccactcccaggtacagttggtgcagtcgtggggctggaggtgaagagccgtggggcctcgaggtgaggtctcctgcaggctcnggatacacttcaccggctactatatccacgtgggtgccgtacgacggcccctgggacgaaggggtcgttggaggtgggagtggggacggactaccaaaccctaacgaccggtggacgaacgaaaaccaacgacaacgaaggtaacgtttcgaggggccgaggggtacaccgtatacggacgacgggaacaccggttccttacgaacgtaccaacaacgtacccgttaacgtttagggaggttacggaacggacgtaacgggcgttagacggtacttaccgttacggaacggaaccgtaccgggtaccgttacggtttaagtttacccgttagggtacggtaccgggtaaagggtaacgggtaaacggggttaaaacggttaaccgtttaaggggtaaacgggttaacccgggggtaaagttaaaccccggtaagggtttacccggttaggggttttaacgggggtttaaaagggtaacggggtttaaaacccgggg

SEQ ID NO: 239047 - DNA, 672 bp, Homo sapiens
  misc_feature: GYAE6OF01DC7B3.4.18.B07.1.454.CMB.1.raw
  modified_base (660)..(660): a, c, t, g, unknown or other
  misc_feature (660)..(660): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctggaggtgaagaagccgtggggcctcgagtgaaggtcctccgtgcgaaggtcttcgtggactacctaccttcaccggtctactattactccacgtggtgcgacacgggcccctaggacgaagggcttggacgtggagtgggacgtataccaaaccccgtaacgaccgggtcggacaaaccgaaaacgaaccgacaacaacggtaaacgtttacgaaggggcctaacggggtaccaaccgtacgtacgaacccgaaggggaccctaaccggttcccttacgaacgcccaacgtacgtacccgttaggttgggaaggttcggaacgcgtacggtcgagaagtacttccggtagaccggaaccgtccggtccgttagttacttacgtaggttcgacgaaggaggaagggaaacgtagttaggacgttacggagttacgacggtacgttagggttaaggttaaaggnggttaaaccggg

SEQ ID NO: 239048 - DNA, 576 bp, Homo sapiens
  misc_feature: GYAE6OF01DM4XV.4.18.B07.1.454.CMB.1.raw
  modified_base (245)..(245): a, c, t, g, unknown or other
  misc_feature (245)..(245): n is a, c, g, or t
  modified_base (548)..(548): a, c, t, g, unknown or other
  misc_feature (548)..(548): n is a, c, g, or t
  modified_base (568)..(568): a, c, t, g, unknown or other
  misc_feature (568)..(568): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttcnggatacaccttcaccggctactatatccactgggtgcgacgacggccccctggaccgaagggcttgaggtggagtgggacggatccaaacccctaacgaccggtgacaacaaaacaacgacaacaagtaacgtttcgaaggggcacgggtcaaccagtacggaccgagggaaccaccgttccttacgacgacacacgtacctacgttgggaggtgagcgaggctggagtatcgtcgaacgacgacgggccgttagttacttcgtgtagcgaggagaggaaagtagttggagtacggataacgngtcgtaggttagggttaagnggtaacgg

SEQ ID NO: 239049 - DNA, 620 bp, Homo sapiens
  misc_feature: GYAE6OF01C89VJ.4.18.B07.1.454.CMB.1.raw
  modified_base (288)..(288): a, c, t, g, unknown or other
  misc_feature (288)..(288): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagagcctggggcctcgagtgaaggtctcctgcaaggtcttctggaactacaccttcgaccggctaactatactccacgtgggtnccgacacggcccctaggacgaagggcttaggaggtggagtgggacgatccgaaaccctacgaccggtggacaacaaacaacgcacagtaacgttcgagggcgagggccacgatcgaccgacggacacgtccttacagcacacgcctacgtggaggtgagcgaggtctcgagactcgtcggaacgacgaccggtcgttagttacttacgtggttacgcggaaaggtagggaacgggtaaaggtaacgtttacggggaaacgggttaccgggtaaagtacggtaacggttacggttagggtttaagggttaaaaggtacggggttaaaccgggg

SEQ ID NO: 239050 - DNA, 562 bp, Homo sapiens
  misc_feature: GYAE6OF01ELGMS.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttctggatacaccttcaccggctactatactccactgggtgcgacaggcccctggacgaagggcttgacggtggatgggacgatccaacctaacgaccggtgacacaaacaacgcacagtaagttcgaggcagggtcacatcgacagggacacgtcttcagcacagcctagtggagtgagcaggctgagacgtctacggaccgacggaccggtcgttagtagttacgtggtaggacgaggaaggaagggaacgtacgttaggacgggttacgaacgtaaccggaggtactagggtttaaggttaacggtggttaaaccggg

SEQ ID NO: 239051 - DNA, 852 bp, Homo sapiens
  misc_feature: GYAE6OF01D5WMU.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcgaggacgcccactcccgaggtactaggttggtgcagtcgtggggctggaggtacgaagacgccgtgggcctcgaggtagaacggtcctccgtgacgtaacggtcttcgtaggtactacctaccgttccgaccggtactacgtatacgtcctacggtgggtcgcgacgccggcccgtaggacgtaacgggtcgttaggaggttaggaggttacggggacgtacgtaccgtaaacccgtaacgaccgggtacgaacaaacgtaaaaccgaacgaccgtaaacgtaacggtaaacggtttacggacgggtaccgtaaccgggttaccaaaccggtaacgtacgggaacccgtagggaaccctaccggttcctacgacgtaccacgtacgtacttacggtagggtacggtcgacggacgtacgggtacgtaggtaacgtcgtttaccggacggtaaccccggtaggtaaccccggggtttaccggtttaacggtttaaccgttacgggttacgggtacggtaaaccggggtaacgggtaaagggttaaaacggggtaaccgggttaacgggtttttaacggggaaaccggggtttaacccgggtaaaacggtttaacccggtaacgggggttttaccggtttaaaaggggggttttaaccggtttaaaagggggtaacccgggttttaaaccccggggg

SEQ ID NO: 239052 - DNA, 521 bp, Homo sapiens
  misc_feature: GYAE6OF01A49PP.4.18.B07.1.454.CMB.1.raw
  modified_base (465)..(465): a, c, t, g, unknown or other
  misc_feature (465)..(465): n is a, c, g, or t
  modified_base (512)..(512): a, c, t, g, unknown or other
  misc_feature (512)..(512): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctggggcctcagtgaaggtctcctgcaaggcttctggatacaccttcaccggctactatatcccatgggtgcgacacggcccctgacaagggcttgagtggatgggacggatccaacctaacgaccggtggcacaaacaacgacacagaagtttcagggcagggtcaccatgacagggacacgtccttcagcacagcctacgttggaggtggagcaggctagagatcgtgacgacgaccggcgtgtaattcgtgtgngagagaagggacgtattgagtcggatacgacgcgtagtagggttagnggttaacgg

SEQ ID NO: 239053 - DNA, 683 bp, Homo sapiens
  misc_feature: GYAE6OF01D0VKE.4.18.B07.1.454.CMB.1.raw
tcagagcactgtagcacgaccggtgctcgatttagtcgctgcgtaagggggagcatcacccagcaaccacatctgtcctctagagaactcccctgagagcctccgttcctcaccatggactggacctgggaggactcctcttcgttggtggcagcacgcctcgaggacgccccactcccaggtactagttggtgcaggtcgtggggctggagggtagaagaacggccgtcggggcctgaggtaggaacggtcctccgtgacgaggtcttcgtaggactaccaccttccgaccggtcttaacttactactacccgacgtgggtcgaccgaccgccggtccccgtaggaacgtagggtcgttaggaggtggacgtgggacgactaccgaaaccgtacgaccggtgaacaacgaaacacacaacgagtaacgtcgagggacagggtaccacgacgtacgaccgacggtacctaccgttactacgacgaccaacgtacgtcgtaggttgggacgtggacgcgaggtacgtagacgtacgtccgtaaggacccgtacggaccggttccgttagttacgttcgacgggtacgacggtaaggagggtaagggtaaccgttaggttacgggtacggtacggaactacgggtaggtacggttaggttaacgggttaaggtacggttaaccgg

SEQ ID NO: 239054 - DNA, 598 bp, Homo sapiens
  misc_feature: GYAE6OF01D4WGF.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttctggatacaccttcaccggctactatactccactggtgcgacacggccccgtggacgaagggtcttcggaggtgggagtcggggaacggtacgtaccaaaccctaacgaccggtggaccaacaaacaacgcaacgaagtaacgtttcgagggacgagggtccaacgagtacgaccgaagggacctaccgtaccttcgagaccaacgacgtccttaacgtggtaggtgacgcgaggctaggagtgtcgacgacgaaccgtcgggccgttaggttaactacgtgtagacggagtaaggaggtaacgtacgttaggacgtacggatacgacgtagtaggttaggttagtagggtacgg

SEQ ID NO: 239055 - DNA, 632 bp, Homo sapiens
  misc_feature: GYAE6OF01CCJD3.4.18.B07.1.454.CMB.1.raw
  modified_base (245)..(245): a, c, t, g, unknown or other
  misc_feature (245)..(245): n is a, c, g, or t
  modified_base (362)..(362): a, c, t, g, unknown or other
  misc_feature (362)..(362): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcgnggatacaccttcacccggctactatactccacgtggtgcgacacggcccctggacaagggcttggagtggagtgggacggactcaacccgtaacaccggtcgcaacaaacacgcaanagtaattcgagggcagggtcacatgacgaggacacgtccttcgacgcacacgtccgtattcgggaggtcggacgcgacggctaggagtacgtcgtacgtaccggaccgtaccgggtaccgttacggtaagtttaccgtaggttcggacgggtaacggaacggtaacggggtaaacggtaccgtttagggaacggttaccgggtaaagttaccgggtaacggtaccggttaaggggtttaacgggtttaaaggaacgggtttaaaccgggg

SEQ ID NO: 239056 - DNA, 578 bp, Homo sapiens
  misc_feature: GYAE6OF01CFBT2.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacacggcccctggacaagggcttggaggtggagtgggacggactccaaacccgtaacaccgggtggacaacaaaacaacgacaacagaacgtttcagggcagggtcaccatcgaccgagggacacgtccgttacacgaccacgacgcctacgtagggaggtgacgcgaggctggagatcgtacggacgacgtacggccgttagttacgttacgtggtaggcgaggaggaaggaacggtagttaggacggtcggaagttacgacgtcgttaggtagggttaaggtaggttaaccggg

SEQ ID NO: 239057 - DNA, 567 bp, Homo sapiens
  misc_feature: GYAE6OF01EW2H6.4.18.B07.1.454.CMB.1.raw
  modified_base (243)..(243): a, c, t, g, unknown or other
  misc_feature (243)..(243): n is a, c, g, or t
  modified_base (280)..(280): a, c, t, g, unknown or other
  misc_feature (280)..(280): n is a, c, g, or t
  modified_base (426)..(426): a, c, t, g, unknown or other
  misc_feature (426)..(426): n is a, c, g, or t
  modified_base (506)..(506): a, c, t, g, unknown or other
  misc_feature (506)..(506): n is a, c, g, or t
  modified_base (560)..(560): a, c, t, g, unknown or other
  misc_feature (560)..(560): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctgagtgaaggtctctgcaaggcttcnggatacaccttcaccggctactatatccactgggtcncgacgacggccccgtgggaacctaaggggctttaggagttgggaagttcggggaacggtattaccgaaacccctaacgaccggtggacaacgaaaacacgcacgagaagttcgaggcaggtcacatcgaccgaggacacgtccttnacgcaacgacgtacctacgttggaggtcgagacgaggcgtagagtatcgtagacgacgacggtccgtagtacgtacgtgngcgagaggaggtacgtacgttgagtcgaatacgaggtactaggttacggtaagnggtacgg

SEQ ID NO: 239058 - DNA, 525 bp, Homo sapiens
  misc_feature: GYAE6OF01E39NL.4.18.B07.1.454.CMB.1.raw
  modified_base (505)..(505): a, c, t, g, unknown or other
  misc_feature (505)..(505): n is a, c, g, or t
  modified_base (518)..(518): a, c, t, g, unknown or other
  misc_feature (518)..(518): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagaagcctggggcctcgagtgaaggtctcctgcaaggcttctggatacaccttcaccggctactatatccactgggtgcgacacggcccctgacaaggcttgagtggatgggacgatcaacctacgacggtggcaacaaacacgcacagaagttcgagggcagggtcaccatacgaccagggaccacgtccttacgacgacaacacgccgttactgggaggtgagcgaggctagagatcgtagaccgacgacggccgttagtatacgtgtgcgagagagggatagtgaggtcggatacgngctaggagttagnggtacgg

SEQ ID NO: 239059 - DNA, 571 bp, Homo sapiens
  misc_feature: GYAE6OF01AUZUB.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttcgtggatacaccttcaccggctactatactccactgggtgcgacacggcccctggacaaggcttgagtggagtgggacgataccaaccctaacgaccggtggacaacaaacacgcacagaagttcgagggcagggtcaccgatcggaccagggacacgtccttcagcacgcgtacctacgttggaggtgacgcgaggtcgagacgtatcgtagaccgacgaccgggtccgttagtacttacgtggtcgaggtaggaaggaggtaacgtacgttaggaggttacggaatacgtaggtacgttagggttaggttaaaggtggttaacggg

SEQ ID NO: 239060 - DNA, 544 bp, Homo sapiens
  misc_feature: GYAE6OF01DGS2Y.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcgagtgaaggtctcctgcaaggcttcgtggatacaccttcaccggctactatatccactgggtgcgacacggcccctggacaagggctgagtggatgggacggatcaaccctaacgaccggtggacaacgaaacaacgcacagaagtttcgagggcagggtcaccatagaccgaggaccacgtccttacagacacacgcctacgttggaggtgagcgaggctagagtatcgtgaccgacgacggcgttagtacttacgtgtgcgagaggagggaagtagttggaggtcggaatacgaggtactaggtaggtaaggaggttaacgg

SEQ ID NO: 239061 - DNA, 647 bp, Homo sapiens
  misc_feature: GYAE6OF01BUU6I.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgccagtctggggctgacggtgaagagccgtggggcctcgagtgaaggtctctgcaggcttctggatacaccttcaccggctactactatccacgtggtgcgacaggcccctggacgaaggcttgagtggatgggacggatccgaaccctacaccggtggacacaaacacgcacagagttcgaggcacgggtacaccagtcgaccgagggacgccgttaccttcgacgtaccacgtacgccgtacgttacgggaggtacggacgacgaggaccgttgaacgacgtacgtacggacgtaccggaaccgggtccggttacgttacgtttaaccgtcgggtacggtaccggaaggtaacgggaagggtaaacgtaacgtttaacgggacggttaaccgggtaacgttaaaccggacgttacccgggttagggttaaacgggtttaaagggtaagggtttaaacccggg

SEQ ID NO: 239062 - DNA, 537 bp, Homo sapiens
  misc_feature: GYAE6OF01D5XB3.4.18.B07.1.454.CMB.1.raw
  modified_base (244)..(244): a, c, t, g, unknown or other
  misc_feature (244)..(244): n is a, c, g, or t
  modified_base (512)..(512): a, c, t, g, unknown or other
  misc_feature (512)..(512): n is a, c, g, or t
  modified_base (530)..(530): a, c, t, g, unknown or other
  misc_feature (530)..(530): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcnggatacaccttcaccggctactatatccacgtgggtgcgacacggcccctggacgaagggcttgagtggagtgggacgatacaaccctaacgaccggtgacaacaaacacgcacagaagttcgagggcagggtcacatacgaccgagggacacgtccttcagcacgacgtcctacgtggaggtgagcgaggctagagagtcaggacgacgacggtccgttagtattacgtgtagcgagaggaaggaagtagttggagtacggatacgngtactaggtaggttaagnggtacgg

SEQ ID NO: 239063 - DNA, 693 bp, Homo sapiens
  misc_feature: GYAE6OF01B7UGR.4.18.B07.1.454.CMB.1.raw
  modified_base (274)..(274): a, c, t, g, unknown or other
  misc_feature (274)..(274): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgacaaggtcttcgtggatacaccttcaccggctactatacnccactgggtgcgacacggcccctggacaagggcttggagtggagtgggaacgtactaccgaaacccgtaacgaccggtggacaacaaaacaacgctaacagtaacgttacgagggcaacgggtcaaccgtatacggaaccgaacgggtaccgtaccgttacccgtacgtaacgacccaaccgaacggtaccctttaacgttaggggtaacgggttacgaacggtaccgtaacgggtccgttagggaacgtacgtcgttaacgggaacccgtaaccggtacgggtacccggttacgttaacgttacgtcgggttacgacggaacggtaagggaagggaacggtaacgttaggtaacggtaccgggtaaagtaccgtaaggtccggttaagggtttacgggttaaaggcgggtttaacggg

SEQ ID NO: 239064 - DNA, 746 bp, Homo sapiens
  misc_feature: GYAE6OF01CXWFG.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggtatcctcttcgttggtggcagcagcctcaggacgcccactcccaggtacagttggtgcagtcgtgggctgaggtgaagagcgtggggcctcagtgaacggtctccgtgacgaaggtcttcgtggactactaccttcgaccggtctaacttatactcctaacgttggggtacgcggaaccgaccgggtccccctagggaacctaaggggtcctttagggacggtgggacgtggggaaccgtatacccgaaacccgtaacgaccgggtgaccaaaccaaacgacgacgaacgtaaggtaacgttcggaacgggacgaacggggttacccaacgtaacgaccggaaccggtaacgggaactaccgttcccgttacgaacgacccgtaacgaccggtacctaaggttcgggaagggttcgaacggcgaagggtacgtggaagtcttccgaagggtacccggaaccggtaccggggtacgttagttaacggtttacgtagggttcgaacgggaggtaacgggaagggtaaacggtaccgtttagggaccggtttacgggtaaacttaccgggaacggttaggttagggtttaaacgggtaaaggggtaaggttaccccggg

SEQ ID NO: 239065 - DNA, 675 bp, Homo sapiens
  misc_feature: GYAE6OF01EUBTJ.4.18.B07.1.454.CMB.1.raw
  modified_base (254)..(254): a, c, t, g, unknown or other
  misc_feature (254)..(254): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacaggttggtgcagtcgtggggctggaggtgaagaagccgtggggcctcgagtgaaggtcctccgtgcgaaggcttcgnggataccaccttcgaccggctactatactccacgtgggtgcgacacggccccgtggacgaagggcttggaggtggagtgggacgtactaccaacccgtacgaccggtagacaacgaaacacgacaacgaagtaacgttcgagggacgagggtaccacgagtcgaaccgagggacctaccgtccttacgacgacacgacgtaccgtacgttagggacggttacgacggtacgagggtctaggtaacgtactccgtaacgaaccggtaacccggaacggttccgttaggttaaccgtttacggtacgggttaggaccgggtaaggtaagggaacgggtaaacggttacggttagggtaacggttacgggtaactaacgtacggtacggttaagggttagggttaaacggagggtttaaccggg

SEQ ID NO: 239066 - DNA, 707 bp, Homo sapiens
  misc_feature: GYAE6OF01B73JO.4.18.B07.1.454.CMB.1.raw
  modified_base (604)..(604): a, c, t, g, unknown or other
  misc_feature (604)..(604): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacaggttggtgcagtcgtggggctggaggtgaagaagccgtggggcctcgagtgaaggtctcctgcgaaggtcttcgtggactacaccttcgaccggtctaactatactcccacgttggggtcgtccgacgaccggtcccctagggaccgaagggtcttggacggtggacgtgggacggacttaccgaaaccgtaaccgaccggtacggacaaacgaaaacgaaccgaccaacgaaggtaacggtttacgaaggggacgacgggtacaaccgagtacggaacccgagggaccgtaccgtaccgttccgacgtcgtaacgaccggtacccttaacggtagggtacggttagacggacgaacggcgtacggtaacgtaactccggtaacggtaccgtaaccggtacgggtccgttaggttaacgtttacgngggtacgacggacgggaaaggaacgggtaaggtacgttaggtaacggtacggaacttacggaacgttacggtaggtttaacgggtaaaggtgggtaaaccggg

SEQ ID NO: 239067 - DNA, 729 bp, Homo sapiens
  misc_feature: GYAE6OF01DZ3CC.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcgagtgaaggtctccgtgcaaggcttcgtggatactaccttcaccggtactactatactccacgtgggtgcgacgacggccctggacgaaggcttggagtggagtgggacggataccgaacctaacgaccggtacgacaacgaaaacacgacaacaagtaaacgtttcgaacgggacgtacgggtacaaccgtaacgtcggaacccgaacgggaacctaaccgggttcccttacgaacgacccaacgtaaccgtaccgttaacgttagggtacggtaggtacgtaccggaacggtacgtacggtaacgagttaccgtaacggaacccgggaacccgtaaccggggttacccggttaggtttaacgtttaccggttgggtacggacccgggttaaaggacgggaaaggttaaaccggtacggttacgggtaacgggtaaccggttaacgtaaacggtaacggtccggttaaaggggtttaacgggttaaagggtaagggttaaacccgggg

SEQ ID NO: 239068 - DNA, 573 bp, Homo sapiens
  misc_feature: GYAE6OF01BJVAF.4.18.B07.1.454.CMB.1.raw
  modified_base (550)..(550): a, c, t, g, unknown or other
  misc_feature (550)..(550): n is a, c, g, or t
  modified_base (565)..(565): a, c, t, g, unknown or other
  misc_feature (565)..(565): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtctggggctgaggtgaagaagccgtggggcctcgagtggaaggtcctccgtgcaaggtcttcgtggatacacctttcaccggctactatatccactggtgcgacaggcccctggacgaagggcttggacgtgggatgggacggtataccaaaccctaacgccggtaggacaacaaacaacgcaacagtaagttcgagggcgagggtcaccagtacgacgaggacacgtacctcgacgacacgacgacctacgttagggaggtacggagaccggaggcctaggagtacgtctagaccggaacgtaccgggccgtagttactacgtgagtcgaggagaggaaggtataggacgcggaatacgancgtaggtagtaaggngtaacggg

SEQ ID NO: 239069 - DNA, 551 bp, Homo sapiens
  misc_feature: GYAE6OF01C4KMK.4.18.B07.1.454.CMB.1.raw
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (476)..(476): a, c, t, g, unknown or other
  misc_feature (476)..(476): n is a, c, g, or t
  modified_base (488)..(488): a, c, t, g, unknown or other
  misc_feature (488)..(488): n is a, c, g, or t
  modified_base (542)..(542): a, c, t, g, unknown or other
  misc_feature (542)..(542): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagaagccgtggggcctcgagtgaaggtctcctgcaaggcttctggatacaccttcgaccggctactatacgtcccacgtgggtgcgaacgacggcccctggacaagggcttggagtggagtgggacggataccgaaaccgtacgacggtggacaacaaaacacgcaacgagaacgtttcgaagggcagggtcacagtacgaccagggacacgtcctcagcacacgaccgtagcgggagtgacgcaggcagagntcgngaccgagacggcgtntaacttgtggancgagagagggaagagttggacgtggaatacgaggtactaggttagggttaaagnggttaacgg

SEQ ID NO: 239070 - DNA, 628 bp, Homo sapiens
  misc_feature: GYAE6OF01B9YL0.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcgagtgaaggtctccgtgcgaaggcttcgtggataccaccttcaccgctactatactccatgggtgcgacacggcccctaggacgaagggtcttggaggtggagtgggacggactaccgaaaccctaacgaccggtggacaacgaaaacgacgacaacaggtaagttcgagggcgaacgggtccaacgagtacggaaccgagggaccaccgttccttacgacgcacacggtacctacgttgggaggtagacgacgaggtctagagtacgtacgtacggaacgaccgtaccggtaccgttagtaacttacgtagtcggacggaggaagggtaaggtaacggttacgttaggtaacggtacggaattacggaggttacgttagggttaaggttaaaggtggttaaaccggg

SEQ ID NO: 239071 - DNA, 599 bp, Homo sapiens
  misc_feature: GYAE6OF01CAII5.4.18.B07.1.454.CMB.1.raw
  modified_base (473)..(473): a, c, t, g, unknown or other
  misc_feature (473)..(473): n is a, c, g, or t
  modified_base (482)..(482): a, c, t, g, unknown or other
  misc_feature (482)..(482): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctggggcctcagtgaaggtcctcctgcaaggcttcgtggatacacctttccaccggctactatatcccacgtgggtcgcgacgacggcccccgtaggaccgaaggggcctttaggacggttgggagttggggaacggtactacccgaaccctaacgaccgggtcggacaacaaacacgacaacagaacgtttcgaagggcagggtcaccagtcgaccgagggactaccgtcctacacgcacgagcctagtgggaggtcgacgacnggactgagntcgtggaaccgacgtaccggtacgtagtacttcggtagtcgaggaggaggaaggtacgtaagtgggtacgacggtacgtacgtacggtacgtaggtaggttaaggtgggttaaccgg

SEQ ID NO: 239072 - DNA, 672 bp, Homo sapiens
  misc_feature: GYAE6OF01D00IY.4.18.B07.1.454.CMB.1.raw
  modified_base (247)..(247): a, c, t, g, unknown or other
  misc_feature (247)..(247): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtctggggctgaggtgaagagccgtggggcctcgagtgaaggtctcctgcaaggcttcgnggatacaccttcaccggctactatactccacgtgggtgcgacgacggccccgtaggacgaagggcttggaggtggagtcgggacggataccgaaccctaacgaccggtcggacaaccaaaacaaaccgacaacgaagtaaacgtttcgaacggggacacgggtccaaccgtacgtacggaccgaacggggaacctaccggttacccttcaacggtaccaccgaacggtacccgttaacgttcgggtaaggtcggacggcgacggggtctagggaacgtacgtacgtacggaccgaacggtacccggtaccggttagttacgttacggtaggtcggacggaggaaggtaagggaaacggttagttagggtacggtaacggtaagtaacgacggtacgtagggttaggttaaaggaggttaaacggg

SEQ ID NO: 239073 - DNA, 752 bp, Homo sapiens
  misc_feature: GYAE6OF01CX9PU.4.18.B07.1.454.CMB.1.raw
  modified_base (268)..(268): a, c, t, g, unknown or other
  misc_feature (268)..(268): n is a, c, g, or t
tcagagcactgtagcacgaccggtgctcgatttagtcgctgcgtaagggggagcatcacccagcaaccacatctgtcctctagagaactcccctgagagctccgttcctcaccatggactggacctggagatcctcttcttggtggcagcagcctcgaggacgcccactcccgaggtaactggttggtgcgtaggttcgtggggcgtggaggtagaagaacgccgtggggcctcgaggtgaacggtcctccgtgacgaaggtcttcgnggtactacctaccttcgaccggtcttaactatactccgtacgtggtcgaccggacgtaccggccccgtaggaacgtacggtcgttcggaggtggacggtacgggacggtactaacccgtaaaccgtaaccgacgggtacggaaccaaacgaaaccgaacgaccgtaagtaaacggttaacggtttacgaacggggtaccgaacgggttaccaaccgtaagaccggaaccggtaaccgggacgttacccgttaccgtaacgaccgactaaccgtaacgtaccgtttaacggtacgggtggtaaggaccgtaccggaggtcccaaggacgtagtccggtacggaaccgtccggtaaccggtccgttagttacgttacgggttaggacccggaagggagtaaagggacggtaaacggtacggtttagggacgggttacgaaggtcgtaagggtacgttaggggttaacggtaggtaaggttaaccgg

SEQ ID NO: 239074 - DNA, 618 bp, Homo sapiens
  misc_feature: GYAE6OF01D36LB.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagaagccgtggggcctcgagtgaacggtctccgtgcaggcttcgtggatacaccttcaccggctactatactccacgtgggtgccgacacggcccctagggacgaaggggtcttaggacggtggacgtggggaacggtatacccgaaaccccgtaacgaccgggtacggaccaaaccgaaaaccacgacaacgaaggtaacgtttcgaagggcagggtcacctatacgaccgaggacctacgtccttcacgcacacgcctacgtggaggtgacgcgaggtcagagtatcgtaggaccgacgtaccggtccgttagttacttacgtgtcggacggaggacggaggtaaacgtacgttacgggacgtaggtataacggtaggtacgttaggtaagggttaacggtggtaacccggg

SEQ ID NO: 239075 - DNA, 573 bp, Homo sapiens
  misc_feature: GYAE6OF01CLRJB.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagaagccgtggggcctcagtgaaggtctcctgcaaggcttcgtggatacaccttcaccggctactatactccacgtgggtgcgacacggcccctggacagggctggagtggagtgggacggatcaacccgtaacgaccggtgacaacaaacacgcacagagttcgagggcagggtcacgatcgacagggacacgtccttacgacgcacgacgcctacgtggaggtgagcgaggctggagtactcgtacgacgaccgtacgggtccgtagttacgttacgtggtcggacgagggacggaagggtaacgtacgttaggtacggttacggaatacgaggtacgttagggtacgggttaaggtaggttacggg

SEQ ID NO: 239076 - DNA, 751 bp, Homo sapiens
  misc_feature: GYAE6OF01D0KAS.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatccttcttcttggtggcagcacgcctcaggacgcccactcccaggtacagttggtgcagtcgtggggctggaggtgaagagccgtggggcctcagtgaaggtcctcctgacaaggtcttcgtggataccaccttcgaccggtactaactatactacccgacgttgggtcgaccgaccgtaaccggcccccgtagggaaccggtaaacggggtccgtttaggaggttagggtaacggtacgggggaaccgggtaacttaccccggaaaacccccgttaaaccggacccgggttacgggaacccaaaccgaaaaaccgaaacccggaccaacgtaaacgggttaacggtttaccggacggggtacgtaacggggtaccaaccgtacgtacggaacccggaacggtaccgtaaccgtccttacgacgtaccaacgacgtacccgtacgttagggtacggtgacggtacgacggtcgtaggtaagacgtcgtaacggaccggaccgtaccgggtacgttacggtaacgtttacgtggtaggacggagaaggaacgggtaagtacgttaggtacggtacggtactacgacggtacgttaggttaacgggtaagtagggttaacgg

SEQ ID NO: 239077 - DNA, 582 bp, Homo sapiens
  misc_feature: GYAE6OF01AQ90Y.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctggggcctcagtgaaggtctcctgcaggcttctggatacaccttcaccggctactatactccacgtgggtcgcgacgacggcccctggacaagggtcttggagtggagtggggacggataccaaccctaacgaccggtggaccaacaaacaacgcaacgagaagttcagggcagggtcacagtgaccgaggactacgtcctacagcaacacgcctagtgggaggtcgagcacggctagagtactcgtaggacgacgtacggtaccgttagtacttacgtggtacgacggtaggaagggaaggacgtacggttaggaacgggttacggtaagtacgacggtcgttagggtaacgggttaaaggtagggtaacgg

SEQ ID NO: 239078 - DNA, 599 bp, Homo sapiens
  misc_feature: GYAE6OF01A54CU.4.18.B07.1.454.CMB.1.raw
  modified_base (242)..(242): a, c, t, g, unknown or other
  misc_feature (242)..(242): n is a, c, g, or t
  modified_base (444)..(444): a, c, t, g, unknown or other
  misc_feature (444)..(444): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaggtctcctgcaaggcttntggatacaccttcaccggctactatactccacgtgggtgcgacgaggccccgtggacaagggtcttgaggtggagtgggacgatacgaaccgtaacgaccggtggacaacaaacaacgcaacaagtaacgttcgagggcgacgggtcaccgatacgacgaggaccacgttcctcgacgcacagtcctagtgggaggtgacgngaggctagagtagtcgtaggaccgaaccgacgggtccgttagttaagttaccgtaggtggacggtaaggaggtaagggaaacgttacggttaggacggttacgggaatacggtacggtacggttaggttaaggttaaagggtaggttaaccgggg

SEQ ID NO: 239079 - DNA, 936 bp, Homo sapiens
  misc_feature: GYAE6OF01DOUQ7.4.18.B07.1.454.CMB.1.raw
  modified_base (189)..(189): a, c, t, g, unknown or other
  misc_feature (189)..(189): n is a, c, g, or t
tcagagcactgtagcacgaccggtgctcgatttagtcgctgcgtaagggggagcatcacccagcaaccacatctgtcctctagagaactcccctgagagctccgttcctcaccatggactggacctggaggatcctcttcgttggtggcagcagccctcgaggacgcccactcccaggtacaggttggngcagtcgtggggctggaggtgaagacgccgtggggcctcgagtgtaacgtctcctgacgtaaggtcttcgtggtaactaccaccgtttccgaacccggtacttaacttagtacctacccgtaggttcggggtaccgtaccggaaccgtaccggggtacccccgtaggggtaaacgtaaacggggttcctttaggggtaacgggttcggggtaaacggttaccggggggtaacccgtaaccgttaaccccgtaaaaccccggttaaccccggtaaccggggtacgaaacccgaaaaccgtaaaacccgaaacggaccgtaaacggtaaacgggttaaaccgggtttccgaaacggggtaccggtaaaccggggtaacctaacccggtaaagtacccgggaaacccgggtaacggggtacccttaacccgggttcccttaccgggaaactaaccccggtaaaccgtaaccggttccccgtttaaaagggttccgggggtaacgggttacgaacgggtacgggtacggttaaccgtaagggtaacgttacgtacccggttaaccgggaaaccggtcccggggtaaaccggttcggtttaaggtttaccctttaacggacggggttaccggaaagggttacgggaaaggtaacggggttaacgttaacgggttacggtaaccggtacggtaaacgtacggtaccggttacgggttaaaggttaacggggtttaaacgcgggtttaaccggg

SEQ ID NO: 239080 - DNA, 744 bp, Homo sapiens
  misc_feature: GYAE6OF01BRUNA.4.18.B07.1.454.CMB.1.raw
  modified_base (253)..(253): a, c, t, g, unknown or other
  misc_feature (253)..(253): n is a, c, g, or t
tcagagcactgtagcacgaccggtgctcgatttagtcgctgcgtaagggggagcatcacccagcaaccacatctgtcctctagagaatcccctgagagctcccgttcctcaccatggactggacctgggaggatcctcttcttggtggcagcagcctcaggacgcccacctcccgaggtacaggttggtgcagtcgtggggctgaggtgaagaagccgtgggcctcgagtgaaggtctcctgcaaggtcttgnggatacaccttcgaccggctactatactcctagtgggtgcgacgacggcccgtggacgacggcttggaggtggagtgggacggataccgaaacccgtaaccgtaccgggtacggaccaaacgaaaaccgaaccgaccgaaacgtaacggtaaacggtttacggaacggggaccgtacggggtaccaaaccgtacgtacggaacccgaagggtaccgtacccggttaccttaccgaacgtaccgaacgacgtacccgttacgtaggggtacggttacggaagtacggagggtcgttaggacggtaacgtcgtaacggaccgaaccggtaccggtaccggttagttaacgttacggttcggtacggacgggaaggaacgggtaacgggtaaacggttaccggttcgggaaaccggggttacggtaaaccggaacggttacgggttacggtttaaggggttaacgggtttaaagggaacgggtttaaaccgggg

SEQ ID NO: 239081 - DNA, 742 bp, Homo sapiens
  misc_feature: GYAE6OF01ASQ4I.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggagatcctcttcgttggtggcagcagcctcgaggacgcccactcccgaggtacagttggtgcagtcgtggggctggaggtagaagacgccgtgggccttcgaggtgaaggtccgtcctgacgaacggtccttacgtacggtacttaccgaccctttaccgaccggtccttaacgtacgtacctccctaacggttcggggtcgaccggtaacccgtaccgggtcccccgtagggaaccgtaacgggtccttagggacggttgggaacgttacggggaacgtacgtacccgtaaacccgtaaccggtaccggtcggacctaacgaaaccgaacgacaacgtagtaacgttcgaagggtcacggtacacctagtacgaccgaggacccgtacgttccgtacgagaccaacgacgtccgtaacggttcgggacgtcggaacgcgaaggtacgtacgagtcgtaccggtacgaacccggtcggtaaccggtcgttaatttacggtacgttcggtaggacgtacggaacggtaagggtaccgtacgttacggtaacggtcccggtaagtaccggtacgttacggtttaaccgggttaagggtttaacgggagtttaaccggg

SEQ ID NO: 239082 - DNA, 710 bp, Homo sapiens
  misc_feature: GYAE6OF01CURD9.4.18.B07.1.454.CMB.1.raw
  modified_base (202)..(202): a, c, t, g, unknown or other
  misc_feature (202)..(202): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttgggtggcagcagcctcgaggacgcccacctcccaggtacagttggtgcagtcgtggggcnggaggtgaagaacgccgtggggcctcgagtaggtacggtcctccgtaggcgaaggtcttcgaggtaactacctaccttcgaccggtctactactactccgacgtgggtcgcgacgaccggccccgtaggaccgaaggtcgttaggaggtggagtacgggaacgtactacccgaaaccgtaaccggacgggtacgacaaacaaaacgacgaccgaacgtaacgtacgttaggacgggtacgtagggtaacccacgacgtaacggaccgaacggacctaccgttacctacgacgtaccctacgtacgtaccgttaggttacgggaggtcggtaagcgtacggtcgtagtaaggtacgtacgaccggacgaaaccggtcggtacccggttagttaacgttcgtgggtacgaagggacggtaaggtaacggtaaacgtacgggttaggaacgggtaccggtaaacgtacggtacggtacgttaaggggtttaggaaaggttcggtaaacggg

SEQ ID NO: 239083 - DNA, 608 bp, Homo sapiens
  misc_feature: GYAE6OF01CVTN0.4.18.B07.1.454.CMB.1.raw
  modified_base (265)..(265): a, c, t, g, unknown or other
  misc_feature (265)..(265): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccaggtacagttggtgcagtcgtggggctggaggtgaagaacgccggtggggccctacgtagtaggaacggttcctccgtgcgaaggtctttcgnggtaactaccacttcgaccgtactactagtactccagtggtcgcgacgacggtcccctaggacgagggtctggaggtgagtgggacgtataccaaaccgtacgacggtacgacaacgaaacacgacacgaagtacgttgagggacaggtaccactagcggacgaacgacctaccgtccgttacgagtaccacgactaccgttgtacgggagtcgagcgagcagagtctacgaggacgacgtcggtcgtagtacttgtagtcgacggtaaggaggaaggtagtagttagggagtacgggtaaactacgtacgtacgttagggtaaggttaaggaggttaaccgg

SEQ ID NO: 239084 - DNA, 613 bp, Homo sapiens
  misc_feature: GYAE6OF01DO0VG.4.18.B07.1.454.CMB.1.raw
  modified_base (426)..(426): a, c, t, g, unknown or other
  misc_feature (426)..(426): n is a, c, g, or t
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcgaggacgccccacctcccgaggtactaggttggtgcgagtcgtggggctggaggtgaagacgccgtgggcctcgagtgagtctcgtgcgagtcttgtaggtactacctaccttccgaccggtactacttactactaccgtaggtgggtcgcgaaccgccggtcccgtaggacgaagggtcttaggaggtgggagtcgggaacgtactaccgaacccgtacgacggtacgaaccaacaaacgacgacaacgagtaacgttcgagggacgnggtacactagtacgacgaggactacgtcctacgagaccacgacgtaccttaggtggaggtgacgngacggntagagntacgacgacgacgtacggtcgtatacgtgtagtggacgtagaaggagtaacggtagtcggtagtaccggtaatacggtaggttgtaaggtacggtaaagtgggtacccgg

SEQ ID NO: 239085 - DNA, 546 bp, Homo sapiens
  misc_feature: GYAE6OF01AGEXY.4.18.B07.1.454.CMB.1.raw
  modified_base (539)..(539): a, c, t, g, unknown or other
  misc_feature (539)..(539): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagccccactcccaggtacagttggtgcagtctggggctgaggtgaagagcctggggcctcagtgaaggtctcctgcaaggcttctggatacaccttcaccggctactatatccactgggtgcgacacggcccctggacaagggcttgagtggagtgggacgatccaaccctacgaccggtgacacaaacacgcacagtaagttcgagggcagggtcaccgatcgaccgagggacacgtccttacgacgcacacgcctacgttgggaggtgagcgaggctggagatcgtaggaccggacgtaccgggtccgttagtacgttacgtgtgcgagaggaggaagtacgttaggacgtcggatacgagtcgtaggtaggttaagnggtacgg

SEQ ID NO: 239086 - DNA, 619 bp, Homo sapiens
  misc_feature: GYAE6OF01C2063.4.18.B07.1.454.CMB.1.raw
  modified_base (251)..(251): a, c, t, g, unknown or other
  misc_feature (251)..(251): n is a, c, g, or t
  modified_base (491)..(491): a, c, t, g, unknown or other
  misc_feature (491)..(491): n is a, c, g, or t
tcagagcactgtagcacgaccggtgctcgatttagtcgctgcgtaagggggagcatcacccagcaaccacatctgtcctctagagaatccccctgagagctccgttcctcaccatggactggacctggaggatccctcttcttggtggcagcagcctcaggagcccactcccaggtacagttggtgcagtctggggctgaggtgaagaagccgtggggcctcgagtggaaggtctcctgcaaggtcttcgnggatacgaccttcaccggtctactatactccacgtggtgcgtacgacggcccctaggaccagggtcttagacggttggacgtgggaccgatcccgaaacccgtaacgaccggtaggacaacaaaccgacgacaacaagtaacgttcgagggcgagggtccaacgactacggacccgaggtaccacgttccttcgaacgccaccacgtcctacgttggaggtcgagcgaggtactgacgtntacgtacgaccggaacgtccgggaccgttagttacctttacgtagtcggaacggaacggagaagggtacgtaacggttggacggttaccgaatacgtacgcgttaggttaacggtaaggtgtaacggg

SEQ ID NO: 239087 - DNA, 524 bp, Homo sapiens
  misc_feature: GYAE6OF01EYZA3.4.18.B07.1.454.CMB.1.raw
  modified_base (334)..(334): a, c, t, g, unknown or other
  misc_feature (334)..(334): n is a, c, g, or t
  modified_base (516)..(516): a, c, t, g, unknown or other
  misc_feature (516)..(516): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttggagtggagtgggacggatcaacccgtaanaccggtgcacaaacaacgcacagaagttcagggcagggtcacgatgaccaggacacgtccttacgagcacacgcctacgtggaggtgagtcgaggctaggagatcgtagaccgacgacggtccgtgttatactgtgcgagagaggaagtattaggagtggaatacaggctagtaggttaagnggtaacgg

SEQ ID NO: 239088 - DNA, 708 bp, Homo sapiens
  misc_feature: GYAE6OF01CVPRF.4.18.B07.1.454.CMB.1.raw
  modified_base (252)..(252): a, c, t, g, unknown or other
  misc_feature (252)..(252): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcgaggacgcccactcccaggtacaggttggtgcagtcgtggggctggaggtgaagacgcgtgggcctgagtgaaggtctcctgcgaaggtcttcgnggactacctaccttcgaccggctaactataactccagtcggtcgcgaccgacggtcccgaggacgagggtcttggacggtggaggtacgggacggactacccgaaacccgtaaccgaccgggtacgaccaaaccgaaacgaacgaccaaacgaacggtaacggtttccggaacggggtcggtaaacgggtacccaacgtaacgtacggaaaccggacgggtaaccgtaccgttccgttaccgacgacaccgtacgtaccgttagttcgggacggtagacggcgacggtcgtaggagtacgtcgacggaaccggaccgtaccgggtaccgttacgttacttacggtcgggtacggtacggaggtaagggtaacggaaggttacggttacgggaacggttacgggtaacgtacggtacgtacggttagggttaaggtaacgggttaggttaacccggg

SEQ ID NO: 239089 - DNA, 562 bp, Homo sapiens
  misc_feature: GYAE6OF01B24P9.4.18.B07.1.454.CMB.1.raw
  modified_base (553)..(553): a, c, t, g, unknown or other
  misc_feature (553)..(553): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcgagtgaaggtctcctgcaaggcttctggatacaccttcaccggctactatactccactgggtgcgacacggcccctggacaagggcttgagtggagtgggacgatcaaccctaacgaccggtgacacaaacacgcaacagaagttcagggcagggtcaccatcgaccgagggactacgtccttacgagccacacgtcctacgtgggaggtgagcgaggctagagatcgtcgaccgacgaccgggtccgttagttaacgttacgtggtacggacgaggaaggaagggaagtacggttaggaggtacggaagtacgagcgttaggtaggttaagnggttaacgg

SEQ ID NO: 239090 - DNA, 535 bp, Homo sapiens
  misc_feature: GYAE6OF01BJZIA.4.18.B07.1.454.CMB.1.raw
  modified_base (247)..(247): a, c, t, g, unknown or other
  misc_feature (247)..(247): n is a, c, g, or t
  modified_base (514)..(514): a, c, t, g, unknown or other
  misc_feature (514)..(514): n is a, c, g, or t
  modified_base (528)..(528): a, c, t, g, unknown or other
  misc_feature (528)..(528): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagaagccgtggggcctcgagtgaaggtctcctgcaaggcttcnggatacaccttcaccggctactatatccactgggtgcgacacggcccctggacaagggcttggagtggagtgggacggatccaaaccctaacacccggtggcacgaaacaacgcacgagaagtttcgaggcagggtcaccagtgaccgagggacacgtccttcagcacagcctacgtggagtgagcgaggctgagatcgtagacgacacggccgttgtacgttactgtgcgtagaggacggaagtacgttggagtcggatacgacgngtaggtgttaaggnggtacgg

SEQ ID NO: 239091 - DNA, 628 bp, Homo sapiens
  misc_feature: GYAE6OF01CRLCG.4.18.B07.1.454.CMB.1.raw
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (496)..(496): a, c, t, g, unknown or other
  misc_feature (496)..(496): n is a, c, g, or t
tcagagcactgtagcacgaccggtgctcgatttagtcgctgcgtaagggggagcatcacccagcaaccacatctgtcctctagagaatcccctgagagcctccgttcctcaccatggactggacctggagatcctcttcgtggtggcagcagcctcgaggacgcccacctcccgaggtactaggttggtgcagtcgtggggctggaggtgaagagccgtgggcctgagtgacggtcnccgtgcgaggtcttcgngactacctaccttccgaccggtactaacttatacgtccgtacggtggtcgcgtacgacggtcccctaggacgaggtctggaggtcgaggtcggaacgacaccaacgtaaccgcggtacgacaacgaaacacgaccagtaagacgttcgacgggtacaggacctacgagtacggacgtagacctacggtcctagacacactacgtactacggtcgaggtcacgcgagtctaggaatcgtacgnggaaccgacgccggtccgtagttacgtacgcggtgtaacggagacggaacggtaacggtcgttaagggcggttaacggtaacgttacggacgttacggttagggtaacggttaaaggtcggttaaacccggg

SEQ ID NO: 239092 - DNA, 566 bp, Homo sapiens
  misc_feature: GYAE6OF01COP7P.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcgagtgaaggtctcctgcaaggcttctggataccaccttcaccggctactatatccactgggtgcgacacggcccctggacgaagggcttgaggtggagtgggacggataccaaaccctaacgaccggtgacaacaaacaacgcacaagtaacgttcgagggcagggtcaccatcggaccgagggacacgtccttcacgcacagcctacgttggaggtgagcgaggctgagtatcgtagacgacgtacggccgttagtattacgtggtgacgaggaggaaggaacgtagttagggacggtacggtactaacgtacggtacgttagtaaggggttaagtaggtaacggg

SEQ ID NO: 239093 - DNA, 705 bp, Homo sapiens
  misc_feature: GYAE6OF01CRLK2.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccacctcccgaggtacaggttggtgcagtcgtggggctggaggtagaagaagccgtcggggtcctcgaggtgaaaggtcctccgtgcgaaggcttcgtggtactaccaccttccgaccggacctactactactcctacgtgggtcgacggaccgaccggtcccccgtagggaccgaaggggtccttaggtacggtaggaggtacggggaacggtacgtaacccgaaaccccgtaaaccgaccgggtacggaccaaaccgaaaaccgaaccgaccaacgtaagtaacgtttacggacggggtaccgagggtaccgacgacgtacggaccggaacggaccgtacgttcccgttacgacgaccgacgacgtaccgttaggtagggaggttagacgacgaggcgtagacgtacgtacgacggaaccggtaccgaccgggtaccttagttaaccgttagtcggtacggacggagaacggaaggaaacgtacgtaggtacggtacgtagtacgtagtacgtagggttaaggttaaggaggttaaccgg

SEQ ID NO: 239094 - DNA, 616 bp, Homo sapiens
  misc_feature: GYAE6OF01EQ9NB.4.18.B07.1.454.CMB.1.raw
  modified_base (261)..(261): a, c, t, g, unknown or other
  misc_feature (261)..(261): n is a, c, g, or t
  modified_base (512)..(512): a, c, t, g, unknown or other
  misc_feature (512)..(512): n is a, c, g, or t
tcagagcactgtagcacgaccggtgctcgatttagtcgctgcgtaagggggagcatcacccagcaaccacatctgtcctctagagaatcccctgagagctccgtcctcaccatggactggacctggaggatcctcttcttggtggcagcagcctcaggagcccactcccaggtacagttggtgcagtctggggctgaggtgaagaagccgtggggcctcagtgaaggtctctgcaaggcttctggatacaccttcaccggntactatatccactgggtgcgacgacggccccgtggacgaacgggcttggaggtgggatggggacggagtaccaaacccgtaaccgaccggtacgggacaacgaaaaccaacgaccacaagtaacggtttcagggcgagggtcaccagtacgaccgaggacaccgtcctcagacacagacctacgttgggaggtgagcgacggtctggagtacgtcgtaggaaccgacgaccggtccgttagtaacgttacnggttcgacggtacggaaggtaagggaacgtacggttagggaacggttaccgggaacgtaacgtaacggtacttaagggtagggtttaaaggagggttaaccggg

SEQ ID NO: 239095 - DNA, 749 bp, Homo sapiens
  misc_feature: GYAE6OF01DAVB5.4.18.B07.1.454.CMB.1.raw
tcagagcactgtagcacgaccggtgctcgatttagtcgctgcgtaagggggaggcatcacccagcaaccacatctgtcctctagagaatcccctgagagctccgttcctcaccatggactcggacctgggagatcctcttcttgggtggcagcagcctcgaggacgcccactcccaggtacagttggtgcagtcgtggggctggaggtgaagaagccgtcggggcctcgagtggaacggtctccgtgcgaaggcttcgaggaattacctaccctttccgaccggtctaactatactccacgtgggtcgaccgacgacggccccgtaggacgtaagggtcttggacgggtggacgtacgggggaacggtactacccgtaaaaccccgtaacgacccgggtaggacctaaaccgaaaacaaaccgaccaacgaggttaaacggttacgacggggacgtaagggtacccaacgtacggtacgaccggaagggaaccctaccggtttacccgttacgacggacctaaccggaccgtaaccgtaccggttaggggtaagggtacgacggttaccgaacgggtcgtacgaagtacgtacgtacgaaccgaccgtaccggtcgtacgttaacgttacgtaggtggacggtaaaggacgggaaacgggtaacgtacgtttaagggtccggtaaccgggtaattaaccggtaggttacccggtagggttaacggttaagggtacgggttaaaccgggg

SEQ ID NO: 239096 - DNA, 698 bp, Homo sapiens
  misc_feature: GYAE6OF01CMZ3X.4.18.B07.1.454.CMB.1.raw
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (310)..(310): a, c, t, g, unknown or other
  misc_feature (310)..(310): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagccgtgggcctcagtgaaggtctcctgcaaggcttcnggntaccgaccttccaccggctactatactccactgggtgcgacacggcccctggacaagggcttgngtggatgggacggatcgaaccccgtaacgaccggtggccaacgaaaaccaacgaccacaaggtaacgtttcgaacggggcgacgggttacacccgagttacggacccgaaggggaccaaccggttcccttaaccgacgaccgaaccgtacggacccgtttaccgttcggggaacggttagggacgaccgagggtaccttaggacggtaagtccgttaacgggaaccgtaaccgtacccgggtacccgttacggttaactttacgtaggttacgggaccggtaaggaacgggtaagggtaaacgtaacggtttaggaacggttaccgggaacgttaacgtacgggtacgttagggttaacgggttaaagggttagggttaaacccgggg

SEQ ID NO: 239097 - DNA, 744 bp, Homo sapiens
  misc_feature: GYAE6OF01DW4VV.4.18.B07.1.454.CMB.1.raw
  modified_base (260)..(260): a, c, t, g, unknown or other
  misc_feature (260)..(260): n is a, c, g, or t
  modified_base (615)..(615): a, c, t, g, unknown or other
  misc_feature (615)..(615): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctgggaggatccttcttcttggtggcagcagcctcaggacgcccactcccgaggtacaggtttggtgcagttcgtggggctggaggtgaagacgcgtggggcctcgaggtgaacggtctcctgacgaaggtcttcgnggactacctacctttccgaaccggtcttaactaatactaccgtacggttgggtcgaccggacgaccgggtcccgtagggaacggtacgggtcgttggacggtggaggtacgggaacgtactaccgaaaccctaacgacgggtcgaaccaaacaaacgacgacaacgtaagtaacggttcggaacgggtacgaggtaccgactacgtaacggaccgaggaaccctaccgttcctagaccgacaaccacgtaccgttaggttagggacggttcgaacggccgtagggtcgtaaggacgtaacgttcggaaccggtaaccggaccgggtaccggttaccggttaggttaactttcggnggttacggaacgggaaggtaacggaacgggtaaacggttacggttaagggtacgggttaaccgggtaactaacgggttacggttaacggttaggggtttaaacgggttaaaggtcgggtttaaaccggg

SEQ ID NO: 239098 - DNA, 743 bp, Homo sapiens
  misc_feature: GYAE6OF01EKJG7.4.18.B07.1.454.CMB.1.raw
  modified_base (736)..(736): a, c, t, g, unknown or other
  misc_feature (736)..(736): n is a, c, g, or t
tcagagcactgtagcacgaccggtgctcgatttagtcgctgcgtaagggggagcatcacccagcaaccacatctgtcctctagagaactcccctgagagcctccgttcctcaccagtggactggacctgggaggatccttctttcgttggtggcagcagcctcgaggacgcccactcccgaggtactaggttggtgcgtaggttcgtggggctggaggtagaagacggccgtggggcctgaggtagaacgtcctcgtcgacgtaaggtcttcgtacggtacttaccgtaccgtttaccggaacccggtacttaaccttaactaccgttacccgtacggttcgggggtcgaccggaaccgtaccggggtaccccggtagggaaaccggtaacggggtccgtttagggacggttgggaaggtacgggaaccggtactaaccccgtaaacccgtaacggtacccggtacgaaccaaacgaaaccaacgaacaacgtaaggttacggttacggaacggtacgaacggtaccacgacgtacggaccggacggtacctaccggttctacgacgtaaccgacgtacgtaccgttaaggttcggaggtcgaacgcgtaggcgtaggataccgtgtaccggaaccgtccggtaacgggttccttagttaccggttacgaggttacggacgtaaggaggtaacggtagtacgtggacgtacgatacgtgtagttaggtagtaaggngtaacgg

SEQ ID NO: 239099 - DNA, 670 bp, Homo sapiens
  misc_feature: GYAE6OF01C76RA.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatccctcttcgttggtggcagcagcctcgaggacgcccactcccaggtacaggttggtgcgagtcgtggggctggaggtgaagacgccggtgggcctcgaggtgaacggtctccgtgacgaggtcttcgaggtactacctaccgttaccgaccggtacttacttactactcccgaggttgggtcgacgaccgtaccggccccgtaggaacgaggtcttaggacggtaggagtgggaacgactacccgaaaccgtaacggaccggtacgacaaaccgaaacacgacaagaaggtaacgtacggaggacgacggtacacgacgtacgacgacggacctcgtacctcgacacgacgacgtaccgttagtacgggagtcgagcgaggcgtacgagtacgtcgacggaccgaacgtccggttacgtacgtttacgtcgtggtacggacgagggtaagaagggaaacgttacggttggaaacgggttacggaagttaacgtaggttaccggttaagggtttaagggtaaaggtaggttaaccccgg

SEQ ID NO: 239100 - DNA, 564 bp, Homo sapiens
  misc_feature: GYAE6OF01DI6QP.4.18.B07.1.454.CMB.1.raw
  modified_base (247)..(247): a, c, t, g, unknown or other
  misc_feature (247)..(247): n is a, c, g, or t
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (405)..(405): a, c, t, g, unknown or other
  misc_feature (405)..(405): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagaagccgtggggcctcagtggaagtctcctgcaaggcttcgngatacaccttcaccggctactatatccagtggtncgacacggccctggacgaaggctgngtggagtgggacgatcaaccctacgaccggtgcaacaaacaacgcacaagacgttacgaggcgacggtcacagtacgaccgaggacacgtccgtagacncgacacgtcctacgtggacgtgcgacgaggctagagtatcgtacgacgaccgtacggccgttagtacgtttacgtaggttcgagaggaggaagggtaaagtcgttaggacggttacggaatacgtagtacgttgggttaaggttaagagggttaaccgg

SEQ ID NO: 239101 - DNA, 719 bp, Homo sapiens
  misc_feature: GYAE6OF01BSBB1.4.18.B07.1.454.CMB.1.raw
  modified_base (288)..(288): a, c, t, g, unknown or other
  misc_feature (288)..(288): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccgaggtacagttggtgcagtcgtggggctggaggtgaagagccgtggggcctcagtgaacggtctccgtgcaaggcttcgtggatacaccttcaccggctactatactccacgtgggtncgacacggcccgtaggacgaagggtcttgagtggagtgggaacggactaccgaaacccgtaacgaccggtaggaccaacaaacgaacgccaacacggtaacgtttacgaggggaccgtaacggggtaccaaccgtagtacggaacccgaaggggtacccaaccggtttacccgttacgaacggtacccgaaaccgtaaccggtacccgttaccggtttacgggaacggggtttaggaacggtccggtaaacggtccgttaggacgtagttaccgtaggaaccggtaccgtacccgggtacgttacggtacttacgtcggtacggacggtaaggagggaacggtaacgtaggttacggaacgggttaacggtaagttaacccggaggtaccgggtttaagggtacggtttaaacgggtcgggtttaaacggg

SEQ ID NO: 239102 - DNA, 640 bp, Homo sapiens
  misc_feature: GYAE6OF01CABDL.4.18.B07.1.454.CMB.1.raw
  modified_base (507)..(507): a, c, t, g, unknown or other
  misc_feature (507)..(507): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactccccaggtacagttggtgcagtcgtggggctgaggtgaagaagccgtggggcctcgagtgaaggtctcctgcgaaggcttcgtggataccaccttaccaccggtactactatactccacgtggggtcgcgacgacggccccgtaggacgaagggcttggaggtggagtcgggaacggactaccgaaacccgtaaccgaccggtacggacaaacaaacgaacgacaacgaacgtaagttcggagggcgacgggtaccacgagtacgaaccgaggacctacgtccttacgacgtacacgacgtcctacgttcgggagtacgacgacgtaggcgtagaggtntacgtacggacgtaccgacgggtcgttagttactacgtcggtgacggtaggaggtaacggtaacggtacgtagggacggtacggtaataccggtagtacgttagggttaagggttaaggagggtttaaccggg

SEQ ID NO: 239103 - DNA, 856 bp, Homo sapiens
  misc_feature: GYAE6OF01C1SV8.4.18.B07.1.454.CMB.1.raw
  modified_base (249)..(249): a, c, t, g, unknown or other
  misc_feature (249)..(249): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctgggaggatcctcttcttggtggcagcagcctcaggagcccactcccaggtacagttggtgcagtcgtggggctgaggtgaagaagccgtggggcctcgagtgaaggtctcctgcaaggcttcgnggataccaccttcaccggtctactatactccacgtgggtgcgacgacgggcccctaggaccgagggtcttaggaggtggagtacggggacggaactacccgaaaccccgtaacgaccgggtacgaccgaaaccgaaaaccgaaacgacccgaacgtaaacggttaacggtttaccggaacggggacgtacggggtaccaaccgtaacggttaccggacccgggtaaaggggaacccgtacccggttacccgtttaccgaaacggacccgtaaccgaacggtaaccccgttaacggtttacggggaacgggtttacggaaccggtaccggtaacgggttcccggtaggtaacgggtacgttacccggtaacgggtaacccgaacccggggttacccggggtaccggtttaacgggttttaaccgtttacgggttacgggttaggggaaacccggtaaggggtaaacgggtaaaaccggggtaaacgggttaaccggttttacggggtaaacgggggttaccgggtaaacccggttaaacggtaacgggttaccggggtttagggtttaaacggggttaaacgggtttaaggggtttaaaccccggggg

SEQ ID NO: 239104 - DNA, 725 bp, Homo sapiens
  misc_feature: GYAE6OF01CFHCW.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcacatggactggacctggaggatcctctttcgttggtggcagcacgcctcgaggacgcccactcccgaggtacagttggtgcagtcgtggggctagagggtagaagacggccgtggggtccctgagtacggaagtccgtccgtagacgaaggtctttaccgaggtaactaccgtaaccgtttccgaccggtactaacgttaactactaccgtaagtcgggtacgacggacacggtaccctaggaacgtaacgggtcttagggacgtagggtagtacggggaaccgtaactacccgtaaaccccgtaacggtaccggacgaaccaaacgaaacgaacgaccaacgtaaggtaacgttacggagggtacgtaacgggtcaaaccgtagtacggaacgtacggacctaccgttccgtacacggtacacgtactaccgttaggtcgagtcggacgacgtaggctaggtagtactcgacgtaccggaacgtaccgggtacgttaggttaactacggtggacggtacggtaaggaacggtaaggaaccgttaggtaacggttcggaaacggttagaacgtagggtaaccgttagggttaaacgttacgggagttaaacccggg

SEQ ID NO: 239105 - DNA, 571 bp, Homo sapiens
  misc_feature: GYAE6OF01B24FM.4.18.B07.1.454.CMB.1.raw
  modified_base (245)..(245): a, c, t, g, unknown or other
  misc_feature (245)..(245): n is a, c, g, or t
  modified_base (446)..(446): a, c, t, g, unknown or other
  misc_feature (446)..(446): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaagtctcctgcaaggcttcgnggatacaccttcaccggctactatatccacgtgggtgcgacacggccccgtggacgaagggcttaggaggtggagtggggacggataccgaaaccctaacgaccggtgacaacaaacgacgacacagtaagttcgaggcgaggtcacagtcgacgaggacacgtcctacagcacgacgctagtggagtgagcgagctgagngtcgtagaccggacgaccgggtccgttgttaacgttcgttggtacgacggtaggaaggaacggtaagtacggtaggtacgggtacgtaatacgtaggtcgttaggtaggttaagtgggtaaccgg

SEQ ID NO: 239106 - DNA, 655 bp, Homo sapiens
  misc_feature: GYAE6OF01DJZBO.4.18.B07.1.454.CMB.1.raw
  modified_base (248)..(248): a, c, t, g, unknown or other
  misc_feature (248)..(248): n is a, c, g, or t
  modified_base (284)..(284): a, c, t, g, unknown or other
  misc_feature (284)..(284): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctggaggtgaagaagccgtggggcctcgagtgaaggtctcctgcaggcttcngatacaccttcacggctactatactccacgtgggtncgacacggcccctaggacgaagggcttggagtacggagtggggacggtataccaaaccccgtaacgaccggtacggacgaaccaaaacgaacgacgaacaagtaacgtttcgacgggcgagggtaccaccgtagtacgaccgaacgggaaccaccgttccgttaccgacggtaccaccgaacgtcccgttaacgttagggtagggtacggacgcggaacggtcgtaggacgtaacgtccgttacgaaccggacgtaccgggccgttagttacttacgtggtcggtacgaaggtaggaggaaaggtacgttagggtacggtacggtagtaacgtacggtacgttagggtttagggtaaggtagggttaacgg

SEQ ID NO: 239107 - DNA, 654 bp, Homo sapiens
  misc_feature: GYAE6OF01ALLOJ.4.18.B07.1.454.CMB.1.raw
  modified_base (260)..(260): a, c, t, g, unknown or other
  misc_feature (260)..(260): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcgagtgaaggtctcctgcaaggtcttctggatacaccttcnccggctactatatccactgggtcgcgacacggcccctggacaagggcttgaggtggagtggggacggtacgtaccaaccccgtaaccgacccgggtggaccaaccgaaaaccaacccggaccaacgtaacggtaaacgttttcgaagggggacaacggggttccaaccgattacggaacccgacggggaacctaccggttacccttacacggcccaacgacggtacccttaacgttgggaacgggttgacggacgaggcgtaggaagtactcgtacggacgaccgaccgggtccgttaggttacttacgtggtcgcggtaggaaggaagggagtagttaggacggttcggaagttacgaggtcgttaggttagggttaaagtgggttaaccggg

SEQ ID NO: 239108 - DNA, 806 bp, Homo sapiens
  misc_feature: GYAE6OF01DTLNU.4.18.B07.1.454.CMB.1.raw
tcagagcactgtagcacgaccggtgctcgatttagtcgctgcgtaagggggagcatcacccagcaaccacatctgtcctctagagaactcccctgagagctccgttcctcaccatggactgggacctgggaggactcctcttcttgggtggcagcagcctcgaggacgccccacctcccgaggtacaggttggtgcgtaggttcgtggggctggaggtagaaagacgccggtcggggcctcgaggtgtaacggtcctccgtggacgaagggtccttacgtaggtaactacctacccgttccgaccggtaccttaactatactacccgtacggttcggggtacgccggaaccggaccgggtacccccgtaggggaaccgtaacgggggtcctttagggacgggttacgggtacggtacgggggtaccggtaacgtaacccgtaaaccccggtaaccggtaacccggggtacggaaccaaaccgaaaaccgtaacccgacgaaaccgtaaacggtaacgtttaccggacgggtacggtaacgggtaccaaccgtacgtacggaaccgaacgggtaccctaccggtccttacgacgacacgcgtaccttacggtagggaggtcggagcgtaggtgaggtagacgtccgtagaccggacggtaccggtaccggttagttacgttacggtcggtacggacggtaaggaacgggaaggttaacggttacggttacgggtacgggtaacggtaacgttaaccggtacggttacgggttaggggttaacgggttaaagggtacggttaaccggg

SEQ ID NO: 239109 - DNA, 533 bp, Homo sapiens
  misc_feature: GYAE6OF01DZ4YH.4.18.B07.1.454.CMB.1.raw
  modified_base (244)..(244): a, c, t, g, unknown or other
  misc_feature (244)..(244): n is a, c, g, or t
  modified_base (285)..(285): a, c, t, g, unknown or other
  misc_feature (285)..(285): n is a, c, g, or t
  modified_base (462)..(462): a, c, t, g, unknown or other
  misc_feature (462)..(462): n is a, c, g, or t
  modified_base (489)..(489): a, c, t, g, unknown or other
  misc_feature (489)..(489): n is a, c, g, or t
  modified_base (523)..(523): a, c, t, g, unknown or other
  misc_feature (523)..(523): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcnggatacaccttcaccggctactatatccactgggtgcgacnggcccctggacaagggcttgagtggagtgggacgatcaaccctacaccggtgcaacaaacaacgcacagaagtttcgagggcagggtcacagtacgaccagggacacgtcctcagcacagcctactgggagtgagcgaggctagagatcgtgacgacacggtccgtgttatacgtgngacgtaggaggaggaagtacgttaggngtacggataacgagtactagggttaggttaaggnggttaacggg

SEQ ID NO: 239110 - DNA, 806 bp, Homo sapiens
  misc_feature: GYAE6OF01BVI1Y.4.18.B07.1.454.CMB.1.raw
  modified_base (185)..(185): a, c, t, g, unknown or other
  misc_feature (185)..(185): n is a, c, g, or t
  modified_base (675)..(675): a, c, t, g, unknown or other
  misc_feature (675)..(675): n is a, c, g, or t
tcagagcactgtagcacgaccggtgctcgatttagtcgctgcgtaagggggagcatcacccagcaaccacatctgtcctctagagaatcccctgagagcctccgttcctcaccatggactggacctggaggatcctcttcttggtggcagcagcctcaggacgcccactcccaggtacagttggngcagtctggggctggaggtgaagagccgtggggcctcgagtgaaggtcctcgtgcgaaggtcttcgtacggactaccgaccttcgaccggtctaactatactccgagtggtcgcgacacggccctaggacgtaaggcttaggacggtggaggtcgggaacggtactaccgtaaacccgtaacgaccgggtacgggaccaaaacgaaaccgtaacgaccgaaactaacggtaaacgtttccggaagggggtactaacggggtaccaaccgtaacgtacgggaaacccgacggggtaacctacccgggtttacccgttaacgaacggaccgaaacccgtaacggtaaccccgtttaaacgggtttgggggaaacgggtttacgggaaaacggtccggaacggggaacctttagggaaaccggtacttccgggtaacgggaacccggtaacccgggtaaccgggtacccgttacggtttaacggtttaccggngggttaacgggacccgggttaaagggaacggtaaacggggtaactaccggggtttagaacggggttacccgggaaattaccggaagggtcgtttaagggttaacgggtttaaagggtacgttaacccgggg

SEQ ID NO: 239111 - DNA, 579 bp, Homo sapiens
  misc_feature: GYAE6OF01D4VHW.4.18.B07.1.454.CMB.1.raw
  modified_base (566)..(566): a, c, t, g, unknown or other
  misc_feature (566)..(566): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttctggatacaccttcaccggctactatatccactggtgcgacaggcccctggacaagggcttggagtcggagtgggacgatcaacctaacaccggtgcacaaaacacgacacagaacgtttcgagggcgagggtcacatacgaccagggacacgtccttcagcacacgtacctacgttgggacggttgacgcgagggtctaggagagtacgtagaccgacgacggtccgtacgttacttacgtgtacgccggagacggaaggtaacgtagttaggtaacggtacgggattaaccggacgtacggttaggttaagggttaaaggnggttaaaccgggg

SEQ ID NO: 239112 - DNA, 774 bp, Homo sapiens
  misc_feature: GYAE6OF01CR93M.4.18.B07.1.454.CMB.1.raw
  modified_base (140)..(140): a, c, t, g, unknown or other
  misc_feature (140)..(140): n is a, c, g, or t
tcagagcactgtagcacgaccggtgctcgatttagtcgctgcgtaagggggagcatcacccagcaaccacatctgtcctctagagaatccctgagagctccgttctcacatggactggacctggagatcctcttcttggnggcagcagcctcaggacgcccactcccaggtacaggttggtcgcgagtcgtgggctggaggtgaagaagcgtacgggcctgagtagaacggtctccgtgaccgtaagggtctttacgacgggtaactaccgtacccgtttaccgaccgggtacttaaccgtagtacctaccgtaacggtcggggtacgaccgtaccgtaccggtccccgttaggaaccgtaacggggtccgttagggaaggtttacggacggttacgggaacgacgttacccgtaaaaccggttaaccgaccgggttaacggaaccgaaaacgaaaaccgtaacccggaactaacggtaaacggttaacggttacggaaccggggacgtaaacggggtaaccaaccgtaacggtaccgggaaccgacggggtaacctaaccgggttacctttaacgaacggtaccctaaccgaacggtaaccttacggtacggacggttcgacgacgacgtcgtaaggtacgtacgtcgacgtacgacgaccggtacgtagttacgtacgtggacgtacggaagggagtaagggtaacgtagtacggtcgggttaacgaagttacggaacgtcgtaaggttacggtaaaggtcggttaaccggg

SEQ ID NO: 239113 - DNA, 717 bp, Homo sapiens
  misc_feature: GYAE6OF01A36TN.4.18.B07.1.454.CMB.1.raw
  modified_base (394)..(394): a, c, t, g, unknown or other
  misc_feature (394)..(394): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagccctcgaggacgccccacctcccaggtacagtttggtgcagtcgtggggctgaggtgaaggagtccgtggggcctcgaggtggaaggtcctccgtgcaaggtcttgtggataccaccttcgaccggctacttatatccactggggtcgcggacgacggccccgtggacgagggtcttggaggtggagtgggacgacgtaccaaccccgtaacgaccggtcgacaaccgaaacgaacgccaanaacggtaagttacggacgggacgacgggtaccacgactacggaaccgaacgggaccgtaccgttcccttacgacgtacccaccgtacggtacccttacggttacgggtaggtacggtacggacgaacgggtcgtaggaacgtacgttacgaccggaaccggacccgggtaacccgggttccggtttaacggttaacgtttaacgtggtacgggacggaagggaaagggacggggtaaacgttacggttagggtacgggttacgtaagttaaccggacggttaggttaagggttacgggttaaagggtacgggtttaaaccggg

SEQ ID NO: 239114 - DNA, 824 bp, Homo sapiens
  misc_feature: GYAE6OF01ET1SE.4.18.B07.1.454.CMB.1.raw
tcagagcactgtagcacgaccggtgctcgatttagtcgctgcgtaagggggagcatcacccagcaaccacatctgtcctctagagaatccccctgagagcctccgttcctccaccagtggactcggaccgtgggaggactccttctttcgttgggtggcagcacgcctcgaggacgcccacctcccgaggtactaggtttggtgctagtcggtggggctggagggtagaaaggacgtccggtcggggccttacgaggtaggaacggttcctccgtggacgaaggtccttcgtaggactacctaccttaccgacccggtacttaactattacctaccgtacggttgggtcgaccggaaccggaccggtcccccggtagggaaccggaacggggtcgttagggaggtagggtaggtaggggaaccggtactaccctaaaaccccgtaacggtaccgggtacgaaccaaaccgaaaacgaacccgacaacgtaaaggttaacgttacggaacggggtaccgtacgggtaccaaccgtagtaccggaaccggaacgggtaacctaccggttcccgttacgacgacccgaacgaccgtaccgtttaacggtgggtacgggtagacggacgacggtcgtagaacgtacgtcgtacggaccgaccggtaccgggtacccgttaggttaacttaccggtggtacggacggtaagggtaaaggtaacggggtaaacgttaacggttacgggaacgggtacccggttaaagtaccggtacggttaccgggttttaggggttaacggggtttaaaaggtacgggttaacccgggg

SEQ ID NO: 239115 - DNA, 681 bp, Homo sapiens
  misc_feature: GYAE6OF01BOF0W.4.18.B07.1.454.CMB.1.raw
  modified_base (630)..(630): a, c, t, g, unknown or other
  misc_feature (630)..(630): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccaggtacagttggtgcagtcgtggggctgaggtgaagagccgtgggcctcgagtgacggtcctccgtgcgaaggtcttcgtggactactaccttcgaccggctaactatactcctacgtgggtgcgacgacggcccgtaggacgaacgggtcttaggaggtggagtcgggacgataccaaccgtaacgaccggtagaccaacgaaacacgacaacgagtaacgttcgacggcgtacggtccaacgagtacgaaccgacgggacctacgtcctacgagacccacgacgtcccgttaaggtacgggacggttacggaacgacggtcgggacgtacggtaagtacgtacggtacgaaccggacccggtaaccgggttccggttacgttaacgttacgttcggacggaccgggaaagtaacgggaaacgggtacggttacgtagggtaacggaccgggtaaanacccggtagttaccggttaagggtacgggttaaaggcgggtttaaacccgg

SEQ ID NO: 239116 - DNA, 813 bp, Homo sapiens
  misc_feature: GYAE6OF01A7A4K.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctgggaggatcctctttcgttggtggcagcagcctcgaggacgccccactcccgaggtacagttggtgcagtcgtggggctggaggtgaagagccgtggggcctagagtgaggtctctgcgaaggcttcgtgataccaccttcgaccggctactatactccgacgtgggtcacgacgtacggccccgtggaaccgaaggtccgttaggacggtcgggaagtcgggaacgtagtacccgtaaacccgtaacgcccgggtagacaaccgaaaaaccgaacggactaaacgaggtaacggtttacgaacggggactaacggggttacaaacccgtagtacggaacccggaagggtaaccgtaacccggtacttaccgaacgacccgaaacgtacggtaacccgttacggttacggggtaggtacggtaacgacgtaacgggaccgttagggaaaccgtagttacccggtaaggtaacccggtaacccgggtaaaccccggggttccggttaaacgttaaccggttttaacgtacgggttaccgggtaaacgggaaccgggtaaaggggtaaaccggggtaaaacggttaacccgggttaagggttaaaccggtacggggtaaaacgtttaaccggtaaccgggttacggtttaagggtttacgggggttaaaaggttagggttaaacccgggg

SEQ ID NO: 239117 - DNA, 759 bp, Homo sapiens
  misc_feature: GYAE6OF01EBXZY.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctggaggtgaagagcgtggggcctgagtgaaggtctcctgcaaggtcttcgtggactacaccttcaccggctactatactccacgttggtcgacgtacgacggccccgtggacgagggtctaggagttggagtcgggacgtactacccgtaaacctaaccggacggtacggaccaacgaaacgaacgaccaacgagtaaacgtttacggacgggacgtacggggtaccaacgtacgtaccggaaccggaacgggaaccgtacccgttaccttacggaaccgtaccgaaaccgtaccgtaacccggtttaacgttacggggtacgggttacgaacgggtaccgaacgggtacgtaacgggtaaggtaacgttaccggaacggtaacccggaaccgtaccggggttaccgttaacgtttaccgtttacggttacggtacggtacggtacgggtaaagggtaacgggtaacgggttaacggttcgggtaaacggttacggtaaagtaacccgggaggtttaccggtaagggtttaacggggttaaacggtaacgggttaacccggg

SEQ ID NO: 239118 - DNA, 610 bp, Homo sapiens
  misc_feature: GYAE6OF01A7YCV.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtgggcctcagtgaaggtctcctgcaaggctctggatacaccttcaccggctactatatccactgggtgcgacacggccctggacagggtcttgagtggagtgggacgactaccgaaacctaacgaccggtgacaacaaacaacgcacagtaagttcgagggcagggtcaccatcgaccgagggaccacggttccttcacgtcaacgtacgccttaacgtgggaggtgacgcgacgggtctaggaacgtacttcgtaggaaccgacgtaccgggtccgttagttacgttacgtcggtaggacggagaaggtaacgggaaacgtaccgtttagggaacggttcggtaaacgttacggtacggttacgttacgggttaagggttaaaggagggttaaccggg

SEQ ID NO: 239119 - DNA, 580 bp, Homo sapiens
  misc_feature: GYAE6OF01AMGN0.4.18.B07.1.454.CMB.1.raw
  modified_base (467)..(467): a, c, t, g, unknown or other
  misc_feature (467)..(467): n is a, c, g, or t
  modified_base (518)..(518): a, c, t, g, unknown or other
  misc_feature (518)..(518): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagccgtggggcctcgagtgaggtctcctgcgaaggtcttcgtggactaccacctttccgaccggctactactactcctagtgggtcgccgacgacggccccgtaggacgaagggtcttaggaggtggagtgggacggactaccaacccgtacgaccggtcgacaacaaacacgcagagtaacgtcgaggcacggtacacatacgaccgaggacctacgttcctcacgctaacgcgtacccttaggtacgggaggtacggaancgacgggtcagacgacttcgagaccgacgacggtcgttagtattcgtgcgnggaagtaggaggaacgtagttggacgtcggtatacgaggtctaggtaggtaaggtcgtacgg

SEQ ID NO: 239120 - DNA, 643 bp, Homo sapiens
  misc_feature: GYAE6OF01AS15S.4.18.B07.1.454.CMB.1.raw
  modified_base (504)..(504): a, c, t, g, unknown or other
  misc_feature (504)..(504): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagccgtggggcctgagtgaaggtcctccgtgcaaggcttcgtggatacaccttcaccggctactatatccactgggtgcgacacggcccctggacaagggcttggagtggagtgggacggatacgaaccctaacgaccggtggcaacaaacaacgcacagtaagttcagggcagggtcaccgatcgaccgagggactacgtccttacgacgccacgacgcctacgttgggaggtgacggcgacggctaggagtatccgtaggaccggaacgtaccgggtccgttagttacgtttaccgnggttacggaccggtaaggtaacgggaagggtaaacggtacggtttaacgggaggggttaaccgggtaacgtttaacccggaagggttacccgtttaaggggttaacggggtttaaaggtaacggggtttaaacccgggg

SEQ ID NO: 239121 - DNA, 640 bp, Homo sapiens
  misc_feature: GYAE6OF01ANL1H.4.18.B07.1.454.CMB.1.raw
  modified_base (247)..(247): a, c, t, g, unknown or other
  misc_feature (247)..(247): n is a, c, g, or t
  modified_base (564)..(564): a, c, t, g, unknown or other
  misc_feature (564)..(564): n is a, c, g, or t
  modified_base (606)..(606): a, c, t, g, unknown or other
  misc_feature (606)..(606): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagccctcgaggagcccactcccgaggtaccagttggtgcagtctggggctggaggtgaagagccgtggggcctgagtgaggtctctgcaggcttcgnggataccgaccttcgaccggtctactatactccgacgtgggtacgcgaaccgacggtccccctaggaaccgaaaggggtcctttggaggttacgggacgttacggggaaccgggtattacccgaaaccccgttaaacgacccgggttggaaccaacgaaaaccgacgcaacgaagtacgtttcgagggtcagggtccacgatacgaaccgaggacctacggttcctacgacgtacacgcggtaccctacgtgggaaggttgacgtacgaggcgtgaacgtatcgtaggaccgaccgaacggtcctagtacgttacgngtcggacgaggtacggacggtagtacgtggtacgtacgtaanaccgtagtcgtaggttacggtaagtggtaaccgg

SEQ ID NO: 239122 - DNA, 910 bp, Homo sapiens
  misc_feature: GYAE6OF01D05GI.4.18.B07.1.454.CMB.1.raw
  modified_base (300)..(300): a, c, t, g, unknown or other
  misc_feature (300)..(300): n is a, c, g, or t
tcagagcactgtagcacgaccggtgctcgatttagtcgctgcgtaagggggagcatcacccagcaaccacatctgtcctctagagaactcccctgagacgccttccgttcctccacagtcggactggacctgggaggactccttctttcgttgggtggcagcacgcctacgacggaccgcccaccttcccgaaggtaccgtaggtttcgggtgcgtacggttcggtcgggggtcgttagggagggtaaggaaaggacggccgggtcggggtcctacgtaggtacggtaacggtcctccgngacgtaacggttctacgtacggtactaaccgtaccgttaccgaccgtctaacttatactccgtacgttggggcaccggacgacccggtccgtaggaacggtacggtcgttagggaggtacgggacggtagggaaccgtactaacccgtaaacccgtaacggaccgggtacggaaaccaaacgaaaaaccgtaccggactaacggtaacgtttaaccggttacggaacgggtaccgtacggggtaacccaacgtaacggtaaccggaaccggtacgggtaaccgttacccggtaccttaaccgaccggtaaccgtaaccggtacccgggtttaacccggttaacgggtcgggtaaacggggttaccgacggggtaacggacgggtacgggtaacggtacgtacgtaaccgggttaacggaacccggtaaccggggtaccgttacgggttacgttaacgttacggtcgggtaacggacggtaaggggtaaacgggtaaacgggttacggttaagggttacgggtaacggggttaacgtaaacggttacgggttaacggttaccgggtttaagggtttaaaggggtaaacccgggttaagggttaaacccggg

SEQ ID NO: 239123 - DNA, 656 bp, Homo sapiens
  misc_feature: GYAE6OF01ARSPS.4.18.B07.1.454.CMB.1.raw
  modified_base (583)..(583): a, c, t, g, unknown or other
  misc_feature (583)..(583): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatccttcttcgttggtggcagcagcctcgaggacgcccactcccaggtacaggttggtgcagtcgtggggctggaggtagaaggacgccgtcggggcctcgagtaggaggtcctccgtggacgacggtcttcgtggaacttacctacccgttcgacccggtacttaactacttactaccgtacggtgggtcggccgaccgacggcccgtaggacgtacggtcgttaggaggtggaggtagggacggactaccgaaaccctaacggaccggtacgaacaaccaaaccgacgaccgaacgaacggtacgttacggaacgggtacgacgggtaaccacgtaacgtacgaaccggacggacctaccgtcctacgacgcaacgacgtacctacggtgggaggtagacgtcgaggtcgtagacgtagcgaggaccgacgtacggtcgtagtacgtacgnggtagaggacggaaggaggacgtaggtggaggtcgtaagacgtggtacgagggttacggtaaggtggtaacgg

SEQ ID NO: 239124 - DNA, 713 bp, Homo sapiens
  misc_feature: GYAE6OF01AJDO6.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaaggaagccgtggggcctcgagtgaaggtctcctgcaaggcttctggactacaccttcgaccggtctactatactccacgtgggtgcgacacggccctggacaagggctggagtggagtgggacggatccaaacccgtaacgaccggtggaccaacaaaaccgaacgaccaacaaggtaaacggtttacgaggggaccgaacggggtaccaacccgtaacgtacggaacccggaacggggtaaccgaaccggttcccttacgaaccggtcaaccgaacgtcccgttaacggttgggtacgggttacggacggacgacgggtaccgtaggaacggtaacgtccgtaggaacccggtaaccgaccggggtacccgttacggttaacgtttacgtagggtacggacgggaaggaaaggtaacggggtaacggtacggttaagggtaacggtttacgggaacttacggtaggtacgttagggtttaacgggttaaagggtaaggttaaccggg

SEQ ID NO: 239125 - DNA, 555 bp, Homo sapiens
  misc_feature: GYAE6OF01BZ7TR.4.18.B07.1.454.CMB.1.raw
  modified_base (247)..(247): a, c, t, g, unknown or other
  misc_feature (247)..(247): n is a, c, g, or t
  modified_base (283)..(283): a, c, t, g, unknown or other
  misc_feature (283)..(283): n is a, c, g, or t
  modified_base (396)..(396): a, c, t, g, unknown or other
  misc_feature (396)..(396): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagaagccgtggggcctgagtgaaggtctcctgcaaggcttcnggatacaccttcaccggctactatatccactgggtncgacaggccctggacaagggcttgagtggatgggacgatcaacctaacacggtgcacaaacacgcacagaagttcaggcagggtcacatcgacaggacacgtctcagcacgancctacgtggaggtgagcgaggctgacgtatctaggacgacgacgggccgttagtattacgtggtacgtcggaagaaggaagggaaacggtacgttaggtaacggtcgggaaacgtacgtaacggcgttaggttaaggggttaaagtagggttaaacggg

SEQ ID NO: 239126 - DNA, 728 bp, Homo sapiens
  misc_feature: GYAE6OF01E3Z22.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctggaggtgaagaagccgtggggcctcagtgaaggtctcctgcaaggcttcgtggataccaccttcaccggcttactatactccacgtggggtcgcgaccgacggccccgtaggaaccgaaggggtcctttgggaggtgggagtacggggaccggaactacccgaaaccccgtaaaccgaccggggttacggaacccaaaccgaaaacccgaaccggaccaaaccgtaaacggtaaacggttttccggaacggggtaccgtacggggttaccaaccgtacgtaccgggaacccgaacggggacctaaccggttacccttacgacgtaccaaccgaccgtaccgttacggttcggggacggtggacgtcgaggtcgtaggtacgtacgttccgtacggaccgaccggtaccggttccgttagttacgttacgtcggtaggaccggaaggaaggtaacgggtaacgtacggttaggtacggtacggtaagtacgtaggtacgttgggttaacgggttaaaggacgggttaacgg

SEQ ID NO: 239127 - DNA, 656 bp, Homo sapiens
  misc_feature: GYAE6OF01CXBI2.4.18.B07.1.454.CMB.1.raw
  modified_base (557)..(557): a, c, t, g, unknown or other
  misc_feature (557)..(557): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggagactcctcttcttggtggcagcagcctcaggacgcccactcccaggtacagttggtgcagtcgtggggctggaggtgaagaagccgtggggcctcgagtgaaggtctccgtgacgaaggcttcgagataccaccttcgaccgtactactatactccagtggtcgacgtacgacggcccctaggacgaaggtctaggaggtcggagtcgggacgactaccgaaacccgtaacgccgggtagaccaaacaaacgacgaccaacgaagttaacgttcgagggcgtagggtaccaacgagtacgaccgaacggtactaccgttaccttacgaacgacacgacgtacccgtagttacgggaggtacgacgacgacggtcgtagaacgtacgtacgtacggaaccgaccggtaccggacgttagttacgttacgnggtacgacggtagagggaacggtaaacgtacgttaggaacggtacgtaagtaacgtacggtacgttacgggttaaggttaaacggtcgggttaaaccgg

SEQ ID NO: 239128 - DNA, 948 bp, Homo sapiens
  misc_feature: GYAE6OF01BNKMQ.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggactcctctttcttgggtggcagcagccctcgaggacgccccactcccgaggtacaggttggtgcagtcgtggggctggaggtgaagacgccgtgggcctgaggtgaacggttcctccgtgacgaacggtccttcgtaggaacttacctacccgtttccgaacccgggtccttaaccttaacttacgtacccgtaacggttcggggtcgaccggacgaccgggtcccccggttacgggaaccggtaaacgggggtccgtttagggagggtaggggtaacggtacgggggaaccgggtaaccgtaaccccgtaaaacccccggtaaacccggtaacccggggttaccggaacccgaaaacccgaaaaaacccgaaacccggaacccgaaaccgtaaacgggttaaacggttttaccggaacgggggtaccggtaaccggggtaccctaaacccgtaacggttaccgggaacccggtaacggggtaacccgtaaccccgggttacccctttaccggaaccggtacccgtaaaccggtaaccggtaaccccgtttaacgggttacggggtaacggggttacggaaccgggtaccggtacgggtaccgtaacgggtacgtaacgttaccggtaccggtaaccggaaccggtaccgggttaccgttacggtttacgttacggttaggttacgggaacggtaacgggaaacgggtagggtaaaccggttaggttacggggtaacgggtaaccgggttaacgtaaccgggtacggttacgggttaagggtttaggggttaaaacgggtagggtttaaaccccgggg

SEQ ID NO: 239129 - DNA, 601 bp, Homo sapiens
  misc_feature: GYAE6OF01B7IHU.4.18.B07.1.454.CMB.1.raw
  modified_base (185)..(185): a, c, t, g, unknown or other
  misc_feature (185)..(185): n is a, c, g, or t
  modified_base (248)..(248): a, c, t, g, unknown or other
  misc_feature (248)..(248): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacaggttggngcagtcgtggggctggaggtgaagagccgtggggcctcagtgaaggtctcctgcaaggcttgngatacaccttcacggctactatactccacgtgggtgcgacgacggccccgtggacgaggcttggagtggagtggggacggataccgaacccctaacgaccgggtgacaacaaacacgcacgagaagttcgacgggactacgggacaccgagtacggaccgtagggacctaccggttcctacgacgacacgacgccgttacgttagggaggtggacgcggacggtctaggaagacgtcgtacggaaccggcgaaccggttcggtagttaacgttacgcggtacgcggaagaggaaaggtacgtacgttggacggtacgaatacgaggtctaaggttggtaaacgtggttaacgg

SEQ ID NO: 239130 - DNA, 663 bp, Homo sapiens
  misc_feature: GYAE6OF01BUIJZ.4.18.B07.1.454.CMB.1.raw
  modified_base (247)..(247): a, c, t, g, unknown or other
  misc_feature (247)..(247): n is a, c, g, or t
tcagagcactgtagcacgaccggtgctcgatttagtcgctgcgtaagggggagcatcacccagcaaccacatctgtcctctagagaataccctgagagctccgttcctcaccatggactggacctggaggatcctcttcttggtggcagcagcctcaggagccccactcccaggtacagttggtgcagtctggggctgaggtgaagagccgtggggcctgagtgaaggtctcctgcaaggtcttcgnggatacaccttcaccggtctactatactccagtcgggtgccgacgacggccccgtggaccgaagggtcttggagtggagtgggacgtactaccaaacccgtaacgaccggtaggaccaacgaaacgaaccgacaacgaaggtaaacgtttccggaagggacgacgggtaccaaccgaagtacgaaccgagggaacctaccggttccttacgacgaccaaccgacgtaccttacggtagggacggtgacgtaccggaggcgtaggagtacgtacgtacggaccgacgtaccggtacgttagttaacgttaccgtaggtcggacggtaaggagggtaacggaacgttacgttagggacggttacggtaacgtaacgtacggtacgttaggggttaacggttaaaggagggttaaccgg

SEQ ID NO: 239131 - DNA, 594 bp, Homo sapiens
  misc_feature: GYAE6OF01APJOF.4.18.B07.1.454.CMB.1.raw
  modified_base (244)..(244): a, c, t, g, unknown or other
  misc_feature (244)..(244): n is a, c, g, or t
  modified_base (401)..(401): a, c, t, g, unknown or other
  misc_feature (401)..(401): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctggggcctcgagtgaaggtctcctgcaaggcttcnggatacaccttcaccggctactatatcccactgggtgcgacacggccccgtggacgaaggcttggagtggagtgggacggatccaaccctaacgaccggtggacaacaaacaacgcacaagtaagttcgagggcagggtcaccatcgaccgaggacnccgtcttcacgcacacgtcctacgtgggacggtgacgcgacggctaggacgtactccaggaccgaccgtaccgggcgttagttaacgttacgtggtcggacgaaggaacggagggaaacggtagttagggaggttaccgggaacgttaacgaggtacgttagggttacgggttaaaggtgggttaaacccggg

SEQ ID NO: 239132 - DNA, 577 bp, Homo sapiens
  misc_feature: GYAE6OF01D7VOD.4.18.B07.1.454.CMB.1.raw
  modified_base (428)..(428): a, c, t, g, unknown or other
  misc_feature (428)..(428): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttctggatacgaccttcaccggctactatactccactgggtcgcgacgacggcccctgggaccgaaggggtcttaggaggtgggataggggacggataccgaaaccctaaccgaccgggtagacaacaaaacgaacgcaacagtaagtttcgagggcagggtcaacatacgacgaggacacgtcctnacgcacacgctacgtggaggtgagcgaggctagagagtctcggacgacgacggccgttagtacttacgtgtacggcgaggaggagggtaaagtacgttggaaggtaccggtataacgtagagttaggtagggttaagtaggtaaccggg

SEQ ID NO: 239133 - DNA, 672 bp, Homo sapiens
  misc_feature: GYAE6OF01A44EN.4.18.B07.1.454.CMB.1.raw
  modified_base (221)..(221): a, c, t, g, unknown or other
  misc_feature (221)..(221): n is a, c, g, or t
  modified_base (247)..(247): a, c, t, g, unknown or other
  misc_feature (247)..(247): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagaagcctggggcctnagtgaaggtctcctgcaaggtcttcnggataccaccttcgaccggcttactagtactccacgtgggtgcgacgacggccccgtggacgaagggcttaggaggtggagtgggacgatccgaaacctacgaccggtggacaacaaacgacgacaacacgtaagttcgacgggacgtaggtccaaccgaagtcgaaccgagggtaccaccgttccgtacgacgacaacacgtaccgtaaccgtgggaacgtggacgtcgaggtctaggagacttcggtagacccggaacgtacgggtcccgtttaggtaacttcgggtcggtcgtacgggaacgtaaacgggaacgggtaaacggtttagggttaaccggaacgggttacccgggtaaattaaccggtaacgggttccggttaaagggtttaacggggttaaaaggtcgggggttaaaaccggg

SEQ ID NO: 239134 - DNA, 512 bp, Homo sapiens
  misc_feature: GYAE6OF01D41M3.4.18.B07.1.454.CMB.1.raw
  modified_base (348)..(348): a, c, t, g, unknown or other
  misc_feature (348)..(348): n is a, c, g, or t
  modified_base (434)..(434): a, c, t, g, unknown or other
  misc_feature (434)..(434): n is a, c, g, or t
  modified_base (506)..(506): a, c, t, g, unknown or other
  misc_feature (506)..(506): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacgaagggcttgagtggatgggacgatcaaccctacaccggtgcacaaacacgnacagaagttcagggcagggtcaccatgaccagggacacgtccttacagcacacgcctacgttggagggtgagcaggctgagatcgngacgacgacggcccgtgtattacgtgtgcgagagaggaacgatggaggtcgatacgagctaggtaggtaagngtacgg

SEQ ID NO: 239135 - DNA, 695 bp, Homo sapiens
  misc_feature: GYAE6OF01D5LEC.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtctggggctgaggtgaagaagccgtggggcctgagtgaaggtcctcctgcgaaggtcttcgtaggaactacctaccttccgaccggtctacttatactccgacgtgggtcgccgacgaccggccccgtaggaccgtaagggtcgtttaggaggtaggagtacgggaacggtactaccgaaaccccgtaacgaccggtaggaccaacaaaccgacgacaacgaaggtaagttcgagggacgtacgggtcaaccgagtacgaccgacggactaccgttcctacacgacacgacgtacgttacgtgggtaggtacggacgtacgaggtcgtaggaagtactaccggtacggaaccggaccggtaccggtaccgttaggttaacgttacgtcggttacggacggacgggaagggtaacgggtaacggttacggttacggttaacggacgggttaacgtaacccgtaggtaccggttagggttaaacggggttaaaggtcggttaaaccggg

SEQ ID NO: 239136 - DNA, 589 bp, Homo sapiens
  misc_feature: GYAE6OF01EI7C8.4.18.B07.1.454.CMB.1.raw
  modified_base (424)..(424): a, c, t, g, unknown or other
  misc_feature (424)..(424): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacaggttggtgcagtctggggctgaggtgaagaagcgtggggcctcagtgaaggtcctcctgcaaggcttcgtggataccaccttcaccggctactatactccacgtgggtgcgacacggccccgtggaacgaagggtcttggagtggagtgggacgatacaaccctaacgaccggtgacaacaaacgaacgcaacagtaacgttcgagggcaagggtcaaccgatcgaccgaggaccacgtccttcganacacacgtcctacgtgggaggtgagcgaggcgtagagatcgagaccgacgaccgggtcgttagtacgttacgtggtagacggaggaaggacgggtaacgtacgttaggtaacggtacgagtaacgacggtacgttagggttaacggttaaagggtggttaaccgg

SEQ ID NO: 239137 - DNA, 716 bp, Homo sapiens
  misc_feature: GYAE6OF01AWQYG.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtctggggctggaggtgaagaagccgtggggcctcagtgaaggtctcctgcaaggcttcgtggatacaccttccaccggtctactatactccacgtgggtgcgacacggcccctggacgaagggcttggaggtggagtggggacggactaccgaaaccccgtaaccgaccgggtcggaccaaccaaaaccgaaccgacaacgaacggtaacgttttaccggaggggtaccgacggggttaccaaccgaacgtacggaacccgaacggggaaccctaccggttaccccgttacgaccggaccaaccgaacgtacccgttaacgttcggggaacggttaggacgtacgaggtcgtaggtaacgtacgttcgtaccggaaccggtaaccgtaccgggtaccgttagttaactttacgtaggttcggaccggtaggaacggtacgggtaaacggtacgttagggacggttaccgggtaattaaccggtaggtaccgttagggtttaacgggttaaaagggtggttaaaccggg

SEQ ID NO: 239138 - DNA, 583 bp, Homo sapiens
  misc_feature: GYAE6OF01BV4BE.4.18.B07.1.454.CMB.1.raw
  modified_base (473)..(473): a, c, t, g, unknown or other
  misc_feature (473)..(473): n is a, c, g, or t
  modified_base (574)..(574): a, c, t, g, unknown or other
  misc_feature (574)..(574): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcgagtgaaggtctcctgcaaggcttcgtggatacaccttcaccggctactatactccacgtgggtcgcgacgacggccccgtaggacgaagggcttaggagtgggagtgggacggactaccaacccgtaacgaccggtaggacaaccaaacaacgacacgaagtaagtttcgagggacgagggtacaaccgatacgaccgaagggaccacgtcctacacgcacacgcctacgttggaggtgagcgagcgtgagtntacgtacggacgaccgtacggtcgttagtaacttacgtggtgacgagaggtaaggaagtacgttaggacggtcggatacgagtacgttaggtaggttaagnggttaacgg

SEQ ID NO: 239139 - DNA, 696 bp, Homo sapiens
  misc_feature: GYAE6OF01BE6O6.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagaacgccgtggggcctcgagtggaacggtcctccgtgacgaaggtccttcgaggataccaccctttccgaccggtactacctatactaccctacgtcggggtgccgtacgacggcccccgtagggaaccgaacgggtccgtttggacggttgggaacggtggggaaccggtaactacccgaaaaccccgtaccgaccgggtacggaccaaaccaaaaccgacgaccaacgaaggttaacgttacggacgggacgtacgggtaccaccgatacggaccgaggacctaccgtcctacgcgaccacgactaccgtacgttagggacggtggacgccgtagggcgtaggagttacgtccgtaaggacccgacggtaccgggttccgttaacggttacttacgtggtccgaggaggaacggagggtaagtacggtagggtacggtacggtaagtacgtaggtacgttagggtacgggttaaggtaggtaaccggg

SEQ ID NO: 239140 - DNA, 555 bp, Homo sapiens
  misc_feature: GYAE6OF01AB9P1.4.18.B07.1.454.CMB.1.raw
  modified_base (308)..(308): a, c, t, g, unknown or other
  misc_feature (308)..(308): n is a, c, g, or t
  modified_base (321)..(321): a, c, t, g, unknown or other
  misc_feature (321)..(321): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttcgtggatacaccttcaccggctactatatccactgggtgcgacacggcccctggacaaggcttgngtggatgggacgntcaaccctaacgaccggtgacacaaacacgcacagaagtttcgagggcagggtcaccagtcgaccgagggacacgtccttcacgcacacgcctacgtggaggtgagcgaggcgtagagatcgagacggacgccgggtccgttgttacttacgtggtagcgaggaaggagggtaacgtacgttagggacgtacgggattacggagttcgtaggtagggtttaagaggttaccggg

SEQ ID NO: 239141 - DNA, 602 bp, Homo sapiens
  misc_feature: GYAE6OF01BNWYO.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagaagccgtggggcctgagtgaaggtcctcctgcaaggtcttcgtggatacaccttcgaccggctactatactccacgtgggtgcgacgacggccccgtggacgaagggtcttggagtggagtgggacgagtaccaaccgtaacgaccggtagacaacgaaaacaacgacaacgagtaacgtttcgacgggcagggtcaacgtatacggaaccgagggaccacgtaccgtacacgtcacgacgtacctacgtgggacggtgagtacgaggacgtggaagtacgtacgcgtaaccggacgtaccgggtcgttagtacttacgtaggcgtacggaggaaggacggaagtagttaggagtcggaagtacgtagtcgttaggttaggtaacgtggtaacgg

SEQ ID NO: 239142 - DNA, 735 bp, Homo sapiens
  misc_feature: GYAE6OF01AQM4F.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggagatcctcttcgttggtggcagcagcctcgaggacgcccactcccgaggtactaggttggtgctaggtcgtggggctggaggtagaagacgccgtgggcctgagtgacggtctcgtgcgtaggtcttcgtaggtactaccaccttccgaccggtctaactactactaccgacgtggggtacgaccggaccgaccggtccccgtacgggaacgtaaggggtccgttagggacggttagggtaggtacggggaccggtaacgtaaccccgtaaaaccccgtaacggtacccgggtacggaacccgaaaccgaaaaccgaaccggaccgtaaaccgtaacggtaacgtttacggaacgggtaccgtacgggtaaccaccgtacgtacggaaccggaggaccgtaccgttcctacgacgacctaacgaccgtacgtagtacgggacggtagacgacgaggtacgagtacgtactcgacgaccggaccgtacggtcgttagtacgtacgtggacgacggtaagacgggtaagtaacggtaggttaggaaccgggttacggaacgtacgtacgggtcgtttaagggttaagggtaacgggttaggttaaccggg

SEQ ID NO: 239143 - DNA, 533 bp, Homo sapiens
  misc_feature: GYAE6OF01BTHUS.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagccgtggggcctcagtgaaggtctcctgcaaggcttctggatacaccttcaccggctactatatccactggtgcgacaggcccctggacaagggcttggagtggagtgggacggactcaaccctaacacccggtggcacaaacaacgcacagaagtttcaggcaggtcaccagtcgacaggacacgtccttcacgcacacgcctacgttggaggtgagcgagcgtagagatcgtgacgacgaccggtccgttagtattacgtgtcgcggagaggaggaagtacgttggacgtcggactacgagacgtgtaggttaagtggttaacgg

SEQ ID NO: 239144 - DNA, 701 bp, Homo sapiens
  misc_feature: GYAE6OF01BFIC1.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctgggctgaggtgaagaagccgtggggcctcagtgaaggtctcctgcgaaggcttctggatacaccttcaccggctactatatccactgggtgcgacgacggcccctggacgaagggcttgaggtggagtgggacggactacgaaccctaacaccaggtacggacaacaaaacgaaccgacaacgaagtaaacggtttacgaaggggacgtaacggggtaccaacccgtaagtacggaacccgaaggggtaacccgtaccggttaccccttaccgaacggaccaaaccgacgtaccccgtttaaccgtttggggaaaccgggttgaccgggaccgagggtacctggaacggtaacttcgtacggaacccgaccggtaccgggtaccgttagttaacgttacgtcggttaggaacgggtaaggaagggaacgggtaagtaaccggtttgggaacggttaccgggaaacttacgacgggtacgtttaacgggttaggggttaaagttaaccgggg

SEQ ID NO: 239145 - DNA, 867 bp, Homo sapiens
  misc_feature: GYAE6OF01C9OUR.4.18.B07.1.454.CMB.1.raw
  modified_base (255)..(255): a, c, t, g, unknown or other
  misc_feature (255)..(255): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcgaggacgcccactcccaggtacaggttggtgcagtcgtggggctggaggtgaagagccgtggggcctcgaggtgaacggtctccgtgcgaggcttcgnggtactacctaccttccgaccggacttaactactactccgaacgtggtcgcgacgacggccccgtaggacgaacgggtcttagggacggtaggacggttaggggaaccggaacgtacccgaaaaccccgtaaccggacccgggtacggaaccgaaaccgaaaaccgaaccgtaccgaaaccgtaaacggttaaacgggtttaccgaacgggggtaacggtaaccggggtaccgaacccgtaaacggttaaccggaacccgggaaaccggggtaaccgttaaccccggttaaccccgtttaccgaaaccggcccggtaaaccgtaaccggtaccccgttttaagggtaccgggggtaagggtacgggtacgtacccgggtaacggtacggtacgggtaagttaccggtacggtaacgggaacccggtaaccgggtaccgggttccgtaacggtttaaccgttaccggtagggttaccggaacgggtacgggtaaagggaacgggttaaaacggtccgttaaggggtaaaccggtacgggttaaagttaaccggagggtttacccgggttaagggtttaaagggggttaaacccgggtgggtttaaacccgggg

SEQ ID NO: 239146 - DNA, 596 bp, Homo sapiens
  misc_feature: GYAE6OF01APU79.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccgaggtactaggttggtcgctagtcgtggggctggaggtagaagacgcgtgggcctgagtgacggtctccgtgacgaaggtcttcgtagtactacctaccgttaccgaccgtactactactactccgtacggtcggcgacgacgccggccgaggacgacggtcgtggaggtggaggcggacgactaccgaaccgtacgacgacgacaacgaacgacgacagacgtacgtacgacggacgacgtacacgacgacgacgtacggacctacgtaccgtacgacgacacgacgtacgtacgtaggaggacgacgacgacgacgagacgtcgacgacgacgacgtacgtacgtagtacgtagtgagacgagagacggtacgtgtaggtacggacgagtacgtagtacggtaggtacggtaggtcggtacg

SEQ ID NO: 239147 - DNA, 586 bp, Homo sapiens
  misc_feature: GYAE6OF01AT9NE.4.18.B07.1.454.CMB.1.raw
  modified_base (363)..(363): a, c, t, g, unknown or other
  misc_feature (363)..(363): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttgggtggcagcagcctcaggagccccactcccaggtacagttggtgcagtcgtggggctggaggtgaagagcgtggggcctcgagtgaggtctccgtgacgaggcttcgtggactacaccctttccgaccggtctaacgtatactcctacgtgggtcgcgacacggcccctggacgaaggcttgaggtggagtgggaacggactacgaaaccctacgaccggngacgaacaaaacgaccgacacgaagtacgttcgaagggcaggatcaacagacgacgaggaccacgtcctcgacgacacgagtacctacgtagggacggtgagtccgaagggtcctaggtagactcggtacgacgacgacccggtcgttacgtactcgtggacgacggaggaggaggtaagacgttgggagtacggatacgagacgttggtaggtagtaacggg

SEQ ID NO: 239148 - DNA, 575 bp, Homo sapiens
  misc_feature: GYAE6OF01BSLY7.4.18.B07.1.454.CMB.1.raw
  modified_base (242)..(242): a, c, t, g, unknown or other
  misc_feature (242)..(242): n is a, c, g, or t
  modified_base (549)..(549): a, c, t, g, unknown or other
  misc_feature (549)..(549): n is a, c, g, or t
  modified_base (567)..(567): a, c, t, g, unknown or other
  misc_feature (567)..(567): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtgggcctcagtgaggtctcctgcaaggcttntggatacaccttcgaccggctactatatccacgtgggtgcgacacggccccgtaggacgaagggcttggagtggagtgggacggactaccgaacccgtaacgaccggtgaccaacaaacgacgcacaagtaagtttcgagggcgaggtcacagtacgacgaggactaccgtccttacgacgtacaacgacgtccttacgtgggaggtagacgacgaggtacgtagagtagtcgtggaaccgacgtacggtaccgttagtattacgtagtcgacggtagaggaggacgtagtaggaggtacgatacgngtcgttaggtagttaagngttaccgg

SEQ ID NO: 239149 - DNA, 661 bp, Homo sapiens
  misc_feature: GYAE6OF01E1ONK.4.18.B07.1.454.CMB.1.raw
  modified_base (501)..(501): a, c, t, g, unknown or other
  misc_feature (501)..(501): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctctttcttggtggcagcagcctcaggacgccccactccccaggtacaggttggtgcagtcgtggggctggaggtgaagaagccgtggggcctcgaggtggaacggtcctcctgcgaaggtcttcgtggactacctacccttccgacccggaccttactatactccacgtgggtcgcgacgacggccccgtggaccgaagggcgttggaggtggagtgggacggagtaccgaaacccgtaaccgaccgggtcgaccaacaaaacgaacgaccacgaagtaacgtttacgagggacgtacgggtccacctagtacgaccgagggactaccgtcctacacgacacacgcctacgttggaggtgacgacgnggtcgtaggacgtacgtcgtacggaaccggacgtaccgggtccgttagtttaacgtacgtcggtaggaccggtaggaaggtacgggtaaacgtagtttagggacggttacgggaactacggacggtcgttaaggttacggttaaaggacggttaaccggg

SEQ ID NO: 239150 - DNA, 657 bp, Homo sapiens
  misc_feature: GYAE6OF01EIA3X.4.18.B07.1.454.CMB.1.raw
  modified_base (296)..(296): a, c, t, g, unknown or other
  misc_feature (296)..(296): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtagaagaagccgtggggcctcagtgaaggtctcctgcaaggcttctggatacaccttcaccgctactatatccacgtggtgcgacacggccccgnggacgaaggggcttgagtggagtgggacgatacaaccgtaacaccggtagacaacaaacaacgcacagtaagttcgaggcgagggtcacacgtacgaccgtaagggacctaccggtcctacgacgtcaacacgtaccttaacggttgggagggtagacgtacgacgggtcgttagacgtatcggtacgggaaccgaacggtacccgggtaccgttacggttaactttaccggttaggtcggaacggacgggaaaggtaacggggtaaacggttacggtttagggtaacgggtacccgggttaaagtaccggtacggttacggttaggggttaaggggtttaaggaacggggttaaacgggg

SEQ ID NO: 239151 - DNA, 829 bp, Homo sapiens
  misc_feature: GYAE6OF01ELVO7.4.18.B07.1.454.CMB.1.raw
  modified_base (196)..(196): a, c, t, g, unknown or other
  misc_feature (196)..(196): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctgggaggactccttcttcgttgggtggcagcacgcctcgagggacgccccactcccgaggtacaggtttggngcacggttcgtggggtctagggacgggtagaacggtaacggtccggtcgggggccctacggtaggttacggtaacggttcctccgtaggaccgtaacgggtcctttcggttacggtaacttaaccctaccctttacccgacccgggtactaaccgttaactaccgtacccgtacggtcgggtcgaccggaaccgtaccgggcccccggttacggggaaacggtaaccggggtcgtttagggtaacggtagggtagggtacggggaaccggtactaaccccgtaaaacccgttaaccggtaccgggacggaaccaaccgaaaaccgaccggaacgaacgtaaggttaacggttaccggaacgggtaccgaggtaccgaaccgtacgtacggaaccggtaacggacctaacccggtcctacgacggaccaacggtactaccgttaccgtagggtacggtagacggacgacgggtctacggaatcgtacgtacggaaccggaccggtaccggtcgttacgttacgtacggtgtacggaggtaacggaacggtaacggtaacggttagtacggtaacggtacggtaacgtaacggtacggttacggtaaggttaaggggtacgtagggtttaaccgg

SEQ ID NO: 239152 - DNA, 686 bp, Homo sapiens
  misc_feature: GYAE6OF01CNK9O.4.18.B07.1.454.CMB.1.raw
  modified_base (244)..(244): a, c, t, g, unknown or other
  misc_feature (244)..(244): n is a, c, g, or t
  modified_base (285)..(285): a, c, t, g, unknown or other
  misc_feature (285)..(285): n is a, c, g, or t
tcagagcactgtagcacgaccggtgctcgatttagtcgctgcgtaagggggagcatcactcagcaaccacatctgtcctctagagaatcccctgagagctccgttcctcaccatggactggacctggaggatcctcttcttggtggcagcagcctcaggagcccactcccaggtacagttggtgcagtctggggctggaggtgaagaacgccgtggggcctcgagtgaaggtctctgcaggctntggatacaccttcaccggctactagtactccacgtgggtcnccgtacgacggccccgtggaccgaagggccttgaggtgagtgggaccgatcgaaaccctacgaccggtcgacaaacgaaacaacgacaacgtagtaacgtttcgacgggtacgaaggggtaccaaccgacgttacgaacccgaacggggaaccgtaccggttacccgttacgacgtaccgaacgacgtacccgttacgttacggggtaaggttacggacggtaccgaaagggtccgttaggaagtaacgttccgtaacggaaccgtaccgtaccgggtaccgttagttacgttacgtcggtaggacggtaaggaacgggaaggtaacgttaacggttaggtacgggtacggtaaacgttaccggaacgtaggtttacgggttaggttaaacggttaacggg

SEQ ID NO: 239153 - DNA, 610 bp, Homo sapiens
  misc_feature: GYAE6OF01EC4BH.4.18.B07.1.454.CMB.1.raw
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagccccactcccaggtacagttggtgcagtcgtggggctggaggtgaagagccgtggggcctnagtgaaggtctctgcaaggcttnggatacaccttcaccggctactatatccacgtggtgcgacaggccccgtggacgaaggggtcttaggacgtggagtgggacggactacgaaacccgtaacgacccggtgacaacgaaaccaacgccacgagtaagttcgagggcgagggtccacgagtcgacgagggacacgtccttcagcacgactccgtacttgggaggtgacgcgacggcgtagagagtcgtaggaccggaaccgtaccgggtaccgttagtaacgttactgggttacgacggaggaaggaagggtaacgtaacggtcggtaaggtacgggtaagtaaccgtaggtacggttagggttagggttaaaggtaggttaaccggg

SEQ ID NO: 239154 - DNA, 595 bp, Homo sapiens
  misc_feature: GYAE6OF01AMP2G.4.18.B07.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagccccactccccaggtacagttggtgcagtctggggctgaggtnaagaagcctggggcctcagtgaaggtcncctgcaaggcttcgtggatacaccttcaccggctactatactccatcgggtgcgacacggcccctggacaagggcttgaggtggactgggacggatcaaccctaacgaccggtgcaacaacacgcacagaagtttcgagggcagggtccaacagtcgaccgaggacgaccgtccttacgagaccaacacgtcctactgggaggtgacgcgacgggctaggagtactcgtacgacggtaccgtaccgggtaccgtagttacttacgtcgttaggaccggtaggtacgggagggtaaacgtacggttaggacggtacggaagtaccgaggttcgtaggttacgggtttaaggtaggttaaccggg

SEQ ID NO: 239155 - DNA, 798 bp, Homo sapiens
  misc_feature: GYAE6OF01E3IB4.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggagatcctcttcgttggtgcagcacgcctcgaggacgcccactcccaggtacgtaggttggtgcgagtcgtggggctggaggtagaagaacgccgtcggggcctcgaggtagacggtcctccgtgacgtaacggtcttacgtaggtaaccttaccgtacccgttccgacccggtacttaacgttacttacctcccgtacggttcgggacgaccgacgaccggtccccggtaggaacggtaacggggtcgttacgggaggtacgggaggttacggggaacgtactaaccccgtaaacccgtaaccggaccgggtacgaaccgaaaccgaaaccgtaaccgaccgtaacgtaacggttaacggttccggaacggggacgtaccgggtaccacggtaacgtaccggaacggaacggaccccgttacggtccctagacgtacccaacgtaccgttaccggttaggacgggtaggtacggtcgacggtagtaccggttagaacgttcgtaccggtaacggaccgtaccggtaccggttccggtttaagtacggttacggtacggtacgggacggtaaagggaacgggtaaacgtacgggtaacggttagggacgggttaaccgaacgttacgggtacgttagggttagttaaacggttaacgggcggtttaacccgg

SEQ ID NO: 239156 - DNA, 690 bp, Homo sapiens
  misc_feature: GYAE6OF01ELZ40.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagaaggccgtggggcctcgagtgaaggtctcctgcgaaggtcttcgtggactactaccttacaccggtctactatatccacgtgggtgccgtacgacggccccgtagggacgaacggggtcgttaggaggtacgggagtcggggaacggactacctaaaccccgtaacgaccggtaggacaaccgaaacaacgacacaacgtaagttcgaagggcgagggtacaacgatacggaccgagggacctaccggtccttacgagtaccaacgtacgtaccgtacgttagggacggtcggacgtcgacgggtctggaagtacgtacgtacgaacccggacgtaccgggtaccggttacgttaacgttacgtcggtacggacgggtaaggaacggtaagggaaacggttacggttagggtaacggttaaccgggtataacggtacgttaccgtttaagggttaaggggttaaagaagggtttaacccgggg

SEQ ID NO: 239157 - DNA, 643 bp, Homo sapiens
  misc_feature: GYAE6OF01BOVNB.4.18.B07.1.454.CMB.1.raw
  modified_base (155)..(155): a, c, t, g, unknown or other
  misc_feature (155)..(155): n is a, c, g, or t
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (543)..(543): a, c, t, g, unknown or other
  misc_feature (543)..(543): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtgcagcagcctnaggacgcccactcccaggtacagttggtgcagtcgtggggctgaggtgaagagccgtgggcctnagtgaggtctcngcaggcttcgngatactacctcgaccggactactatactcctagtgggtagcgacgacggcccgaggacgaggcttggagtggagtacgggacgtactaccgaaccgtaacgaccggtgacaacaaacgacgacaacgtaacggtaagttacgaacgggcgtacgggtacctaacgacgtacgaccggaggtacctacggttcctacgacggaccacgacggtaccttacgtagggacggtagacgccgtaggcctaggactacgtccggacgaccggaccggtacggtacccgttagttaaccgtttacgnggtacggacggtaagggaggtaaggtaacggttacggtaggtacgtacgggtaactacggacggttacggttaggttaacggtaaaggtcgggttaacgg

SEQ ID NO: 239158 - DNA, 591 bp, Homo sapiens
  misc_feature: GYAE6OF01DBRRM.4.18.B07.1.454.CMB.1.raw
  modified_base (446)..(446): a, c, t, g, unknown or other
  misc_feature (446)..(446): n is a, c, g, or t
  modified_base (560)..(560): a, c, t, g, unknown or other
  misc_feature (560)..(560): n is a, c, g, or t
  modified_base (568)..(568): a, c, t, g, unknown or other
  misc_feature (568)..(568): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccacctcccgaggtactaggttggtgcagtcgtggggctaggaggtggaaagacgccgtcggggcctcgaggtgaaggtctcctgcgaggtctgtggactacgaccttcgaccgtctactatctccaggtggtcgacgacgcggtcccgtggacgacggtctggagtggagtagggacgataccgaaacctacgacgggtacgacaaacaaacgaccgacaacaagtagttcgaagggcacgggtcacgaacgtcgaccgtacggactaccgtctacgaacncgaacgacgtccgtagtgggcgtgacgcgtagcgttagcatcgagacgcgtaaccgggctagtaactgcggacgagaacggtgaagggtaactatagggccgtagggtacacgngttacggnggttaaacggttgacggttacgg

SEQ ID NO: 239159 - DNA, 605 bp, Homo sapiens
  misc_feature: GYAE6OF01A5THV.4.18.B07.1.454.CMB.1.raw
  modified_base (222)..(222): a, c, t, g, unknown or other
  misc_feature (222)..(222): n is a, c, g, or t
  modified_base (289)..(289): a, c, t, g, unknown or other
  misc_feature (289)..(289): n is a, c, g, or t
  modified_base (534)..(534): a, c, t, g, unknown or other
  misc_feature (534)..(534): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactccccaggtacagttggtgcagtcgtggggctgaggtgaagaagccgtggggcctnagtgaaggtctcctgcaaggcttcgtggataccaccttcgaccggtctaactatactccagtgggtncgacacggccctaggacgaaggtctagagtggagtgggacgacgtaccaaacccgtaacgacccgggtggaccaacgaaaaccaacgacaacgagtaaacggtttcgaacggggacgaacgggtaccaaccgagtacggaccgagggacctaccgtcctacgacgcaacacgtacctaggtacggaggtgacgcgagacgtagagactcgtacgacgacgaccggtccgtacgtagttcgacggngacggagaaggaaggtagtattaggagtaccggaatacgaggtcgttaggttaggtaaaggtgttaacggg

SEQ ID NO: 239160 - DNA, 633 bp, Homo sapiens
  misc_feature: GYAE6OF01DLP7M.4.18.B07.1.454.CMB.1.raw
  modified_base (244)..(244): a, c, t, g, unknown or other
  misc_feature (244)..(244): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcngatacaccttcaccggctactatatccactggtgcgacgacggcccctaggacgaagggccttggacggtggacgttggggacggattaccaaaccccgtaacgaccgggtggacctaaccaaaacgaaacggccaaccggaaagtaacggtttacgaacggggtccaaggggttaccaacccgaattcgggaacccgaagggggaaccaccggttacccgtttacacggaccacgaacgtaccctacgtttggacgggttagaggccgaaggctacggagtatccgtggaaccgacgacggccgttagttactctaggtgcgaggagagggaagtacgttaggaggtaccggataacgtcgtactggttgggtaaagtggttaacggg

SEQ ID NO: 239161 - DNA, 660 bp, Homo sapiens
  misc_feature: GYAE6OF01AZDBZ.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagaagccgtggggcctcagtgaaggtctcctgcaggcttctggatacaccttcaccggtctactatactccacgtgggtgcgacgacggccccgtggacgacgggtcttggaggtggagtgggacggataccaacccgtaacgaccggtacggacaacaaacgaacgacaacgaacgtaacgttcgaacgggtacgacgggtaccaccgagtacgaaccgacgggacctaccgtccttacgacgccaacgacgtacccttaacggttcgggaaggtcgaggcgacggtcgtaggacgtacgtccgtacggaccggaccgtaccgggtccgttagttacgttacgtggtacggacggaaggaagggaacggtaacgtaggttacggtaagggtaccgggtaagtaaccggtacggtacggttaagggtttacggggttaaaggtacgggttaacggg

SEQ ID NO: 239162 - DNA, 724 bp, Homo sapiens
  misc_feature: GYAE6OF01BXWQJ.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctgggaggatcctcttcttggtgcagcacgcctcaggacgcccactcccgaggtacaggttggtgctagtcgtggggctggaggtagaagacgccgtggggcctacgaggtagaacggtcctccgtggacgaaggtcttcgaggtactacctaccttaccgaccggtactactatactccgacggttcgggtcgacggacgtaccggtcccgtaggaacggtacgggtcttaggaggtaggaggtacgggacgactaccgaaaccgtaccggacggtacgaacaaccgaaacgtaacgacgtaagaacgtaacggttacgacggggtaccgacgggtaccaacgtagtaccggaaccggtaacggaccgtaccgttaccgtagacgacccgtaacgtaaccgtaccgttacggttagggacggtacggacgtacgaggtcgtaaggacgtacgtcgtaacggaccgtaccggtaccggttacggttagttacgttacgtcggtaggacggtaggaacgggtaaggtaccggttagtacgggtaacggtcggtaacgtacggtacggttacggttagttaacgggtaaggtaggttaaccgg

SEQ ID NO: 239163 - DNA, 835 bp, Homo sapiens
  misc_feature: GYAE6OF01A4TY6.4.18.B07.1.454.CMB.1.raw
tcagagcactgtagcacgaccggtgctcgatttagtcgctgcgtaagggggagcatcacccagcaaccacatctgtcctctagagaactcccctgagagcctccgttcctcaccatggactggacctggaggatcctcttcgttgggtggcagcacgcctcgaggacgccccacctcccaggtacaggttggtgcagtcgtggggctggaggtagaagacgccgtcggggcctcgagtagacggtcctccgtgaccgaaggtcttcgtaggaacttacccaccgtttaccgaccgggtactaaccttaactaccttacccgacggttggggtcgaccgaaccgaccgggtcccccgtagggaaccggtaacggggtccgtttaggacggttgggaggtacggggaccggtaactaccccgaaaccccgtaaccgacccgggtagaacccaaaccgaaaaccgaacgaccaacgtaacggtaacggtttacgaacggggtaccgaacgggtacccacccgtaagtaccggaacccgtacgggaaccctaccgggttaccctacgacgtaccctaacgaccggtaccgtttaacggtggggtaacgggttacggacgtaccggaacgggttaccgtagggaaccgggtacttacccggtacggaaacccggtaacccggtaacccgggggttacccgtttaagggtttaaccgtttaccggtagggtaccggaacggggtaaggaaacggggtacggggtaaacgttacgggtaggtacggtacggaacttacggacggttcggtaggggtttacggtaagggtacgggttaaccgg

SEQ ID NO: 239164 - DNA, 609 bp, Homo sapiens
  misc_feature: GYAE6OF01BCLEB.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgccccactcccaggtacaggttggtgcagtcgtggggctgaggtgaagaagccgtggggcctcgagtgaaggtcctccgtgacgaaggcttcgtggactaccaccgttcgaccggtctaactatactccagtgggtcgcgacgacggcccgtggacgaagggtcttggagtggagtgggaacgactaccgaaccctacgaccggtgacaacgaaacgacgcaacgagtaacgttcgaggcacggtcacgagcgaaccgaggacctacgtccgtcgacgtacacgtacgaccgttagtagggagtggacgacgagcgtagagatcgaggaccgaacgtcggtaccgttagtacgtacgtggtagacggtaggaggaaggtaacggtagttaggacggtacggtaactacggtagtacggttaggtaagggttaaagtaggttaaccgg

SEQ ID NO: 239165 - DNA, 510 bp, Homo sapiens
  misc_feature: GYAE6OF01E2UV5.4.18.B07.1.454.CMB.1.raw
  modified_base (504)..(504): a, c, t, g, unknown or other
  misc_feature (504)..(504): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacgatcaaccctaacaccggtggcacaaacaacgcacagaagtttcagggcagggtcaccatcgaccagggacacgtccttcacgcacagcctacttgggaggtgagcaggctgagatctagacgacacggccgtgtattacgtgtgcgagaggaggagacttggagtcggatacagctggtgttaagngtacgg

SEQ ID NO: 239166 - DNA, 801 bp, Homo sapiens
  misc_feature: GYAE6OF01DRJUP.4.18.B07.1.454.CMB.1.raw
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacaggttggtgcagtcgtggggctggaggtgaagagccgtggggcctcgagtgagtctcngnaggctcngatcaccttcacgctactatatccgagtggtcgccgacgacggtccccgtagggaaccgaaggggtcgttggaggtgggagtgggacggactaccaaaccccgtacgtaccggttacggactaaaccgaaaaccgaacgaccgaaacgtaagggttaaacgtttaccggaacggggtaccggtaacggggtaccaaccgtaacgttaccgggaaccccggtaaggggaaccccttaacccgggtttacccttacggaaaccgtacccgaaacgtaaccggtacccgttaaacccggttaggggtaacgggtggaacggtaccgaggggttaccgtacgggtaacgtacggtaccggttaccgggaaccggtaaccggtacccggggtccggtttaacgtttaaccggtttaccggtagggttaccgggaacgggtaacgtaaaggggtaacggggtaaacgttaccggttttacgggtaacgggttaaccggtaacgttaaccggtacggttacggtttaaggggttaacgggttaaagggttagggttaaacccggg

SEQ ID NO: 239167 - DNA, 700 bp, Homo sapiens
  misc_feature: GYAE6OF01EDP9Y.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctggaggtgaagaagccgtggggcctcgagtgaaggtcctcctgcgaaggtccttcgtggactacacccttacaccggtctactatactccacgtgggtcgacggacgaccggccccgtggaccgaagggtcttggagtggatggggacgataccgaaccctaacgaccggtgacaacaaacaacgacaacgaagtaacgttacgagggacgacgggtaccacgagtacgaccggacgggacctaccgtaccttacgacgaccgacgacggtacccgttacggtcgggacgggttaaggaccgtacgaggggtacctagggaacgtacgtccggttacggaccgacccgtaaccggggtaccgtttaggttaacccgtttacggtcgtaacggcggaaacggtaagggaacgggttaaaggtaaccggtttagggaacggtacgggtaacgaaaccggttaggtacgttgggttaaaggggttaaggttacgggttaaaccggg

SEQ ID NO: 239168 - DNA, 692 bp, Homo sapiens
  misc_feature: GYAE6OF01E46N6.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagccctcaggacgcccactcccaggtacagttggtgcagtcgtggggctggaggtgaagaagccgtggggcctcgaggtgaaggtcctccgtgacgaaggtcttcgtggatacctaccttccgacccggactactatactccacgtgggtcgccgtaccgacggccccgtggacgaagggtcgttacggaggtaggagtcggggaacggtactacccgaaacccctaacgacccggtaggaccaacaaaaccgaacgaccaacgaacggtaagtttacggacgggtacgacgggtaccaaccgtagtacggaaccgacgggaacctaccggtaccttaccgacgaccaaccgacgtacccttacgttacggggaggttacggaaggtccgagggtactggagtacgtcgtacggaaccgaccggtaccggtaccggtagttacgttcgtaggtcggacggaggacgggaaacggtaagttacgttaagggacggtacggagttacgtaggtacgttaggtagggttaaagacgggttaacgg

SEQ ID NO: 239169 - DNA, 786 bp, Homo sapiens
  misc_feature: GYAE6OF01C2LPN.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatccttcttcttggtggcagcagcctcgaggacgcccacctcccaggtacaggttggtgcagtcgtggggctggaggtgaagacgccgtggggcctcgagtggaggtctctgcaaggtcttcgtggactaccaccttccgaccggtctactatactccgacgtgggtcgccgacgaccggccccgtagggaaccgtaaggggtccgttaggaggttgggaggtaggggaccggtacgtacccgtaaaaccccgtaaccggacccgggtacggaccaaaccgaaaacccgaaaccgacccgaaacggtaacggttaaacgggtttaccggaacgggggaccggtaacgggtacccaaccgtaacgtaccggaacccggaacgggtaaccctacccggtttacccttacgaaccgtaccgtaacccgacgttacccgttacggttacggggaacgggttacgggacggtacggaacgggttaccgttagggaacgttacggttaccgtaccgggaacccgtaccgggtaaccgggtccggtttagtttaccgttacggtcgggtaactacgggaaggtaggtaacggtaacggtacggttaggaacggttacggtactaacggtcgtacgttgggttaaggtagggtaggtaaccggg

SEQ ID NO: 239170 - DNA, 731 bp, Homo sapiens
  misc_feature: GYAE6OF01BGGS6.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacaggttggtgcagtcgtggggctggaggtgaagaagccgtggggcctcgagtgaaggtcctccgtgcgaaggtcttcgtggatacaccttcaccggctactatatcctactgggtcgcgacgacggccccgtggacgaacgggcttggaggtggagtcggggacggactaccaaaccctaacgaccggtggacaaccaaaacaacggaccaacgaagtaacgtttacgaacggggtacgacgggtccaaaccgagtacgaacccggtaacgggtacccgtaaccggttccgttaccgaacgacccaaaccggaacgtaccccgttaacggttacgggtaacgggtcggaacggtcggacgggtccgtaggtaacggtaacgtcgtaaccggacggaacccgtacgggtaccgttaggttaacgttacgtgggtacggaccggtaagggaaagggtacggggtaaacgttacgggttacgggtaagggttaaccgggaagtaaccggtaggtaacggttaggggttaaacggtttaagggtacggttaaaccgggg

SEQ ID NO: 239171 - DNA, 652 bp, Homo sapiens
  misc_feature: GYAE6OF01C91N4.4.18.B07.1.454.CMB.1.raw
  modified_base (246)..(246): a, c, t, g, unknown or other
  misc_feature (246)..(246): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccaggtacagttggtgcagtcgtgggctggaggtgaagagccgtgggcctcgagtgaagtctctgcgaggcttcgngactcaccttcgacgctactatactcacgtggtgcgacgacggtccccgtaggacgtaacggcgttaggaggtggacggtagggacgtacgtacccgtaaaacccgtaaccgacggtacggaccaaaccgaaaaccgaacgaccaacgaagttaacgttcggaacggccgtacggtacaaccgaagtcggaaccggtaggaacctaccgttacccgttacgacggaccaacgtacgtacccgttacggtgggaacggtggaacgcgaagggtctaggagtctcggtacgaccggtaacgtcgggtaccgtacgttacttacggtagttcggacgagtaggaacggtaagtacgttagggacgtacggtaactagacgtcgttaggttaacgggtaagtaggtacgg

SEQ ID NO: 239172 - DNA, 689 bp, Homo sapiens
  misc_feature: GYAE6OF01D04JH.4.18.B07.1.454.CMB.1.raw
tcagagcactgtagcacgaccggtgctcgatttagtcgctgcgtaagggggagcatcacccagctaaccacatctgtaccctctagagaatcccctgagagctccgttcctcaccatggactggacctggagatcctcttcttggtgcagcagccttcgacggacgcccctactacccgaggtactagttggtgctagtcgtggggctggaggtgaagagccgtggggcctcgagtagaaggtcctcgtgcggtaggtcttcgtggtatacgtaccttcgaccggctacttatactaccaacgtggtcgccgactacggtccccgtaggaacgtaacggtctttaggaagttgggatcggggaacgtacgtaccctaacccgtaacgaccggtacgacaactaaaccacgacacgaaggtaacgtttcggaacgggtccgagggtaccaacctagtaaccgacggaacggacgtacccgtcgttacgaccgtcaacgtacgtaccttacggtagggtaggtacgaacggtccgaggacgtcggaaggtctacggtacggaaccgacgggtcccgtacggttgtaacttacggtggtacgacgtacggaggtaacggtaaaccctgggtaacggtacggttacgtattaaccggacgtacgttagggtaacgttaaggaccggttaacgg

SEQ ID NO: 239173 - DNA, 763 bp, Homo sapiens
  misc_feature: GYAE6OF01A4SAL.4.18.B07.1.454.CMB.1.raw
  modified_base (595)..(595): a, c, t, g, unknown or other
  misc_feature (595)..(595): n is a, c, g, or t
tcagagcactgtagcacgaccggtgctcgatttagtcgctgcgtaagggggagcatcacccagcaaccacatctgtcctctagagaatcccctgagagcttcccgttcctccaccatggacgtggacctgggaggactccttctttcgttggtggcagcagcctacgacggacgccctacctcccgaggtacgtaggttggtgcgagtcgtggggctggaggtagaagacgccggtcggggcctcgtagtaggaacgtctccgtgacgacgtcttgagactacccgtaccttccgacccggtcttaactaacttctacccgtacggtcgggtcgaccggaccggacccgggtacccccggttagggacggtaaccgggtcgtttacgggaggtagggtaggtcgggaacgtacctacccgtaaacccgtaaccggccggtagacccaaacgaaaccgacgacgaacgtaggtaacgtcgacggtcgtacgggtaccaacgtcgtacggaccgaacgggtacctaccgttaccgtaccgagtaaccccaccgtaacgtacccgttaggtcgggtaagggacggtacgcggtacggngtacggaatacggttcgaacgaccgtaccgggtccggttacgttacgttaaccgttgttacgggcggaggtaacgggaagtacgggtaagttacggttacggacgggttaacgtacggttacgacggttacgttaaggggttaacggttaggtaacggttaacccggg

SEQ ID NO: 239174 - DNA, 515 bp, Homo sapiens
  misc_feature: GYAE6OF01BSY0P.4.18.B07.1.454.CMB.1.raw
  modified_base (399)..(399): a, c, t, g, unknown or other
  misc_feature (399)..(399): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccaactgggtgcgacaggcccctggacaagggcttgagtggatgggacggatcaaaccctaacaccggtggcaacaaacaacgcacagaagtttcagggcagggtcacatgaccagggacacgtccttnagcacagcctacttcggaggtgagcaggctgagatctgacgacacggccgtgtattactgtgcgagagaggaagacgttgagtcggatacgagactggtggttaaagaggtaacgg

SEQ ID NO: 239175 - DNA, 662 bp, Homo sapiens
  misc_feature: GYAE6OF01EAG6P.4.18.B07.1.454.CMB.1.raw
  modified_base (250)..(250): a, c, t, g, unknown or other
  misc_feature (250)..(250): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctggaggtgaagaagccgtggggcctcagtgaaggtctcctgacaaggcttcgnggactactaccttcaccggtctaactatactacctacgtgggtcgaccgacgacggccccgtagggaaccgaagggtccgttaggacggtggagtgggacggatacctaaacccgtaacgaccggtacggacaaccaaacacgacacgagtaacgtttcgacgggacgaggtccaacgacgtacgaaccgaggaacccgtaccgttcctacgacgtaccacgacgtaccgttacgtgggtaagtggacggtacgaggacgtagagtacgtcgacgaccgacggtaccggtaccgttagttaacgttacgtcggtcggacggtaggaagggtaacggtaacggtacgttagggacgttacggaacgtacgacggttacgttagggttaacgggttaagtacgggttaaaccgg

SEQ ID NO: 239176 - DNA, 577 bp, Homo sapiens
  misc_feature: GYAE6OF01D8ZB0.4.18.B07.1.454.CMB.1.raw
  modified_base (567)..(567): a, c, t, g, unknown or other
  misc_feature (567)..(567): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcgtggatacaccttcaccggctactatactccactgggtgcggacacggcccctaggacgaagggcttggagtggagtgggacgataccaaaccctaacgaccggtcggacaacaaacgacgacaacgaagtaacgtttcgacgggcgacgggtcaccgatcgaaccgagggactacgtccttcgacgcaacgacgtacctacgttgggaggtgacggacgacggctaggagactcgtagaccgacgacggtccgttagttacttacgtgtgacgaggaaggtaggaacgtacgtgacggtgagtacgagtctaggtaggtaagnggttaaccgg

SEQ ID NO: 239177 - DNA, 781 bp, Homo sapiens
  misc_feature: GYAE6OF01C3I2U.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagaagccgtggggcctcgagtgaacggtctacctgacgaaggtcttcgtaggactaaccacctttaccgaccggtccttaacttactactaccgtaacgtcgggtacgacggtaaccgaccgggtccccgtagggaccgtaaaggggtcctttagggaggtagggtaacgtcggggaacgacttaccgaaacccgtacggaccggtggaccaaacaaacgaaccgacaacgaaggtaacgttacgaacggggacgtaacgggtaccaaacccgtagtacggaaccggaacggaccgtaccgttaccttacgacgacctacgacgtaccgtacgttggggaacggttgacggtacgaggtaccgtaggtaacgtacgttcggaacggtaaccgaacccgggttacgggtacccggttaaggttaaccgttttaccggtagggtttacggaaacggggaacgggtaaagggtaaacggggtaaacgtacgggtttaacggtacggggttaacggtaacgggtaacgtaacggttacgggtttaggtaaacggggttaaaggtaacgggttaaaccggg

SEQ ID NO: 239178 - DNA, 765 bp, Homo sapiens
  misc_feature: GYAE6OF01BGNDE.4.18.B07.1.454.CMB.1.raw
tcagagcactgtagcacgaccggtgctcgatttagtcgctgcgtaagggggagcatcacccagcaaccacatctgtccctctagagaatcccctgagagctccgttcctcaccatggactggacctggaggatcctcttcttggtggcagcagcctcgaggacgcccacctcccgaggtacaggttggtgcagtcgtggggctggaggtgaagagccgtgggcctagaggtgaaggtcctccgtgacgaaggtcttcgtaggactacctaccgttccgaccggtacttacgttactactcccgacgtggggtcgccgaaccgacgggtcccccgtaggacgaacgggtccgtttaggaggttagggagttggggaacggtactacccgaaaccccgtaacgaccggtcggaccaacaaaacgaacgaccgaacgaagtaacggtttcgacgggaccgtacgggtaccaccgacgtacgaacccgacgggaacctacccgttccgttaccgaacgtaccaaccgtacgtacccgttacggttacgggtaacggttacggacgacggtacggacgtaggtaacggtacttacggacgtaccggaaccggtaccggtcccggttacggttaaacgtttcgtcggtacggtacggaagggtaacgggtaacgggtaaacggttacggttacggtacgggttaccggtaacgttaacgtacggttacggttaacggggtttaaggtttaaacgggtacgggttaacccgg

SEQ ID NO: 239179 - DNA, 752 bp, Homo sapiens
  misc_feature: GYAE6OF01EV45X.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagccctcgaggacgccccacctcccgaggtactaggttggtgcgaggtcgtggggctggaggtagaagaacggtccgtcggggcctcgtaggtagaacggtcctccgtgacgaaggtcttcgtaggtactacctaccgttcgaccggtactactaatcgtaccgtacgtgggtcacgacgaccggtcccgtaggaacgtagggtcttaggtacggtaggacgtacgggaacggtacttacccgaaacccgtacggaccggtacggaacctaaacgtaaaaccgacgaacgaacgtaacggttaacggttacgacgggtaccgacgggtacacggtacgtacgaaccgacggacctacgtcctacgacgtacaccgtacgtaccgttagacggggtagtacggacgtacggtaggctaaggaccgttactccgggtaacggaacccgtacgggacccgtcggttttaatacgttacggtcggtacggagggtaaacgaaagggtaaagtcccgggttaagtagggtaaccgtacgggtaactacgggttacggtttacgggtaaagggttttaaacggggtaggtaagggtttaaacccggg

SEQ ID NO: 239180 - DNA, 658 bp, Homo sapiens
  misc_feature: GYAE6OF01EM18K.4.18.B07.1.454.CMB.1.raw
  modified_base (157)..(157): a, c, t, g, unknown or other
  misc_feature (157)..(157): n is a, c, g, or t
  modified_base (325)..(325): a, c, t, g, unknown or other
  misc_feature (325)..(325): n is a, c, g, or t
  modified_base (453)..(453): a, c, t, g, unknown or other
  misc_feature (453)..(453): n is a, c, g, or t
  modified_base (517)..(517): a, c, t, g, unknown or other
  misc_feature (517)..(517): n is a, c, g, or t
  modified_base (569)..(569): a, c, t, g, unknown or other
  misc_feature (569)..(569): n is a, c, g, or t
  modified_base (606)..(606): a, c, t, g, unknown or other
  misc_feature (606)..(606): n is a, c, g, or t
  modified_base (618)..(618): a, c, t, g, unknown or other
  misc_feature (618)..(618): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggactcctcttcgttggtgcagcagcctnaggacgcccactcccaggtactagttggtgcgagtcgtggggctggaggtagaagaacgccggtacggggcctagaggtacgtaacggttcctccgtagacgaacggtccttcgtaggacttaccgtacccttcggaccgtacttacgtattactaccgagttcgggngtaccgaccgaccggtaccccgtaggaaccggtaagggtcttaggaggtggaaggtcgggacgacgtaccaaccgacgacggcgaacaacgaaacacgacagaacgtagttcgaaggcgacgtacacngacgacgtacggactaccgtcgtacacgtacacgtacgtacccgtaggtgggacgagagacggnggactacggacgacttcggaccgacgtacgtaccggtccgttatacgttcgnggtacgagggacgaaggtaggacgttaacggttaggngtaaccgggtanaaccggtggtagttagggttaacggtaggtaacgttacgg

SEQ ID NO: 239181 - DNA, 731 bp, Homo sapiens
  misc_feature: GYAE6OF01CU8A7.4.18.B07.1.454.CMB.1.raw
tcagagcactgtagcacgaccggtgctcgatttagtcgctgcgtaagggggagcatcacccagcaaccacatctgtcctctagagaatccccgtgagagctccgttcctcaccatggactggacctggagatcctcttcttggtggcagcagcctcaggagcccactcccaggtacagttggtgcagtctggggctggaggtgaagaagccgtggggcctcgagtgaaggtctcctgcgaaggcttcgtggactaccaccttcgaccggtcttactatactccgacgtgggtcgccgacgacgggccccctagggaccgaaggggtccttaggacggttggagttaggggacggactacccgaaacccgtaacgaccgggtgacaaaccgaaaaccaccggaccaacgaaggtaacgtttcgaacggggcgaacggggtaccaaccgtagtacggaacccgaagggaccctaccggttacccgttacgaacggaccctaacgacggtacccgttacggtttggggaacgggttcggaacggccggaacgggcgtacgggaagtacgtccggtaggaaccgtaccgtaccgggtaccgttagttaactttacgtggtacggacggaaggtagggaaacgggtaacggtaccggtttagggaacgggttacgggtaaacttacgggtacggtacggtttagggttaacggttaaagggtacggttaaaccggg

SEQ ID NO: 239182 - DNA, 581 bp, Homo sapiens
  misc_feature: GYAE6OF01AZZHB.4.18.B07.1.454.CMB.1.raw
  modified_base (290)..(290): a, c, t, g, unknown or other
  misc_feature (290)..(290): n is a, c, g, or t
  modified_base (362)..(362): a, c, t, g, unknown or other
  misc_feature (362)..(362): n is a, c, g, or t
  modified_base (446)..(446): a, c, t, g, unknown or other
  misc_feature (446)..(446): n is a, c, g, or t
  modified_base (480)..(480): a, c, t, g, unknown or other
  misc_feature (480)..(480): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctgggggcctcgagtgaaggtctcctgcaaggcttcgtggatacaccttcgaccggctactatactccactgggtgcgacncggcccctggacgaaggtcttgagtggagtgggacgactaccaaccctaacgaccggtgacaacaaacgacncaacgagtaacgttacgaggcaggtcacagtcgaccgaggcacgtcctgagcacgactctacgtggagtgagcgaggctagagngtcaggacgacggtcggtaccgtagtagttacgnggtcggacgaggaacggtaggtaaacggtagttacgggacgtacgggtaactaacggtacgtacggttagggtttaacgggttaaaggtgggttaaccggg

SEQ ID NO: 239183 - DNA, 621 bp, Homo sapiens
  misc_feature: GYAE6OF01CH5DR.4.18.B07.1.454.CMB.1.raw
  modified_base (255)..(255): a, c, t, g, unknown or other
  misc_feature (255)..(255): n is a, c, g, or t
  modified_base (300)..(300): a, c, t, g, unknown or other
  misc_feature (300)..(300): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccgaggtacaggttggtgcagtcgtaggggctgaggtagaagaagccgtgggcctcgagtgaacggtctcctgcgagggcttcgnggactaccaccttccgaccggtctaactatactccacgtgggtcncggacgaccggtccccgtaggaccgtaaggggccttaggacggtgggagttacggggacgtaacgtacccaaacccgtaaccgaccggtacggacaaccaaaacgaaccgctaaacgaggtaacgttcgacgggcgtaacgggtacacgagtacgaaccgacggacctacgtcctacgagcgaacgcgtcctaggtgggagtagacgcgaggcgtagagacgtgtacgaccgacgccggtcgtagttactacgtcgagacgagaggaggtaacgtagtaggacgtcgaatacgagtcgttaggtaagttaagaagttacgg

SEQ ID NO: 239184 - DNA, 699 bp, Homo sapiens
  misc_feature: GYAE6OF01C6Z21.4.18.B07.1.454.CMB.1.raw
  modified_base (166)..(166): a, c, t, g, unknown or other
  misc_feature (166)..(166): n is a, c, g, or t
  modified_base (320)..(320): a, c, t, g, unknown or other
  misc_feature (320)..(320): n is a, c, g, or t
  modified_base (525)..(525): a, c, t, g, unknown or other
  misc_feature (525)..(525): n is a, c, g, or t
tcagagcactgtagcacgaccggtgctcgattttagtcgctgcgtaagggggagcatcacccagcaaccacatctgtcctctagagaatcccctgagagctccgttcctcaccatggactggacctggagactcctcttcttggtggcagcacgcctacgaggacncccacctcccgaggttacaggtttggtgcaggtcgtggggctggaggtagaagaacgccggtcggggcctcgaggtaggaaggtctcctagcgaaggtcttcgaggtaactacctaccgttaccgaccgtacttaactatactccaggtgggcncgacgaccggtccgtaggacgtaacggtcttaggaggtagggacggtacgggaccgtactacccgaaacccgtacggaccggtcgaccaaacgaaacacgacaacgtaagtacgtacgaggacgaggtacacgtagtacgacgaacggcctacgtcctacgacgcgacgacgtacctaggtacgggaggtcgacgcgaggtacgnggtaacgtacgtcgaacggtaaccggtacccggtcgggtaccgtttaacgttacgttaccgtagggtaccggtaggaacggaagggtaaacgggttaacgtaccgggttaaggacggtaaagtactacggtacggtaggttacggtttaaagggtaacgttagggttaaaccgg

SEQ ID NO: 239185 - DNA, 814 bp, Homo sapiens
  misc_feature: GYAE6OF01AJHLC.4.18.B07.1.454.CMB.1.raw
tcagagcactgtagcacgaccggtgctcgatttagtcgctgcgtaaggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaaagagccgtggggcctcgaggtgaaggtcctccgtgacgaaggtcctttcgtaggaacttacccgtaccctttaccgaccccggtcttaaccttaacttacttccccgacgttcggggttcgccggaacccgaaccggtcccccgtagggaacgaacggggtctttggaaggttagggagttacggggaacgtacgttaacccgaaaccccgtaaacggtacccgggtggaacccgaaaccgaaaaaccgaacgaccaaaccgtaaggttaaacggtttaccggaacggggtaccgaaacggggttacccaaccgaacgtaccggaaacccggtaacgggaacccgtaaccgttccccgttacgacgtacccaccgtaacgtcccgtttaacggtgggtacggtaggacgcgacgggtacgtggaacgtacttaccggacggaaccgtaccggtaccgggtaccggtttagttaaccgtttacgtcggtacgggacggtaacgggaagggtaaacgggtaaacggttacggttacgggtacggttaccgggtaacttacgtaacggttcggttagggttaagggttaaacgggtaaggtttaaacccggg

SEQ ID NO: 239186 - DNA, 787 bp, Homo sapiens
  misc_feature: GYAE6OF01COFJ9.4.18.B07.1.454.CMB.1.raw
  modified_base (164)..(164): a, c, t, g, unknown or other
  misc_feature (164)..(164): n is a, c, g, or t
  modified_base (204)..(204): a, c, t, g, unknown or other
  misc_feature (204)..(204): n is a, c, g, or t
tcagagcactgtagcacgaccggtgctcgatttagtcgctgcgtaagggggagcatcacccagcaaccacatctgtcctctagagaatcccctgagagcctccgttcctcaccatggactggacctggaggatcctcttcttgggtggcagcagcctcaggacncccactcccgagtacagtggtgcagtcgtgggctgaggtnaagacgcgtagggcctgagtgaaggtcctccgtaggtacgaacggtcttaccgtggaaactaccgtacctttccgaccggtaacctaacttacgtaactcccgaacgtcggggtcaccgaacggtaccggtcccctacggaacggtaacgggtccttaggaaggttcggagtacggggaactaactcccgaaaacccgttaaccgacgggttccgaacaaccgaaaacgacgacctaagtaaacggtacgtttaccggaagggtaccgaagggttacccaacgaagtacggaccgaaagggtaccaccgttaccgtacgtacgactaacgtaacgtacccgttaacgttacggggaacggtagtaacgtccggtaacggtcggtaacggtaagtagtttaacccgtacggtaacccgaacggtacccgggttacccgttaagtaacgtttacggacggttaaccgacggtaacgggttaacgaacgggtaaacgttaccgttagggaacccggttaacggtaaggtaacccggtaagttaccggtttagggttaaacgggttaaaagtcgggtttaaacccgg

SEQ ID NO: 239187 - DNA, 637 bp, Homo sapiens
  misc_feature: GYAE6OF01B5XU8.4.18.B07.1.454.CMB.1.raw
  modified_base (255)..(255): a, c, t, g, unknown or other
  misc_feature (255)..(255): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagccctcaggacgcccactcccaggtacaggttggtgcagtcgtggggctgaggtagaagaagcgtcgggcctcgagtagaaggtctccgtgcgaaggtcttcgnggactacctaccttcgacccggtctaactatactcccaggtcgggtcgccgacgaccggccccgtaggaacgagggtcgtaggaggtggagtcggggacgtactaccaaaccgtacgaccggtacgaccaacgaaacacgacacgagtacgttacgaggacgtaggacaccgagtacgaccgacggactaccgtccgtacgacacgacgtacgtacgtacgtgggtacgcgacgcgaggtacgagagtcgtacgtacgaccgaaccggaccggtccggttagtaacgttacgtcggtggtacggaggtaaggaagggtaacgtagttaggtacggtcgtaagacggtagttacggtaaggttacggttaaggtggtaaccgg

SEQ ID NO: 239188 - DNA, 707 bp, Homo sapiens
  misc_feature: GYAE6OF01BK6ZM.4.18.B07.1.454.CMB.1.raw
  modified_base (255)..(255): a, c, t, g, unknown or other
  misc_feature (255)..(255): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagaagccgtgggcctacgagtgaacggtcctccgtgacgaaggccttcgnggaataccaccttcaccggtctaactatactccacgtggcgccgacgacggccccgtggaccgaagggtccttaggacggtgggagtgggaacggatacccgaaacccgtaacgaccgggtacgacaacaaaaccgaacgaccgaacgtaacggtaaacgtttaccggaagggccgtaaacgggtaccaaccgtacgtacggaaccggaagggtacccgtaaccggttcccttaccgaacggtacccgaacgtacgtaccgtttaccggttagggtacgggtacgaacggtacgacggtcgtaacggacgacgtcgtaacggacccgacggtacccgcggttagttaacgttacgtacggcggaggtacggaaggtacggggaaactacggtaggtacggtcggtaacgtaacgtacggtacgttagggtcggttaaagggtggttaaccgg

SEQ ID NO: 239189 - DNA, 675 bp, Homo sapiens
  misc_feature: GYAE6OF01CM1QB.4.18.B07.1.454.CMB.1.raw
  modified_base (257)..(257): a, c, t, g, unknown or other
  misc_feature (257)..(257): n is a, c, g, or t
  modified_base (463)..(463): a, c, t, g, unknown or other
  misc_feature (463)..(463): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcgaggacgcccactcccaggtacagttggtgcagtcgtggggctggaggtagaagagccgtcggggcctcgagtgaaggtcctccgtgcgaaggtcttcgngactaccaccttccaccggtctacgtactactccgacgtgggtcgccgacgaccggcccgtaggaccgaagggtctaggaggtggagtgggaacgactaccgaaacccgtaccgacggtaccgactaaaccgaaacgacacgaacgtagtacgttacggacggcgacggtccaacacgtacgaccgaaggaccgtaccgtccgtanacgaccacgacgtaccgtaggttacggaggtacgagcgacgtcgtagaagtcgtacgtacgaaccggtaccgacgggttacgttagttaccgttacgtacggtgaaccgggaaggtacgggaaacggtaacggtaggttcgggtaaacggtacggtaacgttaacggtacggtacgttaggggtttaacgttaaaggggtcggttaaaccgg

SEQ ID NO: 239190 - DNA, 575 bp, Homo sapiens
  misc_feature: GYAE6OF01AG39O.4.18.B07.1.454.CMB.1.raw
  modified_base (485)..(485): a, c, t, g, unknown or other
  misc_feature (485)..(485): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacacggccctggacaagggcttggagtggagtgggacggataccaaccctaacaccgggttggacaacaaaaccaacgcaacaagaaggtttcaggggcagggtacacatcgaaccagggacacgtcctacacgcacacgcctatggaggtgagcaggcctgacgatccgaggaaccgacgaccggtccgttagtacttacgnggttacgacgaaggaaggaagggtaagtacgttaggtaggttacggaagttacgacggtcgttaggttagggttaaaggaggttaacggg

SEQ ID NO: 239191 - DNA, 614 bp, Homo sapiens
  misc_feature: GYAE6OF01C6QXR.4.18.B07.1.454.CMB.1.raw
  modified_base (311)..(311): a, c, t, g, unknown or other
  misc_feature (311)..(311): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactccccaggtacagttggtgcagtcgtggggctgaggtgaagaagccgtggggcctcgagtgaaggtctcctgacaaggtcttcgtggataccaccttccgaccggcttaactaatactccacgtgggtgccgacgacggccccnggacgaagggtcttggagtggagtagggacgactaccgaaacctaaccgacggtacgacaacaaaccaacgaccaacgagtaacgtttcgagggcgtagggcaccatcgaaccgaggacacgttcctacacgacacagtcctacgttagggaggtagagacgagtcgtagagactcgtagaccgacgtacggtccgttattaacgttcgtgtcggtacgaagagggtaaacggaagtacgtttaggaacgtacgggtaagtaccgtagtacgttagggttaacggttaaaggtgggttaaccg

SEQ ID NO: 239192 - DNA, 763 bp, Homo sapiens
  misc_feature: GYAE6OF01AHPFE.4.18.B07.1.454.CMB.1.raw
  modified_base (751)..(751): a, c, t, g, unknown or other
  misc_feature (751)..(751): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttgggtggcagcagcctcgaggacgccccactcccgaggtacgagttggtgcagtcgtggggcgtgaggtgaagagccgtgggcctcgagtagaggtctcctgcgaggtcttcgtgactaccaccttccgaccgcttactactactccgacgtgggtcgcgacgaccggtcccgtaggacgtaacggtcgttaggaggtggagtacgggaacgactaccgtaaacccgtaacgaccggtcggaacctaaaccaaaaccgtaaccgaccgaacgtaaacggtaacggtttacggaacgggtcggtaaacggggttacccaaccggtaacgtaccgggaaacccgggtaacggggtaaccccgtacccgggttaccccttacggaaccgaccgtaaccggtacggtaccccgtttagggttaacggggaacgggtacgaccgtaacggcgggtacgtaacggagtacgtacgtaccgggaaccggtaacgtacccgggtaccgttagttaacgttccggtaggtaccggacggaggtaagggaacggtaacgttacggtaggtaacggacgttaactacggtacggttacggttaaggttaagggttaaacggnggttaaacccgg

SEQ ID NO: 239193 - DNA, 777 bp, Homo sapiens
  misc_feature: GYAE6OF01B3OP4.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatccctctttcgttggtggcagcagcctcgaggcgcccactcccgaggtactagttggtgcctgtcgtgggctggaggtagaagaacgccgtggggcctacgaggtaggaacggttccttcctgaccgtaaaggtcctttcgtacggtactaacccgttacccgttttaaccggcttaacttaactactccgtacggttgggtacgacgaaccgtccggcccccgtaggaccgtaagggtcctttagggaggttacgggtacgggtacgggtaaccggtacttaacccgaaacccccgtaaaccggacccgggtacggaacccaaaccgaaaacccctaaccggaaccgaacgtaacgtaacggtttaccgacgggaccggtaccgggacctaaaccgacgtacgtaacccggaggggtaacccttacccggtcctacgacgaccgacgacgttacccgtaaggtggtaacggtcggacgcggaacggtccgtaggaacgtaccttggaaccgacccggtaaccggtcccgggtcgtttaattaaccggttgtcggtacggagtaacggaggaagggtacgtgttaggaagtcggaagtaccgagttacggttaggttaaccggtaaggttccggtggttaaccccg

SEQ ID NO: 239194 - DNA, 649 bp, Homo sapiens
  misc_feature: GYAE6OF01AF1DW.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctgaggtagaagagccgtgggcctgagtgacgtctcgtgacgaggtcttcgtaggactaccaccttcgaccggctactatactccacgtgggtcgacgtaccgacggtccccgtaggacgaacgggtcttaggaggtaggagtacgggacgtactacccaacccgtaacgaccgggtcgaccaacaaaccgacgacgacaagtaacgttcgacggacgtaggtaccacagacgaccgacggacctacgtcctacacgtacacgacgtccgttagtgggacgtaggacgcgacggtcgtagtacgtacgtcgtaccgacgaccgtacggtaccgttagttaacgttcgtggttacggacggtaacggaaggtaacgggtaacgttaggttaggtacggtaccggtaacgttaacgtggtacgttagggttaacggttaaggtcggttaacccgg

SEQ ID NO: 239195 - DNA, 899 bp, Homo sapiens
  misc_feature: GYAE6OF01E2HS8.4.18.B07.1.454.CMB.1.raw
  modified_base (187)..(187): a, c, t, g, unknown or other
  misc_feature (187)..(187): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcaggacgccccactcccaggtacagttggtncagtcgtgggctggaggtagaagacgccgtggggccctgagtagtaacggtctccgtgacgtaggtccttacgaggtactaacctacccgttccgacccggtacttacctattactacccgaacggttcggggtacgaccggtaccgtaccgggtcccccgttaggaaccggtaaacggggtcgtttaggagggtcgggtagtacggggaacggtacgtaacccgtaaaccccgtaaccgtacccgggtacgaaccgaaaccgaaaaaccgaaccggaccaacgtaaggttaaacggttttacggaacggggtaccgaacggggtaaccctaacccgtaagttaccggaaccggtaaccgggaacccgttaacccggttaccccgtttacgaaccggtacccgaaaccgtaccggtaaccctttacgggttacggggaacggtttcgggaaccgtaccggtaacggtccgtacggtaacgtaacgtcccggttaacgaacccgggtacccggttaaccgggtcccggtttaaggtttaaccgttaacggttcggtaaccggtacgggtaaacgggtaaagggtaaaccgggtaacgtttaacgggttacgggttaaaccgggtacccgggttaaacgtaaacccgggttacggttaggtttaacgggggttttaacgggttaaaagggttaccgggttttaaaaccccgggg

SEQ ID NO: 239196 - DNA, 618 bp, Homo sapiens
  misc_feature: GYAE6OF01B73N7.4.18.B07.1.454.CMB.1.raw
  modified_base (376)..(376): a, c, t, g, unknown or other
  misc_feature (376)..(376): n is a, c, g, or t
  modified_base (444)..(444): a, c, t, g, unknown or other
  misc_feature (444)..(444): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
  modified_base (584)..(584): a, c, t, g, unknown or other
  misc_feature (584)..(584): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactccgaggtacagttggtgcgagtcgtggggctggaggtagaagaacggccgttggggcctcgaggtcggaacggtctccgtgcgaacggtcttcgtaggactactaccgttcgaccggtactaactatatccacgtcggtgcgacgacggcccgtaggacgaggtctggagtaggagtacggacgtactacgaaccgtaacgaccggngacaaacgaaacgaacgcaacgagtaacgttacgacgggacacgggacacgagtcgaaccgaggaccncgttccgtacgactaccgaacgacgtaccttacggtaggacggtagacgacgnggtanaggagtgtacgtacgacgacgacggtacgttacgtacttcgaggtacgaggagtaacggagaagtagtacggtagacggtanacgtacacggttaggtaggtaaaggtggttaacg

SEQ ID NO: 239197 - DNA, 697 bp, Homo sapiens
  misc_feature: GYAE6OF01DG8TX.4.18.B07.1.454.CMB.1.raw
  modified_base (254)..(254): a, c, t, g, unknown or other
  misc_feature (254)..(254): n is a, c, g, or t
  modified_base (404)..(404): a, c, t, g, unknown or other
  misc_feature (404)..(404): n is a, c, g, or t
  modified_base (511)..(511): a, c, t, g, unknown or other
  misc_feature (511)..(511): n is a, c, g, or t
tcagagcactgtagcacgaccggtgctcgatttagtcgctgcgtaagggggagcatcacccagcaaccacatctgtcctctagagaactcccctgagagctccgttcctcaccagtggactggactggagatccttcttcttggtgcagcagcctcgaggacgcccactcccaggtactagttggtgcaggtgtcgggctggaggtagaacggaacgccggtggggtcctcgaggtaggtaacggtccttccgngacgacggtcttcgaggtactacctaccgttaccgaccggtacttaacttatactccgtacggtggtcgaccgacgaccggacccgtagggaacgtaggtcgtaggacggtaggagtacgggacggtactaacccaaccgtacgacggtnaaccaacaaacgacgtacaacgtaagtacgttacggacggcgtacggacaacgtacgacgacgtaacggactccggtctacaacgcacgacgtactagtaggaggtnagacgaggctagagtactacgtacggaccggacgtacggtaccgttaagttaccgttcggtacggtcggtaacggagggtaacggtaacggtaaacggttaccggttagggtaaccggtaaacgggtaccctaaacgcgggtttaacgtttaagggttaaacgggttaagggtacggttaaccggg

SEQ ID NO: 239198 - DNA, 836 bp, Homo sapiens
  misc_feature: GYAE6OF01A1WW0.4.18.B07.1.454.CMB.1.raw
  modified_base (826)..(826): a, c, t, g, unknown or other
  misc_feature (826)..(826): n is a, c, g, or t
tcagagcactgtagcacgaccggtgctcgatttagtcgctgcgtaagggggagcgatcacccagcaaccacatctgtcctctagagaactcccctgagacgctccgttcctcaccatggactggacctggaggactcctcttcttggtggcagcagcctcgacggagccccactcccaggtacctaggttggtgcagttccgtgggggctggagggtcgaaacgaacgtccgtcggggccctacgaaggttcggaaacggttcctaccgtaggtaccgttaaagggtcctttacgtacgggaacttaacccgtacccgttttaccgaaccccggggttacttaacccgtttaacggttaaccttaccccgtaacggttcggggggttacggtaccccggaacccggaaccggggtacccccccggttaggggtaacccgtaaaacggggggttcccttttagggaaccggtttcgggtaacggtttacggggggtaaccggtaacgttacccgtaaaccccgttaaccggacccgggttcggacccaaacgaaaacccacgtaccaacgtaacggtaacgtttccggaaggggtccaacggggtacccaaccgtacgttacggaacccgtacgggtacctaaccggtaccttacgacgtaccacgaccgtccgttacgtgggaggttcgagtacgaggctagacgttatcgtacggaccgtacgaccgggttaccgttagttacgttacgcggttaggaccgaggacggaaggtaacgtacgtaggtacgtacggtacacgtacgtacgtaggttacggttaacgnggttaaccgg

SEQ ID NO: 239199 - DNA, 728 bp, Homo sapiens
  misc_feature: GYAE6OF01BOM49.4.18.B07.1.454.CMB.1.raw
  modified_base (155)..(155): a, c, t, g, unknown or other
  misc_feature (155)..(155): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtgcagcagcctnaggagcccactcccaggtacagttggtgcagtctggggctggaggtcgaagaagccgtggggcctcgagtagaaggtcctcctgcaaggcttcgtggactaccaccgttcgaccggtctaacctagtactccgacgtgggtgccgacgaccggccccttgggaacaagggtcttggacggttgggagtcgggtacggactaccgaaaccccgttaacggaccggttaggaccaacgaaaaccaacggtaccaacgtaaggtaacggtttcgaacgggtacgtaacgggtaccaccgtagtacgaaccgtagggaccacggttcccttacgacgtacaacctacggtacccgttaacggttgggaacggtcggaaccgacggtacggtaccgtaaggtacgtaacgttcggaacggtaaccggacccggtaccggggtaccgtttacggtaacgtttaccgtcggtacggacgggtagaagggtacggtaaacggttacgttacgggaaggtaccgggtaagtaaccggacgttaccggttagggttaacgggttaaaggtggggttaaaccgg

SEQ ID NO: 239200 - DNA, 682 bp, Homo sapiens
  misc_feature: GYAE6OF01CSQ0F.4.18.B07.1.454.CMB.1.raw
  modified_base (181)..(181): a, c, t, g, unknown or other
  misc_feature (181)..(181): n is a, c, g, or t
tcagagcactgtagcacgaccggtgctcgatttagtcgctgcgtaagggggagcatcacccagcaaccacatctgtcctctagagaatcccctgagagcctccgttcctcaccatggactggacctggaggatcctcttcttggtggcagcagccctcaggacgccccactcccaggtacngttggtgcagtcgtggggctggaggtgaagaagccgtggggcctcgagtggaacggtctcctgacgaaggtcttcgaggtactacctaccttccgaccggtctactatactccgtacgttcgggcgacgacgacggccccgtaggaccgagggtcttggagtggagtcgggaacgactaccgaaacccgtacgaccggtacgacgaaaccaaacgaacgaccaagaacgttaagtcgagggacgacgggaccacacgtacgacgacggaacgtaccgttactacgacgacacgacgtaccgtaggtacgggtaggtacggagtcgaggacgtagagtacgtcgacggaccgtaccggtacgggttccttagttaaccgttacggttaggtcggaacgggtaggtaacggaacgggtaacggttacgttgggaaacgggtacggtaacgttacgtacgggttaccgttaggggtttaacggtaaaggttacgggttaaacgg

SEQ ID NO: 239201 - DNA, 768 bp, Homo sapiens
  misc_feature: GYAE6OF01CK9K8.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcgaggacgccccactcccgaggtacaggttggtcgctagtcgtggggctggaggtagaagacgtccggtgggcctacgaggtggtaagtccgtccgtgacgacggtcttcgtagtacgtacctaccgttaccgaccgtactactactactccgtacgtcgggtcgcgaccgtaccggccccgtaggaacgaacgggtcgttaggaggtaggtaggtacgggtaacggacctaccgaaacccgtaaccgtaccgggtacgaaccgaaaccgaaacgaccggacaacgtaaggtacgttacggacgggtacgacggtacacgtagtacgaccgacggacctacgtcctacgacgtccgacgtacgtaccgtagttcgggacgggtagacggacgtacggacgtaggaacgtacgtacgtacgggaaccggtaacccgtaccggggttaccggttagttaaccggttaccgtgggtaccggtaacgggtacggtaaagggtaaaccggggtaaagttaccgggttaacgggttacggggtaacggtaaccgttaacggtacgggttaacggttacggggtttaaagggttaacgggtaacgggtttaaacccggg

SEQ ID NO: 239202 - DNA, 815 bp, Homo sapiens
  misc_feature: GYAE6OF01CVZ17.4.18.B07.1.454.CMB.1.raw
  modified_base (164)..(164): a, c, t, g, unknown or other
  misc_feature (164)..(164): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggactcctcttcttggtggcagcagcctcgaggacncccactcccaggtacaggttggtgcagtcgtgggctggaggtgaagagccgtgggcctcgagtgaacggtctccgtgacgaaggtcttcgtaggtaactacctaccttccgaccggtacttactaactactccgacgtgggtcgaccgacgccgggccccgtaggaaccgaacgggtctacgggtagggtaggtaggtacggggacggtactacccgaaaccgttaaccggacgggtacggaaccaaacgaaaaccgaaccggaaccaacgtaaagttaacggtttaccgggaacgggtaccggtaacgggtaaccaacgtaacgtacggaaccggaacggtaaccgtaccgttaccgttacgacgtacccgaacgtacgtacccgttacggttacggggacggttacggacggtacgtacggtacgtacggtaaggtacgttaaccggtaaccggtaaacccggaaccggtacccggggttaccgtttaacggtttaaccggtttacggtacgggtaaccgggtacgggaaaccgggtaaagggtaaaggtaaaccggttaggttaacgggttacgggtaacccggttaaggttaacgtacgggttacggttagggtttaaacgggtaaagggttacgggttaaacccgg

SEQ ID NO: 239203 - DNA, 822 bp, Homo sapiens
  misc_feature: GYAE6OF01BL7BC.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggagactcctcttcgttggtggcagcagcctcgaggacgcccacgtcccaggtacaggttggtcgcaggtcgtggggctaggaggtagaagaacgtccggtcggggcctacgaggttggaacggtcctccgtgacgtaaggtccttacgtacggaacttaccacctttccgaaccggtccttaacgtactactacccgacgtggggtacgaccgaccgaccggccccgtagggaaccggacgggtccgttagggacggtgggacggtacggggtaccggtaactacccgtaaacccgtaaccggacccgggtacggaacaaacccgaaaacgaaccggtaccgaaacgtaacggtaacgttttaccggaggggtaaccggtacgggtacccaaccggtagtaccggaaaccggacggggtaaccctaacccggttccttaaccgacggtaacccaacggtacgtaccccgttaaggttacggggacggttagggaacgtccggacgggagttacggaacggtacttccggaacgtaaccggaccgtaccgggtcgttaacgttacgttacggtacggtacggtaacggacgggtaaacggtagggtaaaccggttagttaacgggcgggtaaacggtacgttaacggtacggtacggttaggggttaaacgggttaaggtaacgggttaacccgggg

SEQ ID NO: 239204 - DNA, 782 bp, Homo sapiens
  misc_feature: GYAE6OF01BJIQX.4.18.B07.1.454.CMB.1.raw
  modified_base (612)..(612): a, c, t, g, unknown or other
  misc_feature (612)..(612): n is a, c, g, or t
  modified_base (622)..(622): a, c, t, g, unknown or other
  misc_feature (622)..(622): n is a, c, g, or t
tcagagcactgtagcacgaccggtgctcgatttagtcgctgcgtaagggggagcatcacccagcaaccacatctgtcctctagagaatcccctgagagcctccgttcctccaccagtggactggaccgtgggaggatcctctttcgttgggtggcagcagcctcgaggacgcccacctcccgaggtacaggttggtgcgaggtcgtggggctggagggtaggaagacggccggtcggggcctgaggtaggaacggtcctcgtggacgtaagggtccttaggtaggactacctaccgttaccgaccggtactacttactacgtacccgtacggtgggtcgaccgaccgtaccggcccgtacgggaccgtaacggggtcgtacgggtacggtagggtacggtacggggaacggtaaccgtacccgtaaacccgtaaccggtacccgggtacggaacgaaaccgaaaccggaacgtaaccgaacgtaacggttaacgttaacggacgggtaacgtacggggtaccacgtacgtacgacggaaggtacctaccgtccgtacgacgaccacgtacgaccgtacggtagggtacgggtaggacgtcggacggtacggngtaaccggtntaccgggtaccgacggacccggtacgggtccgttacgttagttacgtggtacgggacggtagggaagggtacggtaaacggtacggttacgggacgggttaccgtaagtacccgggtagttacgggtaacgggtttaggacgggttacggttaaccgggg

SEQ ID NO: 239205 - DNA, 682 bp, Homo sapiens
  misc_feature: GYAE6OF01B8W4C.4.18.B07.1.454.CMB.1.raw
  modified_base (249)..(249): a, c, t, g, unknown or other
  misc_feature (249)..(249): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagaagccgtggggcctcgagtgaaggtctcctgcgaaggcttcgnggactaccaccttcacccggactaacctatactaccacgtgggtcgcgacgacggcccgtggaccgaagggtctggagtgggacgtgggacggactaccgaaacccgtaaccgaccgggtagaccaacgaaaaccgaaccgacgaactaaggtaaacgttcgaaggggaccagggtaccaaccgagtacggaaccgaacgggacctaccgtccttacgacgccaacgtacgaccgttacgtagggacggttacggacgcgaacggtcgtagacgactcgaacggaccgaccggtacggtccgttagttacgttacgtcggtcgacgggaaggaggtaacgggaacggttaacgttacgggaagggttacccggtaagtaaacggtacggttacggttagggttaacgggttaagggtagggttaaacccgggg

SEQ ID NO: 239206 - DNA, 761 bp, Homo sapiens
  misc_feature: GYAE6OF01BSYFN.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcgagtgaaggtctcctgcgaaggtcttcgtggactacaccctttcgaccggccttacgtaactactccctaacgtggggtcgaccgacgtaccggcccccgtagggaaccgaaacggggtcttagggaggtgggaacgttacggggaacggtaactacccgtaaaaccccgttaaccgacccgggttacggaacctaaaccgaaaaacccgaaccggtacccgaaacgtaacgggtaaacgtttcggaacggggaccgtaacggggtaccgaacccgtagtacggaacccggaacggggtaacctacccggttaccttaccgacgtaccaaccgtacgtacccgttacggttacgggagggttcgaggtaccggaggtaccgtagaacgtacgtaccgtaggaaccggaccgtacgggtcccgtttaagtacgttacgtggtacgacggtaggaacggtaacgggtaacgtcgttaggaccggttacgggtaacctaacggtacggtacgttagggttacggttaaacggtgggttaaccgg

SEQ ID NO: 239207 - DNA, 691 bp, Homo sapiens
  misc_feature: GYAE6OF01AWVLL.4.18.B07.1.454.CMB.1.raw
  modified_base (269)..(269): a, c, t, g, unknown or other
  misc_feature (269)..(269): n is a, c, g, or t
  modified_base (623)..(623): a, c, t, g, unknown or other
  misc_feature (623)..(623): n is a, c, g, or t
tcagagcactgtagcacgaccggtgctcgatttagtcgctgcgtaagggggagcatcacccagcaaccacatctgtcctctagagaatcccctgagagctccgttcctccaccatggactggacctggaggatcctcttcgttggtggcagcacgcctacgaggacgcccaccgtccccgaaggtacaggtttcggtgcgagtcgtggggctggagggtagaagagccgtgggcctcgagtgaaggtctccgtgacgaggtccttacgnggactacctaccgttccgaaccggtcttaacgtattaccgtcctacgtgggtcgaccggaccgaccggtcccgtaggaaccgaacggggtccttaggacggttggaggtacgggaacggtactaccgaaaccctaaccggaccggtgaaccaacgaaaccgtacgaccgaacgtaacgtacgttacgaacggggaccgtcggtaaccgacgtacgtacggaaccggacggaaccgtcccgttaactcgacgaaccgtccgacgtacccgtttaggacgggttaagcggacgtacggacggtactaggaacgtacgttcgacggtaccgacgtacggttcgttagtcgtttacgnggtacggagaggaggacgtaacgtggtacggagtacgtagagtacgtgttaggtaggtagtcggtacg

SEQ ID NO: 239208 - DNA, 676 bp, Homo sapiens
  misc_feature: GYAE6OF01BLIIR.4.18.B07.1.454.CMB.1.raw
  modified_base (187)..(187): a, c, t, g, unknown or other
  misc_feature (187)..(187): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactccccaggtacagttggtnccagtcgtgggctgaggtgaagagccgtgggcctcaggtgaacggtcctctgacgaaggcttcgtaggactacaccgttcaccggtctactatactccgacgtcgggtgccgacgacggaccccgtggaaccgaaggtccttaggacggtaggacgtcggggacgtacgtaccaaaccccgtaacgacgggtacgacaaacgaaacacgaccaagtaacgtaacgttcgagggactagggacctacgacgagaaccgaggaacctccgttaccgtactacgactacgacgtaccttacggtggaacgtggacgtacgacggacttacggagtacgcgtgaccggacgtccggaccgttaggttaacttacgtgggtagtcggtaagaacgggtaaagggtactacggttacgggtacggtacgggtaaacgttacggtaacggttacgttagggggttaacggttttaaagggaccggtttaaaccggg

SEQ ID NO: 239209 - DNA, 712 bp, Homo sapiens
  misc_feature: GYAE6OF01C4EVI.4.18.B07.1.454.CMB.1.raw
  modified_base (163)..(163): a, c, t, g, unknown or other
  misc_feature (163)..(163): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacncccactcccgaggtacaggttggtcgcagtcgtggggactggaggtagaagacgccgtcggggcctacgaggtgtaacggtcctccgtgacgaacggtcgttcgtaggaatacctaccgtttccgaaccggtctaacttactactaccgtacggttcggtcgccgaaccgaccgggtccccgttagggacggtaacgggtcttaggacggtacggtaacgttaggggaccgtaacgttacccgaaaccgtaacggaccgggtacggaaccgaaacgaaaccgaacgaccgaaacgtaacggtaacggttacgaacggggtactacgggtacaaccgtaggacgaaccggacggtaccctacgttacccgttacgaccgactaacgacgtaccttacggttagggacggtgacgtacgcggtacgtacgacgacgttcgacggacgtacgtcggtacgttagttaccgtagtaccggtgacgaggtacggaaggaacgtacgtaggacggtaccgtagaccgagttacgtaggttaggtaaggtgtaacg

SEQ ID NO: 239210 - DNA, 820 bp, Homo sapiens
  misc_feature: GYAE6OF01B629N.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctggagggtgaaagaacggtcccggtcgggtccgtacgaggtaggtaacgttcctccgtcgacgacgtcttcgagtactacctccttaccgaccgtactaacttatacctaccgtacggttgggtaccgaccgaaccggacccggtacccgtacgggaacggtacgggttcgtaggtagggtcggagggtacgggaacgtactaaccccgtaaacccgtaaccggacgggtacggaaccaaaaccgaaacgaaccgacaacgtaacgttaacgtacggacgggacgtacggaccaacgtacgaccgaacggtacggacctaccggtctacgacactaaccgtacgttaaccgttagggtacggggtaagcggaccggtacggacggtacttagggaactaccggttcggaaaccgggaacccgtaaccgggtaccggggttcccgttttaacttaacgggtttaggacgggttcggaaacgggtaaaaggggaaacgggtaaacgggttaaacggttacgggtttaaggggaaaccgggggttaccttaaacgggaacgggttcggtttaaggggtttaaggggttaaaccgggtttaaaagggggtcgggttttaaaacccgg

SEQ ID NO: 239211 - DNA, 821 bp, Homo sapiens
  misc_feature: GYAE6OF01BQR07.4.18.B07.1.454.CMB.1.raw
tcagagcactgtagcacgaccggtgctcgatttagtcgctgcgtaagggggagcatcacccagcaaccacatctgtcctctagagaatcccctgagacgctccgttcctcaccatcggactggacctggacggactcctcttcttggtggcagcacgccgtcaggacgcccactcccgaggtacaggttggtcgcgagtcgtggggctggaggtagaaggaacgccgtggggcctcgaggtgaacggttcctccgtgcgaacggtcttcgtggtactaccgtaccgttccgaccgtctactatacgtccgtacgtcggtcgaccgacgaccggtcccgtaggaacggtacgggtcgtaggtacggtaggtacggtacgggacgtacgtacccgaaacccgtaccggaccgggtacgaaccgaaaccgaaacgaccgaccgaacgtaacggttaacggttacggacggggtacgtacgggtaccgaaccgtaacgtaccggaacccggtaacgggtaaccgttaccggtttaccgttaccggaacgacccgtaaccgtaccggttacccgttaaccgggttacgggtacgggttacggacgggaccggtacgggtacgtacggaacggttacgtaccgtaccgggtaaccggtaccggtaaccgggttaccgtttacggttaacgtttaccgtgggttaccggacgggtaacgggtaacgggtaacggggtaacggttacggttaacgggtaccggttacggtaacgttaacggtacggttaccggttaagggttaacgggttaaggtaccgggttaacggg

SEQ ID NO: 239212 - DNA, 672 bp, Homo sapiens
  misc_feature: GYAE6OF01DIZCI.4.18.B07.1.454.CMB.1.raw
  modified_base (346)..(346): a, c, t, g, unknown or other
  misc_feature (346)..(346): n is a, c, g, or t
tcagagcactgtagcacgaccggtgctcgatttagtcgctgcgtaagggggagcatcacccagcaaccacatctgtcctctagagaatcccctgagagctccgttcctcaccagtggactggacctgggaggattcctctttcgttgggtggcagcagcctcgagggacgccccactccccgaggtacaggttggtgcgagtcgtggggctggaggtagaagagccgtaggggcctcgagtgaacggtctccgtgcgaaggtcttcgtggactaccgtctccgaccgtctactatactccgtacgtgggcgacgacgaccggtcccgtaggacgtaggtcgttggnggtggaggtcgggaagtactaccgaaccgtacgacggtcgaacaacgaaaccacgacgaacgtaacggtacggttcggaacgggacgtcgggaacctacgtagacggaccgacggaaccttccggtaccgtacgaagccgaacgtacccgtacttagggtaacgggtggtacgacgtacgagggtcgaggaacgtcgtacgacggtaccgaccggtcggtaacgttgttaacgtgtacgcgggtagacggttaggaacggtgtaacggttggacggttacggtaactacggtacggtacggtttaggaagggttgaccgttaacgg

SEQ ID NO: 239213 - DNA, 758 bp, Homo sapiens
  misc_feature: GYAE6OF01AN5E7.4.18.B07.1.454.CMB.1.raw
  modified_base (745)..(745): a, c, t, g, unknown or other
  misc_feature (745)..(745): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctaggggcctcagtgaaggtctccgtgcgaaggtcttctggactacaccttcgacccggtctacttaatactccgacgtgggtcgcgaccaacggtccccctaggaaccaaggggctttaggacggttcgggaagttcggggaacggtactaccgtaaaccccgtaacgtacccgggttggaccaaccgtaaaaccgaccggaccgaacaacggtaaacgttttcgaacggggtaccgtaacggggttaccctaacccgaagtccggtaaaccccgaaggggtaaccaacccggttcccttacgaacgacccaaccgacgtacccttaaccgtttggggaacgggtttacgaacggtcggtaacgggtcgttaacgaggtaacgtttccgaacgggttaacccggaaccgtacccgggaccggtttaacgttaagtttaaccgtcggttcggacgtaggaaacggtagggtaacgtaccggttaggaccggttcggtaaacgttacgaccggtacgttagttacgggttaaagggnggttaaaccgggg

SEQ ID NO: 239214 - DNA, 750 bp, Homo sapiens
  misc_feature: GYAE6OF01A1NDH.4.18.B07.1.454.CMB.1.raw
  modified_base (301)..(301): a, c, t, g, unknown or other
  misc_feature (301)..(301): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccgaggtaccaggttggtgcagtcgtggggctgaggtgaagagccgtggggcctcgagtgaggtctccgtgcgaggtcttgtcggactacctaccttcgacccggtctacgtatactccgtacgtgggtcnccgaccgaccggccccgtacggaccgaaggggtcgttggtaggtggacggtggggaacgactaccaaaccgtacgaccggtcggacaaccaaacgaacgcaacgaagtacgttacggacgggacgacgggtaccaaaccgtcgtacggaacccggtaacgggtaccctaaccggttaccgttacggaaccgtacccgaaaccgtaacggtaccccgttaacggttacggggtaacgggtagggtaccgtaaccggaccgggtacgtaacgggaccggtaggtcccgttaacgggacccggtaaccgggtaacccgggtccggtttaacgttaccggttacgtcgggttacggacgggtaaggaaacgggtaacgggtaacggttaggtagggtacggtacggaagtccggtaaggttacgttagggtaaggttaaaggtcggtaacggg

SEQ ID NO: 239215 - DNA, 751 bp, Homo sapiens
  misc_feature: GYAE6OF01C0E1U.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgccccacctcccgaggtacagttggtgcagtcgtgggctgaggtgaagacgccgtggggcctcgagtcggaaggtcctcgtcgacgaaggtcctttcgaggtaacttaccaccttcccgacggtccttaacgttactaactccacggttgggcgaccggacgaccggtccccgtagggaaccgtacggggtcttacgggaggttacgggaggtacggggaaccggtataccccgaaacccgttaaccggaccgggtcgaaccaaaccgaaaacgacgaccgagaacgttaacggttaccggacggggccgtaacgggtaccaacgtacgtacggaaccgacggtaaccgtaccgtaccgttacgaacgtaccaaccgtacggtaacccttagggttacgggtacggtacggtaacgacgtacgggtacgttaggaacgtactacggtaccggaaccggtaccgacgggttccgttacggttaacttcggttaggacgggtacggacggaaggtaacggtaacggttacgtaggtaacggacggttaagacgtacggtagttaggtttaacggaacggtgggttaaaccg

SEQ ID NO: 239216 - DNA, 722 bp, Homo sapiens
  misc_feature: GYAE6OF01D6G2F.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggactccttctttcgttgggtggcagcagccctcgaggacgccccactccccgaaggtactaggttggtgcagtcgtggggctggaggtagaagacgccgtggggcctgagtagaagtcctcctggacgtaacggtcttacgtaggaactaccgtaccttaccgaccgtacttaacgttactactaccgtacgtggggtactaccggaaccgaccggtccccggtagggaaccgtacggggtccgttagggtacgggtaggacggttacgggaaaccggtaccgtaacccgtaaaaccccgtaaccggtacccggtacggaaccaaccgaaaaccgtaacgacgaacgtaaaggtaacgttacggaacgggtaccgaggtaccacgacgtacgaccgaaggtacctacgttacctcgaacgtcacgtacgtactacggtagggtacggtcgagcgaggtgtacgaagttgtacgtacggaacgtaccggacggtacgttagtaacgtagaggttcggacgaaggaaggaacggtaacgtagttaggacggttacgaacgtacggtcgttacgtaggtaacgttagacgggtacg

SEQ ID NO: 239217 - DNA, 723 bp, Homo sapiens
  misc_feature: GYAE6OF01B51W5.4.18.B07.1.454.CMB.1.raw
tcagagcactgtagcacgaccggtgctcgatttagtcgctgcgtaaggggggagcatcacccagcaaccacatctgtcctctagagaactcccctgagagctccgttcctcaccatggactggacctggaggatcctcttcgttggtggcagcacgcctcgaggacgccccactcccgaggtactaggttggtgcacgtcgtggggctggaggtagaagacgccgtggggcctcgagtgacggtcctccgtgacgacggtcttcgtaggactacctaccttccgacccggtacctaacttactactccgtacggtgggtcgaccgaccgaccggtccccgtagggaccgtacgggtcgttaggaggtagggacggtacggggaacgtacctaacccgaaaccccgtaacgacccgggtacgaccaaaccgaaacgaccgacaacgtaacgttaacggttacggacgggacgtacgggtaccaacgtacgtacggaaccgacggacctaccggttcctacgacgaccaacgtccgtaccgttaggtagggaggttacggacgtacggtacggacgtaggacgtacgtcgacggtaaccgaccggtccggttacggttacgttaacgttcggtaggcggaggaggtaagggaaggtaacgttaggtacggtacggtaggtaactacggtacggtagttaaggttacggttagggtacggttacgg

SEQ ID NO: 239218 - DNA, 667 bp, Homo sapiens
  misc_feature: GYAE6OF01CHAAC.4.18.B07.1.454.CMB.1.raw
  modified_base (243)..(243): a, c, t, g, unknown or other
  misc_feature (243)..(243): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtctggggctggaggtagaagagccgtgggcctgagtgaggtctctgcagcttcgnggataccaccttcaccggctactatactccacgtgggtcgacgaccgacggtcccctaggaccgaagggtccttggaggtggagtcggggacgactaccgaaaccccgtacgaccggtcggacaacgaaaacgaacgaccaacgaacgtaacggtttcgaggggacgacgggtaccaaccgagtacgaaccggaacgggtacctaccggttccttacgacgaccgaaccgaccgtaccgttaggtcgggaagggttacgacgacgtagggcttaggaagtactcgtacggacccggaacgtaccgggtcgttagttacgtacgtggtaggacgtaaggacggtaacgaaggttacgttagggaacggttccggaaattacggacggttacgttaagggttaaggttaaaggtcggttaaccggg

SEQ ID NO: 239219 - DNA, 775 bp, Homo sapiens
  misc_feature: GYAE6OF01DTJJE.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctgggaggatcctcttcttgggtggcagcagcctcgaggacgcccactcccgaggtacagttggtgcagtcgtggggctggaggtgaagaagccgtggggcctcgagtgaacggtcctccgtgacaacggtcttcgtggtaactacctaccttaccgacccggtaccttactaactactaccgtacgtgggtacgccgaccgaccggtccccgtagggacggaacgggtcgtaggacggtgggtagtacggggacggtacgtacccgaaacccgtaaccggacggtacgaccaacaaaccgaaccgacaacgtaaggtaacgttccggaacgggaccgtaacgggtacccgaaccgtaacgtaccgggtaaccggaacgggtaacccgtacccggtttaccgttacgaaccggtacccgtaaccgtaacggttaccctacgggtttacggggtagggtacggtacggacgtacggtcgtagaacgtacgtcgtacggaacggtaccggtacggtaccgttagttaacggttcgtagggttaccggacgggtacggaagggtaacgggtacgttacggttaacgggaacggttacggtaacgtacggtacggtacggttagggtttaagggtaacgggttagggttaacccgg

SEQ ID NO: 239220 - DNA, 987 bp, Homo sapiens
  misc_feature: GYAE6OF01A2GBD.4.18.B07.1.454.CMB.1.raw
tcagagcactgtagcacgaccggtgctcgatttagtcgctgcgtaaggggagcatcacccagcaaccacatctgtcctctagagaatcccctgagagctccgttcctcaccatggactggacctggaggatcctcttcgttggtggcagcagcctcacggagcccactcccgaggtacagttggtgcagtcgtggggctgacggtgaagaagtccgtggggcccttagacgttggaacggtcctccgttggacctaaggggtcctttaccgtagggtaagttaaccgtacccgtttaccgtaacccgggtaccttaacgttaacttaacgttcccgtaaccgttggggttcggaccgtaacccgtaaccggggccccccgttaagggtaacccgtaaaacgggggtccgtttacggggtaacggttaggggtaaccggttgggggtaaccggggtaagttaccccgtaaaacccccgtttaaaccggtaacccgggttcgggaaccgtaacccggaaaaaaccgtaaacccggtaccgtaaaccgaacggttaaaccggttttacgaaacccggggggtcgtaaacggggggtttaaccccaaccgttaacggtaaccggaacccgtaaacggggtaacccgttaacggttacccccgtttacgaaacgggtaccccgtaaccgtaaccggtaccccgtttaccgtttaccggggtaacgggtttaccggaacggtaaccggtacgggttacgttaccggaaggttaccgttaccgtaacgggtaacccggaaccggtacccggggttaccgtttaacgggttaacgtttaacccggttcggttaacgggtaccggtaaacgggtaacgaacgggggttaaaccgtacggtttaagggaaccggggttacccggttaaacggttaaccgtaacgggttacggttacgggttttaaacgggtaaaggggttacgggttaaacccgggg

SEQ ID NO: 239221 - DNA, 684 bp, Homo sapiens
  misc_feature: GYAE6OF01DBE68.4.18.B07.1.454.CMB.1.raw
  modified_base (326)..(326): a, c, t, g, unknown or other
  misc_feature (326)..(326): n is a, c, g, or t
  modified_base (544)..(544): a, c, t, g, unknown or other
  misc_feature (544)..(544): n is a, c, g, or t
  modified_base (674)..(674): a, c, t, g, unknown or other
  misc_feature (674)..(674): n is a, c, g, or t
tcagagcactgtagcacgaccggtgctcgatttagtcgctgcgtaagggggagcatcacccagcaaccacatctgtcctctagagaatcccctgagagcctccgttcctcaccatggactggacctggaggatcctcttcttggtggcagcagcctcaggcgccccactcccgaggtacagttggtcgcgtaggtcgtggggcttgggaggtaggaaagaacggccggtcggggccttcgaggtaggaacggttctccgtagacgaacgggtcttacgtaggactaccaccgttccgaccggtactactatactccgagtgggtcncgacgacggtccctaggaccgaggtctaggacgtggacgtagggacgactaccgaaacccgtaccggacggtcggaaccaaacgaaaccgaacgacaacgtaacgtaacgttcggaacgggtcgaacgggtaccaaccgagtacggaccgacggacctacgtcctagacgcaacgtcgaccgttacggagggtaggtacggacgtaccggagtaacgnggaacgtacgtaccgtacgaccggacggtaccggttccggtagttacgtaccgtggtacggacggaaggtacggaaggtaacgtagtacgggacgtacggtaagacgtcggttagtaggttaggtaaggnggttaaccgg

SEQ ID NO: 239222 - DNA, 874 bp, Homo sapiens
  misc_feature: GYAE6OF01BXY7X.4.18.B07.1.454.CMB.1.raw
tcagagcactgtagcacgaccggtgctcgatttagtcgctgcgtaagggggagcatcacccagcaaccacatctgtcctctagagaatccccctgagagtctccgttcctccaccatggactggacctggaggatcctcttcttggtggcagcacgcctcgaggacgcccacctacccgaggtactaggttggtgccgtaggtcgtggggtctaggaggtagaacggaggtccggttcgggggtaccctacgtaggtacggtaacggttcccttacccggtaggtacccgaagggttcccgtttacgtaagggtacctaccctaacccgttaccgtacccggtaccttaaccgttaacttacgtcccgttacgggtcgggtaccggaccgtacccggtacccggtacccggtacgggtaaccggtacgggttacgtaggtagggtagggtacgggtacgggtaacgtaacccgtaacccgtaaaccccggtaaccggtaccgggtaccggaaaccgaaacgaaaaccgtaccgaaccgtaacggtaaacggtaacggttacggaacgggtacggtacggtacccgaacgtaccgtaacggaccggtaccggtaccgtacccggtaccgtaccgacgtaccgtaaccgtaccgtaccgttacggttaggtacgggtagacggacggtacggacgtacggtacgtacggtacgggtaaccggaaccggtaccgggttaccggtaccggtttacgttaacgttacgtacggtaccgggaggaacgggtaagggtaacggtacggttacggtacgggtacggtacgacgtacggtacggttacggttaagggttaagggttacgggtaccggtaccgg

SEQ ID NO: 239223 - DNA, 698 bp, Homo sapiens
  misc_feature: GYAE6OF01B1QWU.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcgaaggtcttctggatacaccttcaccgctactatatccgactgggtgcgacacggccctggacaagggcttggagtggagtgggacgataccgaacctaacgaccggtggacaacgaaaacacgcaacagtaacgtttcgagggacagggtaccaaccgtagtacggaaccgaagggacctaaccggttccgttacgacgtaccaaaccgacgtacccttaacggttcgggaaggttcggaacggacgtaacggggtctacgggtaagtaacgttccgttacgggaaccggtacccggtaacccggggtccgttacggttaaacgtttaccggttacggttcgggaacgtacgggaaagggtaaggggtaaaacggtcgttagggtaacgggttaccgggtaaagttaaccggaacgggttcgttaggggttaacggtttaaaagggaagggtttaaaccggg

SEQ ID NO: 239224 - DNA, 665 bp, Homo sapiens
  misc_feature: GYAE6OF01CANYZ.4.18.B07.1.454.CMB.1.raw
  modified_base (251)..(251): a, c, t, g, unknown or other
  misc_feature (251)..(251): n is a, c, g, or t
  modified_base (469)..(469): a, c, t, g, unknown or other
  misc_feature (469)..(469): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtaccagttggtgcagtccgtggggctgaggtgaagaagcgtggggcctcgagtgaaggtcctcctgccaaggcttcgnggactacaccttcaccggctaactatactccgagtgggtgcggacgacggccctagggaactaagggcgttggacggtggagtcgggaacggtataccgaaaccctaacgaccgggttagaccaaacgaaacaacgacaacgtacgaaacgtttacggaggggacgaacgggtcaaaccgtagtacgggaccctagggaacctaccgttcctacgtanacccgtaacacgtcctacgttgggaggtcgagcgaggcttaggacgtagtacgtacggaacgtaccgacgggtaccgttagttaacgttacgtcggtaggacggtaggtaaacgggaaggtaaaggtgttaacgggaggtaccggtaagtaccggtagtaccgttaggttaggggttaaacggtggttaaaccggg

SEQ ID NO: 239225 - DNA, 739 bp, Homo sapiens
  misc_feature: GYAE6OF01AL3KN.4.18.B07.1.454.CMB.1.raw
  modified_base (270)..(270): a, c, t, g, unknown or other
  misc_feature (270)..(270): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagctacgcctcgaggacgccccaccttcccgaaggtactaggttggtgcgaggtcggtggggctggaggtagaacggacgccgtgggcctcgagtcgaagtcctcgtggacgtagtcttcgngtactaccgtccttcgacgtctactacgtctaccgtcgtgggtcgaccgtacggccggtacccgtagggaacgagggttcgttaggacggtgggaacggtcgggtaacgtactaacccgaaacccgtacggtaccggtcgaaccaaccgaaacgaaccgtacgaacgtacggtaacgtcggacgggtacgtacggtaaccacgacgtacgaaccgtaccgggtacctacccgttaccgtacgacgtccgtaacgtacggtaccgtaggttacgggaggtccggaaggccgtaaggtggtaacgacggtaccgtacggtaccggacggtaaccggtccgggtacttagggttaacgtccgtgggtaccgagtaacgggtacgtaagggtaacgttacggtagggtaaaccggttcggtaactacgggttacggttagggttaaggttaggtaaccgggttaggtaccggg

SEQ ID NO: 239226 - DNA, 741 bp, Homo sapiens
  misc_feature: GYAE6OF01AJZOE.4.18.B07.1.454.CMB.1.raw
  modified_base (391)..(391): a, c, t, g, unknown or other
  misc_feature (391)..(391): n is a, c, g, or t
  modified_base (662)..(662): a, c, t, g, unknown or other
  misc_feature (662)..(662): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcacgcctcgaggcgcccactcccaggtactagtttggtgcgagtcggtcggggctggaggtaggaaacgtacggcccggttacggggccctacgtaggtacggtacggttcctaccgttgaccgtacggtcctttcgtacggtactaccgtaccgttccgaccggtacttacgtatacgtacccgtaggtcgggtcgacgtaccggacggccccgtaggaacgtagggtcgttaggtaggnggtacggacggggacgtaacctaacccgtaaaccccgtaaccggacccgggtacgaaccaaacgtaaaacccgaaccggtacaaaccggtaagttaacggttacggacgggaccggtaccggtaccaaccgtggaacccggacggaccggtaacgtcccggtaccttaccgacgtactaccgacgtacccttaggacgggtaggtacgacgagacgggtacgtagtacgactcgtacggaccaccgggtaccgtcttacgtacgttaccgnggtacgcgaaggtaagggagtaaacggtggttaggcgtaagacgtacgacggtgtacgggtaaggttagagggttaccg

SEQ ID NO: 239227 - DNA, 617 bp, Homo sapiens
  misc_feature: GYAE6OF01DHS7E.4.18.B07.1.454.CMB.1.raw
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
tcagagcactgtagcacgaccggtgctcgatttagtcgctgcgtaagggggagcatcacccagcaaccacatctgtcctctagagaatccctgagagctccgttcctcaccatggactggacctggagatcctcttcttggtggcagcagcctcaggagcccactcccaggtacagttggtgcagtctggggctggaggtgaagacgcctgggcctnagtgaggtctcctgcaaggtcttcgngactacaccttcgaccggtctaacgtatatccagtcggtgccgtacgacggccccgtggaacgaggtctgagtggagtgggacgtatacgaaccaacgaccggtaggacaaccaaaaccgaacgcaacgaacgtaagtttaccgaggggtacgagggttccaacgtacgtacggaccgaagggaaccaccggttccttacgacggacacgaccgtcgtaccgtgggaggttcgacgcgaggtcgtcggagacgttacgcggaaccgtacggaccggtaccgtagttacgttactcggtcgacggaggacggaacgggtaaagtacgtacggtagacggtataacgagtacgtggttaacggtagtggtaaccgg

SEQ ID NO: 239228 - DNA, 753 bp, Homo sapiens
  misc_feature: GYAE6OF01BO0P7.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccaggtacagttggtgcagtcgtggggctaggaggtagaagaagccgtggggcctcgagtgacggtcctccgtgacgaggtcttcgtggtatacctaccttcgaccggtacttaactatacgtccgtacgtcgggtgtaccgacgaccgggccccgtaggtacgaacggggtctttaggacggttagggacgttcggggaaccggtaactacccgaaacccgttaaccggaccgggttcgaaacctaacgaaaaccgaacgaccgaacgtaacgggttaacggtttccggaacggggtacgaacgggggtaccaacccgtaacggtaccggaaccgggaagggtaccccttaacccggttcccgttacggacgaaccgttacgaaccgttaccgtttaacgggttcgggaacgggttcggaacggtacgtacgggctaggacgtacgtacggtcggaaccggtacgtaccgggtccgttagttacttcgtggtagacggtaggaacggaacggtaacgttagttagggcgtagtaacgtacggtacggacggttaggttacgggttaaggcggtttaaccggg

SEQ ID NO: 239229 - DNA, 714 bp, Homo sapiens
  misc_feature: GYAE6OF01D3GI4.4.18.B07.1.454.CMB.1.raw
  modified_base (253)..(253): a, c, t, g, unknown or other
  misc_feature (253)..(253): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggagatcctcttcttggtgcagcacgcctcgaggacgcccacctcccgaggtactaggttggtgcgagtcgtggggctgggaggtagaagacggtccggtggggtcctcgaggtaggacggtctccgngacgaaggtccttcgtaggtactacctaccttcgaccggtacttaactattactccgtacggttcggggtacgaccgaccggacccggccccgttagggaaccggtaacggggtcttagggagttagggacggttaggggaaccgtaactaaccccgtaaaccgtaaccggaccgggtacgaaccaaacgaaaaccgaccgacgaacgtaaggttaacgttccggaggacgaccggtacaacgagtaccggaccgaacgggtacctaccgttctacgacacgtacgacgttaccgtaggttgggacgtggacgcggtaggcgtaggacgtagtcggtacgacggaccgtcggtaccgttagttacttacggtgacggtacgaaggtaaggaacggtaagttacggtaggacgtacggtataccggtagttacgttaggttaacggtaaggtcgttaaccgg

SEQ ID NO: 239230 - DNA, 696 bp, Homo sapiens
  misc_feature: GYAE6OF01ESG3P.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccacctcccaggtacaggttggtgcagtcgtggggctggagggtagaagaagccgtggggcctacgagtgaaggtcctaccgtgcgaaggtcttcgtggactacctaccttcgaccggcttaactatactccacgtgggtcgacgacgaccggcccgtaggacgagggtcgttggaggtggaggtgggacgactacaacccgtaacgaccggtcgaacaaccaaacgacgacacgaacgtacgttacgacgggacgacggtacacgagtacgaaccgtagggacctacggtccgtacgacgacctacgacgtaccgttaccggtagggacggtacggacgtacggaggtacggtcggaacgtacgtaccggtacgaaccggaccgtcgggttaccgttagttacggttacgtggtacggacgggtaaggaaggtaacgggtaacgttaaggttacgggtaaccgggttacggaacggttaacggtagttaaccgggttaaggttaacggggtttaaagggtggttaaacccggg

SEQ ID NO: 239231 - DNA, 678 bp, Homo sapiens
  misc_feature: GYAE6OF01E29KG.4.18.B07.1.454.CMB.1.raw
  modified_base (164)..(164): a, c, t, g, unknown or other
  misc_feature (164)..(164): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttgggtggcagcagcctcgaggacnccccacctcccaggtacaggtttggtgcgagtcgtggggctggaggtagaagaacgccgtggggcctgaggtaggacggtcctccgtgacgaggtcttcgtggatacctaccttcgaccgtctaactactactacccaggtgggtacgccgaccggaccggtcccgtaggaaccggagggtcgttaggaggtggaggtacgggacgtactacccgaaaccgtacggaccggtgaaccaacgaaacgacgacaacgtaagtaacgttcgacgggacgtacgggtacacgtacgacggaccggaacggcctaccgtccgtagacacgtaacgcgtacgttacggtagggagtacggacgtaccgtaggactagggataccggtcgaccggaccggtaccggtacggttaccgtttagttaccgttacgtacggtacgacggacggtaaggaaggttacgtaagttgggaccggttaggaagttacgcgtaggttaggtaaggttaagtgggttacg

SEQ ID NO: 239232 - DNA, 825 bp, Homo sapiens
  misc_feature: GYAE6OF01EX67Q.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctctttcgttggtggcagcagcctcaggagcccaactcccaggtacagttggtgcagtcgtggggctgaggtagaagagccgtggggcctcgagtgaaggtcctcctgcgaggcttcgtggatacctaccttccaccggacctacgtatactaccacgtacggggtcgaccggtaacgaccggtaccccgtgggaaccgtaaacggggtccgtttacgggtagggttacgggtaagggttgggggaacccgggtaagtaaccccgtaaaacccccgttaaaccggtaacccggggttacggaacccgaaaaccgaaaaacccgaaaccgacccgtaaccgaaaaggttaaacggttttaccggaagggggtaaccgacggggtaacccgaacgtacgtaacggaacccgggtaacgggtaacccgtaaccggttacccttaccgaacggtacccaaccggaaccgtacccgttaacggttacggggtaacggtaggacggtaccggacgggtacgtaggaacgtagtaccgtagggacccgtacgggtaccggtaccggttacgttaccgttacgtggtaggaccggaaagggtacggtaaagggtacgttagttacgggtaggttaccgggtaacgtacggacggttacggttaagggttaacgggttaaagggtacgggtttaacccggg

SEQ ID NO: 239233 - DNA, 749 bp, Homo sapiens
  misc_feature: GYAE6OF01B981E.4.18.B07.1.454.CMB.1.raw
  modified_base (168)..(168): a, c, t, g, unknown or other
  misc_feature (168)..(168): n is a, c, g, or t
  modified_base (658)..(658): a, c, t, g, unknown or other
  misc_feature (658)..(658): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggacggatccctcttcgttggtggacagcagccctcgaggacncccgacctcccaggtactaggtttggtcgctacggttcgtggggctggaggtgaaaggaacgccgtcggggtcctcgaggtaggtaacggtcctccgtaggaccgtaagggtcctttcgtaggtacttaccgtaccgttccgaccggtctactacgtactccacgtcgggtcgccgacgtacggccccgtaggacgacggtcgttggaggtggaggtacgggacgtacgtaccgtaacccgtaaccggtccggtacgaccaaccgaaactaacggaccaacgtacgtaacgttccgacggggtactacgggtacctaacgagtaccggaaccgaacgggtacctaacccggttctaccgacgtacccgtaacgtaccggtacccttaagggtcgggaacgggttacaccggtacggacgggttactaggaacggttaactccgtaacgggacccgtaaccggtacggaccgggttttactacgtttcggngtacggacggtaagacgggaacgtaagttaccggtaagtcggaacgtactacgacgggttcgtaaggttaccggtaaagtcggttaaccgg

SEQ ID NO: 239234 - DNA, 783 bp, Homo sapiens
  misc_feature: GYAE6OF01BZ2QA.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggagcccactcccgaggtacaggttggtgcagtcgtggggctggaggtagaagaacgccgtggggcctcgagtggaacggtcctcctgcgaaggtccttcgtggactactacccgtttccgacccggtactaactactactaccctacggtgggtaccgcgaccgaccggccccgtagggacgaacgggtcgttgggaggtagggagtcggggaacgtactaacccgaaacccgtaacgtacccgggtacgaaccctaaaccgaaaaccgaaccggacaaaccgaacgggttaacgttacggaaggggaccgtacgggtaccaaccgtacgtacggaccgacgggaacctacccggttcctacgacgaccaacgtacgtaccgttacggttgggacggtacggacgaccggtagcggtacggacgttaacgtccggtaacgacccgggaaccgttaccgggttaccgttacgtttaacgttaaccggtgggtaccggaacggttaacggggaaggttaaacggggtaaacgtttagggttaacgggtacgggttacggtaaacgttacgggtaggtttacggttaaggggttaacgggtttaaaacgggtcgggttaaacccggg

SEQ ID NO: 239235 - DNA, 650 bp, Homo sapiens
  misc_feature: GYAE6OF01ATQ88.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcgagtgaggtcctcctgcaaggcttctggatacaccttcacccggctacgtatactcccacgtgggtgcgaccgacggcccctggacgaagggtcttggagtggtagtcgggacggatccaaacccgtacgaccgggtggacaacctaaacaacgaccacgaagtaacgtttcgaacggggcgagggtaccaacgagtacgaacccgagggaccaccggttccttacgacgtacaccgacgtcccgtaacgttacgggtaggtgacggaccgtaggcgtagagacttcgtagaaccggacgtaccggccggttataacgttacgttggcggtaggtaacgggagggtaagggaacgtaggttacggaacggttacgggaacttaacggtacggtaccgttagggttacggttaaagggtggtttaaacccgg

SEQ ID NO: 239236 - DNA, 659 bp, Homo sapiens
  misc_feature: GYAE6OF01DOZT2.4.18.B07.1.454.CMB.1.raw
  modified_base (255)..(255): a, c, t, g, unknown or other
  misc_feature (255)..(255): n is a, c, g, or t
  modified_base (453)..(453): a, c, t, g, unknown or other
  misc_feature (453)..(453): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccaggtacagttggtgcagtcgtggggctggaggtgaagaacgccgtcggggcctcgagtgaggtcctccgtgcaaggtcttcgnggactaccaccttccgaccggtctactatactccacgtgggcgcgacacggcccctaggacgaagggtcttaggaggtggagtcgggacgactaccaaacccgtaacgaccggtacgacaacaaaaccgaacgcaacgaagtaacgttcgagggtccgagggtaccacgagtacgaccgacggacaccgtctacgacncacgactaccgttacgtagggtaggtacgacgtacgacggtcgtacggtacgatccgtacggaaccggaacgtacccggaccgtttacgttacgtttcgtggttacgacgtaagggtaggaacggtaacgtaaggtttcggaacgggttaccggtaagtaacgtacggtacggttggtttaaacgggtagggtacggttaaccggg

SEQ ID NO: 239237 - DNA, 733 bp, Homo sapiens
  misc_feature: GYAE6OF01BT3VG.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcacgcctcgaggacgccccactcccaggtacaggttggtgcagtcgtggggctggaggtgaagacgcgtcgggcctgagtgaggtcctccgtgacgtaggtcttcgtgatacacccttacgacccgcttactagttactccacgtggtcgacgacgaccggtcccctagggacgaacgggtcgttaggaggtggaggtcggggaacgacgttaccgaaaccccgtaaccggccgggttacggaccaacgaaaacccgaaccgaccaaacgtaacggttaacggttttacgacggggtacgtaacggggtacctaaccgaacgtccggaaccggaccgggtaacctacccgttaccgtttaccgacgtaaccccaccgtaacgtacccgtttaacgtacggggtacggtaggtaaccgtacggacggtaacgtaaggcgtacgttcgtacggacccgtaaccggtaccgggttaccgtacggtttacttacggtgttcggaggtaacgagggtaacgacggttactaggggtactacggggtactacggtacgtacggtaggttaaggtaagggtagttaccggg

SEQ ID NO: 239238 - DNA, 718 bp, Homo sapiens
  misc_feature: GYAE6OF01A44AB.4.18.B07.1.454.CMB.1.raw
  modified_base (308)..(308): a, c, t, g, unknown or other
  misc_feature (308)..(308): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggattcctctttcgttggtggcagcacgcctcgacggacgccccacctcccgaggtacctaggttggtgcgtagtcgtggggctggaggtaggaagaacgccgtggggcctcgagtaggagtccgtcctgacgaaggtcttcgtaggactaccacccttcgacccggtactaactatacncctacgtgggtcgaccgacgacggccccgtaggacgaacggtctaggaggtgggatggggacgtactaccgaacccgtacgaccggtgaaccaaacaaaccgtaacgacgtaacgaaggtaacgttacgacgggtacgtacggtccaaccgtaagtaccggtaaccggaacgggtaacccgtaaccgttccttacgacgtaccgaaccgtacgtacccgttaggttacgggaggtcggacgtacggacggtacgtaggtaccgagtacctacggacccggacggtaacccggtcgttagttacgttacgtcggtaccggacgtaggaaggaaacggtaccgttagtacgggttaacggactaaacgtacgtaaccggttaggtaggttaacgggtaagtaacgggttacg

SEQ ID NO: 239239 - DNA, 781 bp, Homo sapiens
  misc_feature: GYAE6OF01BV0QY.4.18.B07.1.454.CMB.1.raw
  modified_base (191)..(191): a, c, t, g, unknown or other
  misc_feature (191)..(191): n is a, c, g, or t
  modified_base (769)..(769): a, c, t, g, unknown or other
  misc_feature (769)..(769): n is a, c, g, or t
tcagagcactgtagcacgaccggtgctcgatttagtcgctgcgtaagggggagcatcacccagcaaccacatctgtcctctagagaactcccctgagagctccgttcctcaccatggactggacctggaggatcctcttcgttggtggcagcacgcctcaggacgcccacgtccgaggtactaggttggtncgagtcgtggggctgagggtagaaagaacgccgtggggcctcgtaggtggtaacggtcctccgtgacgtaacggtcctttcgaggtaacttaccgacccgtttaccgacccggtacttaactacgttactccgtaggttggggtcgccggtaccaccgggtccccgtagggaaccggtaacggggtccgttggaacggtcgggtaaggtacggggtaaccgtactaacccgaaaaccccgtaacggacccgggtagaccaaaccgaaaaccgtaaccgaacctaacgaaagggttacgttacggacgggacgtacgggtcaacccgtagtacggaaccggaacggtaccgtaccgttcccgtaacgactaaccgaccgtaaccgttccgtaacgggttacgggtacgggtagacggtaacgcggtacgtaggtagacgtcgtaccggaccgaccgtacggtaccggttacgtacgttacggtcggtacggtaacgggaggtaaggtaaacgggaggttacggttagggtaacggtacgtaacggaacgttacgggtggtttaaggagggtttaaacgngggttaacccgg

SEQ ID NO: 239240 - DNA, 619 bp, Homo sapiens
  misc_feature: GYAE6OF01EXRIR.4.18.B07.1.454.CMB.1.raw
  modified_base (496)..(496): a, c, t, g, unknown or other
  misc_feature (496)..(496): n is a, c, g, or t
  modified_base (530)..(530): a, c, t, g, unknown or other
  misc_feature (530)..(530): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggagatcctcttcttggtggcagcagcctcaggagcccactcccaggtacagttggtgcagtctggggctgaggtgaagaagccgtggggcctcgagtgaggtctcctgcgaaggtcttcgtggactaccacccttcacccggctaccttatactacccgacgttggggtcgaccggacgacggcccccgtaggaacgaacgggtcttaggaggtggagtcgggacgtactaccaaccctaacgaccggtgacaacaaacacgacacagtaagttcgagggcgaggtaccacgcgtacgaaccgagggacctaccgtaccttcgacgcaacgtacgtacctacgttgggaggtgacgacgaggtactgagntacgacgacgaccgtcggtaccgttgtattacgngtcggaggtaaggaggtaacggaacgtacgtaggtacggtacggtataacggtacggtacgttagggttaggtaaggtaggttaaccgg

SEQ ID NO: 239241 - DNA, 819 bp, Homo sapiens
  misc_feature: GYAE6OF01AGBVY.4.18.B07.1.454.CMB.1.raw
  modified_base (755)..(755): a, c, t, g, unknown or other
  misc_feature (755)..(755): n is a, c, g, or t
tcagagcactgtagcacgaccggtgctcgatttagtcgctgcgtaagggggagcatcacccagcaaccacatctgtcctctacgagaatccctgagagctccgttcctcaccatggactggacctggagatcctcttcgttggtggcagcagccctgaggacgcccactcccgaggtacaggttggtgcgaggtcgtgggctaggaggtgaagacgccggtcggggtcctcgacggtagtacggtcctccgtacgcgtaacggtcttccgtagggtaaccttaccgacccgtttaccgaacccgggtccttaaccgtaacttactcccgacgggttggggtaccgaccgtaccgaaccgggtccccgtagggaaccggtacgggtcgtttaggacgggttgggaacgttacgggggaaccgtaaccgtaaccccgtaaaccccgtaaccggtacccggggtacgaaacccgaaacaaaaaccggtaaccgacgtaaacgtaacggttaacgttaccgggacgggtacggaacggttcccgaacgtagtacccgggaaccggacggtaaccgtacccggttacttaccgaacgtaccacgtaacggttaccgttaacgggttacggtaggggtacggtacgacggtaggcgtaggacgacttcgggaacgtaaaccggtcgggaccgttacggttacggtacgttcggtaacgaggtacgtaaagggtaggaaaccggtacggttactaacggggngttaaccgggaacgtaggtaacccggttaggttacggttaaggggtaacgtcggggttaacccg

SEQ ID NO: 239242 - DNA, 769 bp, Homo sapiens
  misc_feature: GYAE6OF01BV6QF.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagccctcgaggacgccccactccccgaggtactaggtttggtgcgtaggtcggtggggctaggagggtagaaaggacgccggtcggggccctagaggtaggaacggtcccgtcgtgacgtaaggtcttcgtaggtactacctaccttacgaccggtactactatacctaccgtacggtcgggtcgacgaccgaccggtcccgtaggaacggtaggtcgtaggtagggtggtaggtacgggacgtactaacccgaacccgtaaccgacggtacgacgaaacgaaaccgacgacgaacgaagtaacgttacgacgggtacgacgggtaccaacgtagtaccggaaccgtaacgggtacctaaccgttccgtacgacgtacaccgtacgtaccgtacgtagggacggtagacgacggtacgtacgtaggacgtacgtacgaacggtaccggtaaccgtacgggttacgttaacgttacgttacggtcgggtacggacggtaaagggtaagggtaacggtaaacggttacgggttaacggggtaacggtaaccgggttaaacgaccggtaagttaccgggtttaagggttaagggttaaacggtaggggtttaaaccccggg

SEQ ID NO: 239243 - DNA, 622 bp, Homo sapiens
  misc_feature: GYAE6OF01DLY0U.4.18.B07.1.454.CMB.1.raw
  modified_base (285)..(285): a, c, t, g, unknown or other
  misc_feature (285)..(285): n is a, c, g, or t
  modified_base (565)..(565): a, c, t, g, unknown or other
  misc_feature (565)..(565): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagagccgtggggcctcgagtgaaggtctcctgcaaggcttcgtggactacaccttcaccggtctactatactccactggtncgacacggcccctaggacgaaggcttggacggtgagtgggaacggataccgaacccgtaacgaccgggtaggacaacgaaaaccaacgacaacgaagtaacgtttacgaacgggcgacgggtaccaccgatacgaccgacggacaccggttccttacgacgacaaccgagtcctacggttggaggtagacgcgaggctaggagtaatcgagaccgaacgtacggccggttagtaattacgtagtacgacggagtaacggaaggtaacggtagttacgggnggtacggaacttaacgtagtacgggttaaggttcgggttaaagaagggttaaccggg

SEQ ID NO: 239244 - DNA, 896 bp, Homo sapiens
  misc_feature: GYAE6OF01CAWR2.4.18.B07.1.454.CMB.1.raw
tcagagcactgtagcacgaccggtgctcgatttagtcgctgcgtaagggggagcatcacccagcaaccacatctgtcctctagagaactcccctgagagctccgttcctcaccagtggactcggacctggaggtactccttcttcgttgggtcggccagcgacgccctcgacggacgccccaccgtacccgaggtaactggtttggtcgcgtacggttcggtcggggtccgtaggtacgggtaggaaacggacggccggtcgggggtacctacgtaaggtcgaacggttcctccgtgaccgaaggttctcggtaggacctacctaccgttaccgaccggtacttaacttactaaccgtccgtacggttcgggtacgaccggaccgtacccgggtcccgtacggaaccggtaacgggtccgttagggacggttacgggacggtaccgggtaaccggtaacctaaccccgaaaccccggtaaccggtaccgggtaccggaacccaaaacgaaaacccgaccggaacccgtaacgggttaaacggttaaccggttaacggacgggggtaacccgttaacggggtaacccaccgtaacggtaacccggaaccgggtaacggtaccgttaaccggttacccttaccggaccgtaccgaaccgtaccgttacccggttaagggttaccgggaacggtccgggtaaggccccggtaaggtacgtaacgggtaccgttacggaaccggttaccggaacccggtacccgggtaccggttaccggtttaacggtttaacggtactaccggggtagggttaaccggaggtaaaccgggaaggtaaccgttagggtaacggtcggtacgtagacgtaggtacgtagggttacgtaggtaggtaaccgg

SEQ ID NO: 239245 - DNA, 725 bp, Homo sapiens
  misc_feature: GYAE6OF01CQ8Y1.4.18.B07.1.454.CMB.1.raw
  modified_base (246)..(246): a, c, t, g, unknown or other
  misc_feature (246)..(246): n is a, c, g, or t
  modified_base (621)..(621): a, c, t, g, unknown or other
  misc_feature (621)..(621): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggagatcctcttcgttggtggcagcagcctcgaggacgcccactcccgaggtacagttggtgcagtcgtgggctggaggtgaagagccgtgggcctcgagtgagtctcctgcgagcttcgngactaccaccttcgaccggtctacgtatactccgacgtgggtcgacggaccgaccggtccccgtagggaccgaacgggtcgtaggtaggtggagtacggggacggtaactacccgaaacccgtaaccgaccggtacggaccaaacgaaaccgaacggacaacgtaaggtaacgttacggaagggtaccgaacgggtaccaaccgtaacgtacggaaccgaacgggtaacccgtaccgtttacccgttaacggacgtacccgtaacgaacggtacccgttacgggttacgggtaagggtacggacgaccgagggtactaggtaacgtcgttacgacgggaaccgtaccgtacgggtaccgttagttacgttacggnggttacggaacgagggtaaggagggtaaacgttagttacgggtacggtacggtaacgtaggtacggttacgttagggttaagggttaaggtacggttaaccggg

SEQ ID NO: 239246 - DNA, 839 bp, Homo sapiens
  misc_feature: GYAE6OF01B052A.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggagatcctcttcttggtggcagcagcctcgaggacgcccactcccgaggtaccaggttggtgcgagtcgtggggctgaggtagaagagccgtggggcctagaggtagaaggtcctcctaggcaaggtcttacgtaggactaccaccgttcgaccggtactactatactccgtacgtgggtcgaccggacgtaccggcccgtagggaacgtaaggtcgttaggagtgggacgtacgggaacgtacgtaccgaaaccgtaaccggaccggtacggacaaccgaaacgacgaccgaacgtaaggtaacgttcggaacggacggtaacgggtacctaacgagtaccgggaaccggtaacgggtaccgtaacccggtttaccgttacgaaccggtaccgaaccgtaaccggtaccgtttaacgggtcggtaaacggggttacggtaaccggaccgtacgggtacccgtttaacgggacgtaaccgttaccggttaacggaaccccggtaccggggtaacccgggtttaccgggtttaaacgtttacgtttaccgggttaccgggtacgggtaaacccgggtaaggaaaggggttaaaccgggtaacgggttacggttaaacgggtacgggttaaccggtaaaccgttacccggggtaaacgttacgggttaaacgggttttaaacgggttaaacgggtaacggtttaaaaccccgggg

SEQ ID NO: 239247 - DNA, 571 bp, Homo sapiens
  misc_feature: GYAE6OF01A3R4N.4.18.B07.1.454.CMB.1.raw
  modified_base (221)..(221): a, c, t, g, unknown or other
  misc_feature (221)..(221): n is a, c, g, or t
  modified_base (246)..(246): a, c, t, g, unknown or other
  misc_feature (246)..(246): n is a, c, g, or t
  modified_base (365)..(365): a, c, t, g, unknown or other
  misc_feature (365)..(365): n is a, c, g, or t
  modified_base (408)..(408): a, c, t, g, unknown or other
  misc_feature (408)..(408): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagagccgtggggcctnagtgaaggtctcctgcaaggcttcnggatacaccttcaccggctactatatccacgtgggtcgacgacaacgggcccctggacgaagggcttgagtggagtgggacggactcaaaccctaacgaccggtggacaacaaacacgnacagtacgttcgagggcagggtcacgtagtagaccgaggaccncgtccttcacgcacacgccttacgtcgggagtcggagcgaggcaggacgactcgtacggacgaccgtcggaccgttgttacttacgtggttacgcgaggacgagggtaacgtacgttaggaggtacgaagtacgtagcgttaggtacgggttaagaggtacgg

SEQ ID NO: 239248 - DNA, 806 bp, Homo sapiens
  misc_feature: GYAE6OF01A8WP3.4.18.B07.1.454.CMB.1.raw
tcagagcactgtagcacgaccggtgctcgatttagtcgctgcgtaagggggagcatcacccagcaaccacatctgtcctctagagaactcccctgagagctccgttcctcaccagtggactggacctggagatcctcttcgttggtcggcagcgacgccgtacgacggaccgcccctaccgtcccgaaggtacgtaggttggtcgcgtaggtcggtggggtcgtaggaggtaggaacggtacggtccggtcggggtcctacgtaggtacggtaacgggtcccttcgtggaccggtaacggtccgtttacgaggtaccttaacccgtacccgttaccggaacccggtacttaaccttacttaccgtcctagggtcgggtcgaccgacggtacccggtcccggtaggaaccggtacgggtcttagggaggtacgggtaggtcggggtaaccgacgtaaccccgtaaacccgtacgggaccggtagaaccaaacgaaaccgacgaacgtacgtacggttaacggttcggagggtaccgtacggtaacctacgtagtaaccggacggtaacggtacctaccggtccgttaacgacgtaccaacgtaccgtacggtacggtagggacggtacgacggtacggacgtcgtaggtacgtacgtacggtacgaccggaccggtaccggtacgttacgtagttacgggtcgtaggaaccggaggaacggtaacggtacggtacggtagggtaccgtaacgggtactaacgggtacggttacggttagggttaacggtaaggtacgggttaaccgg

SEQ ID NO: 239249 - DNA, 729 bp, Homo sapiens
  misc_feature: GYAE6OF01A5132.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatccttcttcttgggtggcagcagcctcaggacgcccactcccgaggtacagttgggtgcagtcgtggggctggaggtgaagaagccgtggggcctcagtgaacggtctccgtgacgaaggtcttcgtaggacgtaccaccttccgaccggacctacgtatactcctagtcggggcgtcgaccgtaccgggtccccgtggaacgtaacggggtcttacggaggtacgggaggtacggggacggtaacctaccgaaacccccgttaaccggacccggggtcggtaaccaaccgaaaaccgaaccgaccgaacgaacggtaaacggtttacggaacggggtacgtacgggacgaaccgagtacgaaccggaacgggacccgtaccgtccgttcgacgaccgacgtacgtaccgtaccggttgggtacggtggtacggacgtacggcgtaggagtacgtacgacggaccggaccgtaccgggtaccggttagtaacctttcggtaggtcggtacggagtaaacgggtaggaacgggttacgtaggtccggttacggtaagtacgtggtacgttagggttaggttaagggtaggttaaccggg

SEQ ID NO: 239250 - DNA, 769 bp, Homo sapiens
  misc_feature: GYAE6OF01DD7YF.4.18.B07.1.454.CMB.1.raw
  modified_base (549)..(549): a, c, t, g, unknown or other
  misc_feature (549)..(549): n is a, c, g, or t
tcagagcactgtagcacgaccggtgctcgatttagtcgctgcgtaagggggagcatcacccagcaaccacatctgtcctctagagaactcccctgagagctccgttcctcaccatggactggaccgtggaggactcctcttcgttggtggcagcacgcctcgaggacgcccacctcccgaaggtactaggttggtgcgtagtcggtgggctggaggtagaagacgcgtgggcctgagtagaacggtcctcgtacgacgtaaggtccttacgtaggtaacttaacccgtacccgtttaccgaacccggtacttaaattacgttaaccgtccgtaacggttcggggacgaccggtaaaccggcccgggtacccgttagggaaaccggaagggttccttagggaggtagggaacggtacgggtaaccgaacgttaaccccgaaaaccgtaaccggacgggtacgaacaaacgtaaaaccgacggtacaacgtaagtaacggttacggagggacgtaggtacacgtagtacgacgaggacctacgtctagacncaacgtacgtccgtaagtgggacgtagacgtagaacgggcgtaggagtacgtccgtaaggacccgggaacgtaccgggtacgttaacgttacgttacgtcggtacggaacggtaagaagggtaacggtaaacgttacgggttaaggaccgggttaacgtaattacgggtacggttaacgggttaagggttacgggttaaaagggtccggtttaaaccggg

SEQ ID NO: 239251 - DNA, 831 bp, Homo sapiens
  misc_feature: GYAE6OF01BYON1.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgccccactcccaggtacagttggtgcagtcgtggggctggaggtagaagaaggccgtggggcctcgagtggaaggttcctccgtgcgaaggtccttcgtaggactaccacccgtttccaccggtcttaactagtactaccctacgtggggtcgaccgaccgaccgggccccgttaggaaccgaaaggggtccttaggacggttagggtaggtacggggaaccggtacgttaaccccgaaaaccccgtaaaccgacccgggttacggaaccaaaaccgaaaacccgaaacggaccctaaaccgaacggttaaaacggtttaccggaagggggacccgtaacggggtaccaaacccggtagttaccgggaaacccggaacggggtaaccctacccggttaacccttaccgaacggaccctaaacccgtacggtaacccgtttaccggttacgggtaacggggttacggacggtacgaaccgggtacgttacgaggtaacgttcgtaacgacccggaacggtacccgggtacggttacgttaaccgttaaggttacgtacggtacggacggttaaacggaagggaacggttacggttaacggtaacggtaccgggtaaacgtaacgaacggttacggtaggtttaacgggtttaaggaacgtttaaaccggg

SEQ ID NO: 239252 - DNA, 862 bp, Homo sapiens
  misc_feature: GYAE6OF01CK8IR.4.18.B07.1.454.CMB.1.raw
  modified_base (188)..(188): a, c, t, g, unknown or other
  misc_feature (188)..(188): n is a, c, g, or t
tcagagcactgtagcacgaccggtgctcgatttagtcgctgcgtaagggggagcatcacccagcaaccacatctgtcctctagagaatcccctgagagctccgttcctcacatggactggacctggagatcctcttcttgggtggcagcagcctcgaggacgccccactcccgagtacgagttggtcngtagtcgtgggcgtaggtaggtagaaggaacgtcccggtaggggccctcgaggttacggaacggtcctccgttgacgaggttcttcggtgactacctaccgttacgaccggttctaactacttactaccgtcgttacgggtcgaaccgtacggacccggtaccccggtaggggtaaaccggtaggggttacccgtttagggtacgggtacggggtaacggggtaccggggtaaacgggttaacctaaacccccgttaaaaccccggttaaacccggtacccggggttaaccggaaacccaaaacccgaaaaaacccggacccgggttaaacaaccggtaaaggttacggtttaaccggacgggggaaccttaccggggtaaccaccggtaggttaacccggaaccgggacgggtaaccgttaacccgggtttccaacccgtacgaccccgtaacggtaccgtacccggttaaggtttacgggaacggtttagggacgtaccggacggtcgtagtacggtcgttaggtaccggtacggaacccgggtacggttccggtaacgtttcgtttaacggcggttaaggcggtaaagtagggtaacggtacgtttacggtaagggtccgtaacggtaagtaccggtagtcgtttaggtaaggttacgtaaggttacccgg

SEQ ID NO: 239253 - DNA, 747 bp, Homo sapiens
  misc_feature: GYAE6OF01AQKQS.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcacgcctcgaggacgccccactacccaggtacagttggtgcagtcgtggggctggaggtagaaggaacgccgtcggggcctacgaggtaggaacggttcctccgtgacgaagtcttcgtggactacctccttccgaccggtacttactatactccaggtggtcgcgaccgaccggtccccgtaggaacgaacgggtcgttaggacggtggacggtacggggacgtacgtaacccgtaaaccccgtaacggacccgggtacggaaccaaacgaaaccgaacaccaacgtaaaggtaacggttacgacggggtacgaacgggtacaaccgtacgtacgaccggaacggtaccgtacgttacccgtacgacgacaacgccgtaccttacggttagggacggtcgacgacggacggtacgagtacggtacgtacgttacggacgaacccggtccgggtaccgtttagttaccgtcgtcggtacggaacggtacgggtaagggagggtaacgtaccgggttaagggcccggtaacgggtaacgtaaccgggtacgttacgggtttaagggtaacggttaaacggggtaagggttaacccggg

SEQ ID NO: 239254 - DNA, 748 bp, Homo sapiens
  misc_feature: GYAE6OF01ELZQG.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctctttcttggtggcagcagccctcgagggacgccccacctccccgaggtacctaggttggtgcgaggtcgtggggctggagggtagaaggacgtccggtcgggggtcctacgaggtagaacgggttcctccgtgacgtaaggtcttcgtaggacttaccacccgttcgacccggtcttaaccttatactccgtagttcggggtcgtccggaaccgtaccgggtcccccgtagggaacggtaacggggtcctttagggaggtacgggtagtacgggggacgtactacccgtaaaccccgtaacgaccggggtgaacctaaccgaaaacgacgaccaagtaacggtaacgtttcggaacgggaccggtaggtaccaaccgtagtacggaccggacgggacctaccggtaccttacgcgtaccgtacgacgtccgtttaaggtcgggacggtgacgcggagacgtgagtacgtcgagaaccgccggtacggtccgttagtacgtaccgttggacgtacggacggtaaaggacggggtaacggtacgttagggtacgggtaacggtacgtacgttagggttcggttaagggttaaggttaacgggtagggttaaccgg

SEQ ID NO: 239255 - DNA, 998 bp, Homo sapiens
  misc_feature: GYAE6OF01EQJWU.4.18.B07.1.454.CMB.1.raw
  modified_base (157)..(157): a, c, t, g, unknown or other
  misc_feature (157)..(157): n is a, c, g, or t
tcagagcactgtagcacgaccggtgctcgatttagtcgctgcgtaaggggagcatcacccagcaaccacatctgtcctctagagaatcccctgagagctccgttcctcaccatggactggacctggaggattcctcttcgttggtggcagcagcctnaggacgcccactcccagtacagttggtgcagtctggggctaggaggtgaagaacgcgtggggcctagacgtggaacggttcctccgtgacgtaaggtccttacgtacggataccgtaaccctttccgaacccggtaccttaacgttaacttaacgtaccccgttaacgttcggggttacggaccggtaaacccggtaccgggggtacccccccgtttaagggggaaacccggtaaacgggggttacccggtttagggtaacgggttacggggtaaccggttaacggggggtaacccgggtaaccgttaacccgtaaaaaccccccggttaacccggtaaccccggggttacgggaaacccgtaaaccccggaaaaaaccgtaaacccgggaacccgtaaaccggtaaacggggtttaaaaccggtttttaccggaaaccgggggtacccgggtaaacggggtttaaaccccgaaccggtaaacggttaaccgggaaaccccggaagggggttaaccccccgttaaaccggttacccccggttttaaaccggaaccgtaaccccgtaaccggtaaacgttcccgttaaccggttacggggttaacggggttaccggacgaacggtaaccgggtcggtaacggtacccgggaacttaccggtaacgtaacccggaaccgggtacggttacccgggtactttaacggtttaaccgtcgggtggtaaccggtaaaggtaaggtaaacgggttaaacgttacgggttaaggtaacggggtacccggtaaagtaccggtacgtacggttaccgggtttaagggttaacggtaagggttaaacccggg

SEQ ID NO: 239256 - DNA, 697 bp, Homo sapiens
  misc_feature: GYAE6OF01AT969.4.18.B07.1.454.CMB.1.raw
tcagagcactgtagcacgaccggtgctcgatttagtcgctgcgtaagggggagcatcacccagcaaccacatctgtcctctagagaactcccctgagagctccgttcctcaccatggactggacctggaggatcctcttcttggtggcagcacgcctacgaggacgcccactcccgaagggtacaggttggtgcgaggtcgtgggggctggacggtagaacggaacgccggtcggggcctcgaggtaggaacggttcctccgtgacgaacggtcttcgtaggactacctaccttacgaccggtcttaactacgtactaccgaggtcgggtcgaccgaccgaccggtccccgtaggaacgaacgggtcttaggaggtggacgtcgggacgtactaccgaaaccgtacgaccggtgacaacgaaacacgacagacgtacgtcgacgggcagggcacgagtcgaaccgcggtaccacgtcctacgacgccaacgacgtaccgttacggtagggacggtagacgtacgacggtcgagagtccgtacgacggaacccgacggaccgggttaccgttagttaacgttaccgtagggtacgtacggaacggtaagggaacgggtaacgtacgggttaggtaacgggtaccggtaagtaacggtacgttaggttaagggttacggttaaaggtcgggttaaccgg

SEQ ID NO: 239257 - DNA, 596 bp, Homo sapiens
  misc_feature: GYAE6OF01AVFTM.4.18.B07.1.454.CMB.1.raw
  modified_base (222)..(222): a, c, t, g, unknown or other
  misc_feature (222)..(222): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacaggttggtgcagtcgtggggctggaggtgaagagccgtggggcctnagtgaaggtctccgtgcaaggtcttctggacttaccacctttccaccggctaactatatcctactgggtgccgacgacggtccccgtagacgaagggtcttaggagtggagtggggacgactaccaaccccgtaacgaccggtggacaaccgaaaccaacgcaacgacgtaagttcgagggcgacgggtccacgatacgaccgtaggacctacgtcctagacgacacgacgtcctagtacgggagtggacgtcgaggctaggagtacgtcgtacggacgaccgtacgggtccttaggtacttacgtggtcgcgaagagtagggaagtctaggacggtcgagtacgtggtacgtaggttagggtaagtgggtacg

SEQ ID NO: 239258 - DNA, 666 bp, Homo sapiens
  misc_feature: GYAE6OF01B54D6.4.18.B07.1.454.CMB.1.raw
  modified_base (250)..(250): a, c, t, g, unknown or other
  misc_feature (250)..(250): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagccctcaggacgcccactccccaggtacagttggtgcagtcgtggggctgaggtgaagagccgtggggcctgagtgaaggtcctcctgccgaggcttcnggatacaccttcaccggtctactatactaccacgtgggtgcgacgaggcccctggacgaagggcttggagtggagtcggggacggactaccaacccttaacgaccggttcggacaacgaaacgaacgcgacaacggtaacgtttcgacggggacgagggtaccaccgaagtcgaaccgagggaacctaccggtccttacgagccacacgccttacgttacgggaggtacggacgtacgagggtcgtgtaagtactcgtaggtaacccggacgaccgggtcccggttagttaacgtttacgtaggtcggtaccggaggtaacgggagggtaaacggtaccgttacgggtacgttaaccgggtaagttaaccgtagggtcgttaagggtacgggtttaaagggtagggtttaaccggg

SEQ ID NO: 239259 - DNA, 745 bp, Homo sapiens
  misc_feature: GYAE6OF01D1ZME.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccagtggactggacctggaggatcctcttcgttggtggcagcacggcctcgaggacgcccacctacccgaagggtactaggttgggtcgactaggtcggtgggggctggagggtaggaaaggaacggtccggtcggggtccctagtaggtacgacggttcctcgagcgacgggtcttgaggtactaccgtaccttccggaccgtcttaactatacctaccgtacgtggggtccaccggtaccgaccgggaccccgtagggaaaccgtagggtcgtaggacgggtggacggtacgggaacgtactaacccgtaaacccggtacggaccgggtacgactaaaccgaaaccgaacgtacaaacggtaagggttaaccgttacgggacgggtaccgtagggtaccctaacgtaacggaccgacggaacggtacctaccgtacctacgacgtaccgtacgacgttacccggtagtacggggtagtacgacgaacggtggtcgtaaggtacgtacgtccgtaacggaccggtaaccgtccggtacgttcgttacgtcgcgtaggagtacggaaggtcggtaaagtcgttagggacgtagtaacgacgtcggttaagttgggttaaggtaaagtggtaaccg

SEQ ID NO: 239260 - DNA, 928 bp, Homo sapiens
  misc_feature: GYAE6OF01BAW1N.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggagatcctcttcgttggtgcagcacgcctcgaggacgcccacctcccaggtacgaggtttggtgcgtaggtccggtgggggactggaagggtagaaaggaacggtccggtacggggtcccgttacgaaggttaggaacggttcccgttaccgtggtaccgtaacggttccgtttacgtaggtaccttaacccgtacccgttccgaaccggtacctaacttacttaccgtacccgtaggttcgggtcgacccggtaccgacccgggtaccccggtagggaaccggtaacgggttacgttagggaacggttacgggtacggttacggggaaccgttaccgtaaccccgtaaaacccgttaacccggaccgggtacggaacccgaaaacccgaaaacggtaacccgaaaccgtaacggtaaacggttaaaccggtttacgggaaacggggtaccggtaacgggttacccaaaccggtacgtaaccggaaccggtaacgggtacccgttacccgttacgtaccgtacgacccgaacgtaccgttaccgttacgggttagggaacggtacgacggtacggaaccggtaggtaggtacgtaccgttacggaacgaacccgggtacggtacccgggttaccgtttaagggttaacgttacggtacgggtaaccggtaaccggaaagggttaaaccgggtaagggtaaacggttaacgggttaacgggaacggttaccgggtaaacggttacgttacggggttaacggttaagggtttaaagggttaacgggttaacgggtttaacccgg

SEQ ID NO: 239261 - DNA, 843 bp, Homo sapiens
  misc_feature: GYAE6OF01BDTVT.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggactcctcttcgttggtggacagcagcctcgaggacgccctactcccgaggtacaggttggtgcagtcgtggggctaggaggtagaagaacgccggtagggcctacgaggtagtaacggtcctaccgtgacgaaggtccgttacgtaggtaactacctaccgttaccgtaaccggtaccttaacgtaataacgtccgtaacggttggggtacgaccgacggtaccggaccccgttacgggaacggtaacggggtccgttaggaaggttacgggtaacggtacggggtaaccggtaacttacccgtaaaacccgtaaccggtaaccgggtacggaacaaacccgaaaacgtaaccgacgtaaacgtaacggttaacgttaccggaacggggtacgtacggggtaaccaaaccgtacgtacggaaccgtagggtaaccctaccggttaccttaccggaagtacccaaacggtaccgtaaccgttaacggtagggtaacgtaacggaaaccgtacggtacgtaaggacgtacgtcgtaaccggaacgtaacgacccgggttacgtagttaacgttacgtacggacggacggtaacggtacgggaaacggtaaacggttaccggttaaggaccgggttaacgggtaagtaaacggtaacccggttaaggttaccgggtttaaagggttaaaaccgggtaaggtacggttaaaccccgg

SEQ ID NO: 239262 - DNA, 689 bp, Homo sapiens
  misc_feature: GYAE6OF01ANLRE.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcaggtgaaggtcctcctgcaaggtcttactggatacaccttcaccggctactatatccacgtgggtcgcgtacgaccggccctggacgaagggtcttggaggtggagtgggacggataccaacccgtaacgaccggtgactaaccaaacaacgacaacaggtaacgtttcgacgggacgacgggtcaaccgacgtacgaaccgaagggtaccgtaccggtaccgttaccgacgaccgaaccgacggtacccgttaacgtttacggggtaacggtttggaacggaccgtacgggtacgtaggtaacgtagttaccggttcgaaacccggaaccggttaaccggggtaccgttacggttaactttacgtcgggtacggtacgggtaacggaacgggtaagggaacgttacgttaggtacggtacggtaagtacgtacggtagttagggtaggttaaaggtaggttaaccggg

SEQ ID NO: 239263 - DNA, 801 bp, Homo sapiens
  misc_feature: GYAE6OF01EULTY.4.18.B07.1.454.CMB.1.raw
  modified_base (166)..(166): a, c, t, g, unknown or other
  misc_feature (166)..(166): n is a, c, g, or t
tcagagcactgtagcacgaccggtgctcgatttagtcgctgcgtaagggggagcatcacccagcaaccacatctgtcctctagagaactcccctgagagcctccgttcctcaccatggactggacctggagactcctctttcgttggtgcagcacgcctcaggacnccccactcccaggtactaggttggtgcagtcgtggggctggaggtagaagtaacgccgtggggcctgtagtgaacggtcctcgtgacgaacggtctcgtaggatacccgtaccttaccgacccggtactaactataactccgaacggttcggggtacgacccgaccgaccggtacccccggagggtaaaccggtaagggtccgttagggacggttaggggaacggttacggggaaacgtactaaccccgaaaccccgtaacgtacccgggtgaaccaaaccgtaaaccgaacgacaaacgagttaaaccggttcggaacggtacgaacggtaccaacgtacgtacgaaccgtaggacctaccgttctaacgacgtaccaaccgtcgtacccttaaggtacgggtaacggtacgtaacccggaggtaccggtactaacgggaacgtagttacccgtaacggaaaccggtacggtacccgggttacgttagtttaaccgtaccggttaggaccggtacgggaaagtaaccgggtaaagggaccgttaagggttaccggtaacgggttaaccgtaattaaccggtaacggtttacggttaagggtttaaaggggtttaaaccacggggtttaaacccg

SEQ ID NO: 239264 - DNA, 771 bp, Homo sapiens
  misc_feature: GYAE6OF01CBP3D.4.18.B07.1.454.CMB.1.raw
  modified_base (258)..(258): a, c, t, g, unknown or other
  misc_feature (258)..(258): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctgggaggatcctcttcgttggtggcaggcagcctcgaggacgcccacctcccaggtaactggttggtgcagtgtggggctaggaggtagaagagccgtgggcctgagtgaacggtcctctgcgaagtcttacgngactaccgtacctcgaccgtctaactactacgtccgtaggtcggtacgacgtaccggaccggtccccggtaggtaacccgtaaggggtcgttacggagggtacgggtaggtacggggtaaccggacgtaacccgaaaacccgtacccggaacggggtaccggaaccgaaaccgaaaacccggaacccgaacgaaccggtaaacggttaacgggttacggaaccgggggtaccgtacggggtaacctaaccggtacgtaaccgggtaacccggaacgggtacccgtacccgttaccgttaccgcgtaaccgacggaaccgtaccggttacggttacgggtaggtcggaacgtacgacggtacgtaggtaaccgtacgtacgacggtacccggaccgggtacggtaccgtagttacgttacgtagggtcgaacggacggtaaggaacgggtacgtagttcggacggtacgtaacgaggtacggtacgtaggttaaggtaacggtcggttaaccgg

SEQ ID NO: 239265 - DNA, 645 bp, Homo sapiens
  misc_feature: GYAE6OF01DYSZR.4.18.B07.1.454.CMB.1.raw
  modified_base (253)..(253): a, c, t, g, unknown or other
  misc_feature (253)..(253): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctgaggacgcccactcccgaggtacagttggtgcagtcgtggggctggaggtagaagaacgccgtggggcctcgagtgaagtcctctgcgaggtcttcgnggactacctaccttccgaccgcttaactatactccgagtggtcgaccgacgaccggccccgtaggacggaacgggtcgttaggaggtgggagtacggggacgtaacgtaccaaaccccgttaacggaccggtacgaacgaaccaaacgaacgacaacgaagtacgttcgaggcgacggtaccacgagtacgaaccgacggacctaccgttcctacgacgacacgacgtaccgtaggttacggaggtgacgctacggcgtaagacgattcggacggaaccgacggaccggttacgttagttacttacggtagtacggagaggaaggaacggtacggtacgtaggtacggtacgataacgtaggtacgttaggttaaggtaggtaggtaaccgg

SEQ ID NO: 239266 - DNA, 829 bp, Homo sapiens
  misc_feature: GYAE6OF01AXZEW.4.18.B07.1.454.CMB.1.raw
tcagagcactgtagcacgaccggtgctcgatttagtcgctgcgtaagggggagcatcacccagcaaccacatctgtcctctagagaactcccctgagagctcccgttcctcaccatggactggacctggaggatcctcttcttggtggcagcagcctcaggacgcccactcccaggtacaggttggtcgcgagtcgtggggctaggagggtagaaggacgccgtcggggcctcgaggtaggtacggtcctcccgtggacgtaacggtcttacgtaggaactacccgtacccttacgacccggtaccttaacttaactactcccgtacggtgggtacggccgaaccgaccggtcccccggtaaggaaccggtaacgggttccgttagggtacgggttagggaacgggtacgggggaacggtaaccgttaacccgtaaaacccccgttaaaccggtacccgggtacggaacccaaaacccgtaaaaacccgaaacgaaccgaaccgtaacggtaaacgtttaccggaacgggacgtaacgggaccacccggtacgacggaaccggacgggtaacctaccggtacttaccgactaccgaaccgtacgtacccgttaacggtacgggtacggacggacgaccggtacggtacgtacggaacgttacgaaccggtacggtaaccgaaccggtaccggttaccggttaggttaccttacggtacggtacggtacggtaaggaacgggtaaacggtacgtaacggtagggtacgggacggttaaacctacggtacgttacgggttaaggttaacgggttaaaggtacgggttaacg

SEQ ID NO: 239267 - DNA, 911 bp, Homo sapiens
  misc_feature: GYAE6OF01AJUWK.4.18.B07.1.454.CMB.1.raw
  modified_base (221)..(221): a, c, t, g, unknown or other
  misc_feature (221)..(221): n is a, c, g, or t
  modified_base (901)..(902): a, c, t, g, unknown or other
  misc_feature (901)..(902): n is a, c, g, or t
  modified_base (904)..(905): a, c, t, g, unknown or other
  misc_feature (904)..(905): n is a, c, g, or t
  modified_base (907)..(908): a, c, t, g, unknown or other
  misc_feature (907)..(908): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttctggtggcagcacgcctcaggagcccactccgaggtacagttggtgcgagtcgtggggctgaggtgaagagccgtgggcctgngtgaggtcctctgacgaggtcttcgtggactaccgtaaccttccgaccggctacgtactactccgacgtggtcgaccgacgtacggcccgtaggacgtaacgggtcttaggagtgggtacgtcgggaacgacgtaccgaaccgtaacgccggtggacaacgaacgacgcgacgagtacgttacggacgggacgtacgggtaccaccgtacgtacggaacccggtacggaaccgtaccggttacccgtttaccgaaccgtaccccgaaaccgtaaccggttaccccgttaaccgggtttacgggggtaaccggttaaggggaccccggtaaccggaaccgggtaccggggtttaacggaaccgggttaaaccgggttacccggtaaccgggtaaacccccggggtaacccggggtttaaacccccgggggttacccggggttttttaaaccggtttaaaccgggtttttaaccccgggttaggggttaaaccccgggggggtaaaaccgggttaaaaccccggggggggttaaaaaaaccggggggttttaaaacccgggggggttaaaaaaaccccggggggttttttaaaccccgggggtttttttaaaccccgggggggggaaaaacccggggggtttttttaaaaccccccccggggggtaaaaaccccggggggannanngnngcg

SEQ ID NO: 239268 - DNA, 700 bp, Homo sapiens
  misc_feature: GYAE6OF01DMSLK.4.18.B07.1.454.CMB.1.raw
  modified_base (179)..(179): a, c, t, g, unknown or other
  misc_feature (179)..(179): n is a, c, g, or t
  modified_base (309)..(309): a, c, t, g, unknown or other
  misc_feature (309)..(309): n is a, c, g, or t
  modified_base (647)..(647): a, c, t, g, unknown or other
  misc_feature (647)..(647): n is a, c, g, or t
tcagagcactgtagcacgaccggtgctcgatttagtcgctgcgtaaggggagcatcacccagcaaccacatctgtccgtctagagaatcccctgagagctccgttcctcaccatggactggacctggagatcctcttcgttggtggcagcagcctcgaggacgcccactcccgagtacnggttaggtgcgagtccgtggggctggaggtcgaagacgccgtcgggacctacgtagtacgtacggtcctccgtgacgacggtctcggtagactactaccgtcgaccgtactactatactaccgtagtggnccgagtccggtcccgtaggacccggaaggtcgttaggaggtacgaggacgggacaacctacccaaacccgtacgaccggtgaccaaacgaacgaacgcgtaagtaacggtagttccgagggcgtaacggtccaacgtcgtaacgggaccgaacgggtaacctacccggttacctcggaaacgacccgtaacggaccgttaccggtttacggcgggtaaggtacgtacccgaggtaaccggtcgtagggaccttacggttaaccgggtaaacccgacggttacccggtatttacgtaacgttcgtggtaacgacgaaaggccgtaaagggttaaacccngttaacggtcgtacgtacgagtccgtttaggtaggtaacgttgaagggtcccg

SEQ ID NO: 239269 - DNA, 845 bp, Homo sapiens
  misc_feature: GYAE6OF01AOPQS.4.18.B07.1.454.CMB.1.raw
  modified_base (188)..(188): a, c, t, g, unknown or other
  misc_feature (188)..(188): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcgaggacgcccactcccgaggtacaggttggngcagtcgtggggctggaggtgaagacgccgtgggcctgagtggaacggtcctcgtagacgaaggtcttcgtaggtactacctaccttaccgaccggtactactactactcctacggtcgggtcgaccgtaccgaccgggtaccccgtaggaaccggaacggggtcgttaggtaggtagggaggttacggggaacggtaccttaacccgtaaaccccggtaacccggtacccgggtaacggaaccgtaaaaccgaaaccggaaacccgaaccgtaaaccggtaacggtaaacggtttaccgggaacggggtacccggtaacggggtacccgtaaacccgtaacggtaaccggaaccgggtaaccgggtaacccgtaacccgttaccgttacccgaacgtaacccggaaccgtaacggttaaccccgttaacggttacggggtaacgggtacggtacggacggacgggtacggtacgaacggttaaccggtacgtacggaaccggtaccggtacccgggttaccgttacggtttaacgttacggtcggtacggaaggtacggaagggtaaaggaaccggttaaggtcggtacgggtaccgaaagttaccggaacgttacgggttaagggtaaacggttaagggtaccggtttaaacggg

SEQ ID NO: 239270 - DNA, 692 bp, Homo sapiens
  misc_feature: GYAE6OF01BL3GB.4.18.B07.1.454.CMB.1.raw
  modified_base (686)..(686): a, c, t, g, unknown or other
  misc_feature (686)..(686): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcgagggacgcccactacccgaggtacctaggtttcggtgcgaggtcgtcgggggctggagggtgaaacggaacgccgtggggcctgagtggacgtcctctgacgacggtcttacgtaggactacctaccgtaccgaccggtactactactaccgtaccgtacggtcgggtcgaccggacgtaccggcccgtacggacggtacggtcgtaggaggtacggacggtacgggacgtacgtaacccgaaaccgtacgaccggtacggaccaaccgaaacgacgacaacgtacggtaacggttacggacgggtacgtacgggtaccacgtacggtacgaaccggacggtaccgtaccgttccgtacgacgacaacgtacgtaccgtacggtcgggtagtacggacgacggacgacgtaggacgtcgtaccgacgacggacgtacggtcgttactagttacgtcggtacggacggtaggaggtaacggtacgtacgtaggtcgacggtagacgtcgtaggttaggtacggtaaggngtacgg

SEQ ID NO: 239271 - DNA, 868 bp, Homo sapiens
  misc_feature: GYAE6OF01BB0GW.4.18.B07.1.454.CMB.1.raw
  modified_base (53)..(53): a, c, t, g, unknown or other
  misc_feature (53)..(53): n is a, c, g, or t
  modified_base (276)..(276): a, c, t, g, unknown or other
  misc_feature (276)..(276): n is a, c, g, or t
tcagagcactgtagcacgaccggtgctcgatttagtcgctgcgtaagggggancatcacccagcaaccacatctgtcctctagagaatcccctgagagctccgttcctcaccatggactggacctggaggatcctcttcgttggtggcagcacgcctcgaggacgcccacctccgaggtacgtagttggtgcaggtcgtggggctaggaggtaggaaggaacggtccgtacggggcctcgtaggtaggaacggtcctccgtgacgacggtcttcgnggtaactacctaccgttccgacccggtacctacgttaactactaccgtagtcgggtcggaccgacgacccgggtcccggttacggaaccggtaacgggttccgtagggagggtgggacggtacgggggaccgtacgtaacccgtaaaaccccgtacggaacccggtggaacccaaccgtaaaacgacccgaactaacgtaaggttaaccggtttcggaacgggtccggtacggacccgtaaccgtaaggtaccggaaacccgggtaacgggaacccgttacccggttacccgtacgtaaccgacccgtaaccggaaccgttacccgttagggtttaacggggacgggttaacggaaccggtcgtaacgggtctagggtaaccgtacggtaccgtaaccggacccggtaccgggtaacccgggttacgtttaacggttaacgtttacggtcgggttacgggaacgggtaaacgggtaagggaaacgggtaacggttaagggtacggggtaaaccgggttacggaaaccggtttaacggtaacgttaggggttaacgggtttaaggggttaaaacgggttagggttaaaccggg

SEQ ID NO: 239272 - DNA, 679 bp, Homo sapiens
  misc_feature: GYAE6OF01A6NFO.4.18.B07.1.454.CMB.1.raw
  modified_base (497)..(497): a, c, t, g, unknown or other
  misc_feature (497)..(497): n is a, c, g, or t
tcagagcactgtagcacgaccggtgctcgatttagtcgctgcgtaagggggagcatcacccagcaaccacatctgtcctctagagaactcccctgagagctccgttcctcaccatggactggactggaggatcctcttcgttggtggcagcagcctagaggacgccccacctcccgaggtacagttggtgcagtcgtggggctggaggtagaagagccgtggggcctcgaggtaggaacggtcctcgtgacgaacggtcttcgtagacctaccgtaccttaccgaccggtactactatactccgtacgtgggtcgacgaccgccggtcccgtggaacggacggtcgttggaggtgggagtacgggacgtactaacccgtaaccgaacgcggtagacaacgaaacgacgacaagtacgtaagttcgaagggtcgaggcacgagacgacggagactaccggtcctagactacgactcgtaccgtacgtgggaggtgacncgagagtacgagtcgtcgacggaccgaacgtccgggttacttaaggttactacgggtcgtaacgggaacggagggtaaacggtagggtaaccgtacgggttacgggtacggtaacggtaccgttaacggtacgggttaacgggttaacggtttaagggttaaaggtaaccggggtaaaccgg

SEQ ID NO: 239273 - DNA, 728 bp, Homo sapiens
  misc_feature: GYAE6OF01B4A4O.4.18.B07.1.454.CMB.1.raw
  modified_base (161)..(161): a, c, t, g, unknown or other
  misc_feature (161)..(161): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggagatcctcttcttggtggcagcagcctcaggacnccccactccccaggtacaggttggtgcagtctggggctggaggtgaagagcgtggggactcgagtgaggtcctcgtgacgaggtcttcgtgactacctacctcgaccggtactactactactacccgacgttgggcgaccggacgaccggaccccgttaggaaccgtaaggggtctttagggaaggttggaaggtcgggtaaccggactaaccgaaacccctaaccggacggtacgaccgaaccgaaagaaccgactacgaagtaacgttcgacggtcgtaacggtccacgaagtaccggacgtacgggaccgtaccgttccgttacgacgtacacgtacgtaccgtacggtaggacggtacgacgacgacggtagtacgaacgtagttacgacgggacccgtaaccgaccgggttcgttacgttaacggttaccgtacggttcggaacgggttacggtaaagggaaacggttaaacggtacggttaacggtacggtacggttaacttacgaacgggtttaccggttagggtttaacggtttaaacgggaaggttttaaaccccggg

SEQ ID NO: 239274 - DNA, 733 bp, Homo sapiens
  misc_feature: GYAE6OF01EZIOH.4.18.B07.1.454.CMB.1.raw
  modified_base (183)..(183): a, c, t, g, unknown or other
  misc_feature (183)..(183): n is a, c, g, or t
  modified_base (233)..(233): a, c, t, g, unknown or other
  misc_feature (233)..(233): n is a, c, g, or t
tcagagcactgtagcacgaccggtgctcgatttagtcgctgcgtaaggggagcatcacccagcaaccacatctgtcctctagagaatccctgagagctccgtcctcaccatggactggacctggaggatcctcttcttggtggcagcagccttcaggacgcccaagtcccaggtacagtggtncagtctggggctggaggtcaagaagcctggggcctcgagtgaaggtctcngcgaggtctcgtggactacaccttcgaccgacgttactatactccgactgggtacgccgaccgacggtcccccgtaggtaaccgacgggtaccgttaggtaggtaggtaacggttacgggaaccgggtacttacccgtaaaccgtaaccgaacccgggtcgaacctaaaccgaaaaccgaaccggtccgaaaccgtacggtaaacggtttaccgaacggggtaccgaggggttaacccaacgtacgttaccggaaccggaacgggtaaccctaaccggtcctaccgtaacgaccgaacgaccgtaccgttacgttagggtaccggtagtaacgcgtacggacgttacgagacgtacgtacggaaccgacggtccggtaccgttacgttaacgttccgttagtcgtacggacgaaggtacgggtaagtacgggttacgttcggtaccggtaataaccgtacgttacggttaggtacggtttaaacggacggtttaacccgg

SEQ ID NO: 239275 - DNA, 766 bp, Homo sapiens
  misc_feature: GYAE6OF01CL0K6.4.18.B07.1.454.CMB.1.raw
tcagagcactgtagcacgaccggtgctcgatttagtcgctgcgtaagggggagcatcacccagcaaccacatctgtcctctagagaatcccctgagagcctccgttcctcaccatggactcggacctggaggatcctcttcgttggtggcagcagccctcaggacgcccactcccaggtacaggttggtgcgaggtcgtggggctggaggtaggaaagaacgtccggtacggggcctacggaggtaggtaacggtcctccgtcggacgaacggtctttcgaggtaactaccgtacccttcgacccggtcctaacttactactccgacggtggtcgccggacgacggccccgtaggacgtacggtcgtggacgtaggacgtacggggacgtactaccgaacccgtaacgaccgggtcgaccaaacgaaaccgaacgaccgaacgtacggtaacgttcggaacggggacgtaacgggtaccgtaaccgtaacgtacggaacccgaacgggtaacccttacccggttaccctacgtaccgccgtaaccgcggttacccgtacggttcgggaacgggtcgacggacgtacggtcgtaaggtagtaacgtccgtaacggaccggtaaccgtccgggttacggttagtttacgtcggttacggtacggtacgggaaggtagggtaaacggtacgggttaacgtggggtacggtacggattacgggaaggttaccgttaagggtttaacgggtaaaggttaacgggtacccgg

SEQ ID NO: 239276 - DNA, 627 bp, Homo sapiens
  misc_feature: GYAE6OF01BP47H.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggagcccactcccgaggtacaggttggtgctaggtcgtggggctggagggtagaaggaacgccgtggggcctacgagtgaacggtctcctgacgaaggtcttacgtggatacaccttacgaccggactactatactccacgtggtcgacgacacggcccgtaggaccgagggtcttcggagtggagtgggacgatacgaaccctaacgaccggtgacaacgaaacacgacacgagaagtttcggaagggcgacggtacacagtcgaccgacgggacacgttaccgtagacgaccgacaccgacctaggtacgggaggtacgagcgtaggcgtacgagtatcgaacggacgtacgtccggtccgtagttcgttacgtacggtcggtactacggggaagtacgggacgtagttacggggaagttacgggtaagtacgtcggtacgtagggttaggtaagtggttaaccggg

SEQ ID NO: 239277 - DNA, 815 bp, Homo sapiens
  misc_feature: GYAE6OF01BM54M.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccaggtacagttggtgcagtcgtggggctggtagggtagaagaacggtccgtcggggcctcgaggtaggtaacggttcctccgtcgacgtacggtccgttcgtacggtactacctacccttaccgacccggtaccttaacttacttactcccgtacggtgggtaccggaccgtaccggaccggtccccggtaggaaccggtacgggtccgttagggacggtgggtacggtaccggggtacggaaccgtaaccccgtaaacccgtaaccggtaccgggtacggaacctaaaccgaaacctaacgaccaacgtaacggtaacgtttcggacgggtaccgtaacgggtaccaaccgtacgtaccggaaccggtacgggtaccgtaccgtacccgttaccgaacgtacccgtaacgaccgttaacccgttacggtcggggtaaggtacggacggtacgtacggtcgtaggtaacgtagtacccggtacgaccggaacccgggtaccggtacggtttacgtaacggtttcgacgggtacgggacggtaacggaagggtaacgggtaacggttaggttaacggggtacgtacgggtaactaaccggtcggtaaggttagggttagggttaaacgttcggggttaaacccgg

SEQ ID NO: 239278 - DNA, 818 bp, Homo sapiens
  misc_feature: GYAE6OF01C05GB.4.18.B07.1.454.CMB.1.raw
tcagagcactgtagcacgaccggtgctcgatttagtcgctgcgtaagggggagcatcacccagcaaccacatctgtcctctagagaactcccctgagagcctccgttctcaccatggactcggacctggaggtattcctctttcgttgggtcggcagcacgtccctacgaacggaccgcccctacctacccgaacggtaccgtaggtttcgggtcgtacgtaggttccggtaggggcttaggggagggtaagaacgggaacgtccgggtcggggtcctacggagtacggtacgtcctcgtgacgacgttctacgacggtactacctaccttaccgaccgtactactactaccgtaccgtacgtcgggtacgacggacccgaccggcccggtaagggacggtaaccggtgttagggaaggttcggaacggtcgggaacgtacctaccgaaacccggtacggaaccgggtacgaaccaaaccgaaccgaacgcgaactaacggtaacgtacggacggacgtacggactaaccgacgacggacgtacggaccttccggtactaccgacgacaaccgtacgtacccgttaggcggtacggtagacggtaacggccggtaagtacggtacgtaacggtcgtaaccgggacggtacccgtaaccgggttcgttaacgttacggtaacggttgggacgtaaccgggaggtaacgggaacggttaacggtacggtttacggggaaacggttaacccgggtaggttaaaccgcggggtttaaacggttacgggtttaaagggtaaacgggttacccgggttaaacgg

SEQ ID NO: 239279 - DNA, 655 bp, Homo sapiens
  misc_feature: GYAE6OF01DZ1UR.4.18.B07.1.454.CMB.1.raw
  modified_base (501)..(501): a, c, t, g, unknown or other
  misc_feature (501)..(501): n is a, c, g, or t
  modified_base (512)..(512): a, c, t, g, unknown or other
  misc_feature (512)..(512): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggactcctcttcttggtggcagcagcctcgaggagcccactcccaggtacaggttggtgcaggtcgtggggctggaggtcgaagaacgccgtacggggccttacgaggtcgtaaggtcctaccgttggaccaaggtccttcgtggtaactaccgtacccttccgaaccggcttaaccttactaacgtcctaacggtgggtcgcggaaccgacggtccccttaggaaccgtaagggtccgttggaggtgggtacgtacggggacgtactaccgaaacccgtaacgtccgggacggacaaacgaaaccgagtccaagtacggtaacgttcgagggcgaggtacactagtacggaccgacggaccaccgtaccgtnacgcacgtacncgtacgtggagtgacgcgagtcgtagagtgtcgacgaccggacgtacggtcgttgttaagttacgtgggtacgacggtaggtacggaaggtacggtaagttggaacgccgtatacgagtacgtaggtaggtaacgtaggtacg

SEQ ID NO: 239280 - DNA, 763 bp, Homo sapiens
  misc_feature: GYAE6OF01CEV3H.4.18.B07.1.454.CMB.1.raw
  modified_base (536)..(536): a, c, t, g, unknown or other
  misc_feature (536)..(536): n is a, c, g, or t
  modified_base (565)..(565): a, c, t, g, unknown or other
  misc_feature (565)..(565): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctgggaggatccgtcttcgttggtacggcagcacgcctcgaggacgccccacctacccgtaaggtacctaggttggtgacgtagttccgtggggcttggagggtagaaggaacgtccggtaggggtcctacgaggtaggtaacggtcctccgtgacgtaaggtccttcgtagactaccaccctttccgaccggtactacttatactaccgacggtgggacgaccgacgaccgggtcccgtaggactaagggtcttaggaggttggagtacgggacgacttaacccgaaacccgtaacggccggacgaccgaaacaaaccgaacgacgtaacgtaacgttaacgttaccggaagggtaccggaagggtaccaacgtaagtccgaaccgaggtaccctaccgtctagacgtaccncgacgtacgtagtgggacgtagcgtacgngtactgaccgtagtccgtaagggaacccgtaacggtaccccgggttagttaaggttacccgttagttacgggcggtaaccgggaaggtaaaaccggggtaaggttaaccgttagggttaaccgggtacggttacgggtaaacttcggtaacggtttaccgttaaggggttaagttaaacgggtacgggttaaacccgg

SEQ ID NO: 239281 - DNA, 913 bp, Homo sapiens
  misc_feature: GYAE6OF01AZ5ME.4.18.B07.1.454.CMB.1.raw
  modified_base (184)..(184): a, c, t, g, unknown or other
  misc_feature (184)..(184): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtncgagtcgtggggctgaggtgaagaacgccgtggggcctcgagtagaacggtcctcctgacaaggtcttcgtggactacctaccttccgacccggtacttaccgttatactacccgtaacgttcggggtacgtaccggaaccgaccgggtacccccgttagggaaccggtaaacggggtcgtttaggacgggttacgggacggttacgggggtaaccggtaacgttacccgtaaaacccccggttaaaccggtacccgggttacgggaaccctaaaccgaaaaaccgaaacccggaaccgaaaacggtaaacggttaaaaccgggttttaccggaaacggggggtaccgaaaccgggggttaaccctacccggtaaacggtttaccggaaacccgggtaacgggggtaaccccgtaacccgggtttaaccccctttaccgggaaaccggtacccctaaaccggtaacccggttaccccggtttaaaccggtttacgggggtaacgggttacgggaacgtacggtacgggtacgtcgggtaaccgtacgttaccgtacggtaaccggaccgggtaacccgggttccgtaacggtttaaccgttacggttcggtacggtacggtaagggaagggtaacggtaaacggttaggtaacggtacgggttaacggttaagaaccggttacggtacggtttaagggtaacgggtttaagggtaacggttaaaccggg

SEQ ID NO: 239282 - DNA, 638 bp, Homo sapiens
  misc_feature: GYAE6OF01DSRYG.4.18.B07.1.454.CMB.1.raw
  modified_base (248)..(248): a, c, t, g, unknown or other
  misc_feature (248)..(248): n is a, c, g, or t
  modified_base (632)..(632): a, c, t, g, unknown or other
  misc_feature (632)..(632): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcgagtgaaggtctcctgcaaggtcttcgnggataccaccttccgacggctactatactccacgtggtgcgacgaggcccctggacgagggtcttggagtggagtgggacggactaccaacccgtaacgacggtggacaacgaaacaacgcaacgtagtaacgtttcgagggacgtacgggtacaaccgtaagtacggaccgaacgggtacctaccggttaccctttacgacgaccctaaccgaacggtccccttaacgttacggggtaggttacggaggtaccgagggtccgtaggaacgtacgtacgtaggtaaccgacgtaccgggtcccgttaggttacttacgtgtggacgaggacggagggaatacggttagacggtacgagtaacgcgtacgttaggtcgtaaaggnggtaag

SEQ ID NO: 239283 - DNA, 833 bp, Homo sapiens
  misc_feature: GYAE6OF01A71QI.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtactagttggtgcagtcgtggggctgaggtagaagagccgtgggcctgagtgagtctctgcgaggcttcgtggactacaccttcaccggtctaactatactcctacgtcgggtgaccgacgaccggccccgtaggaccggaaggggtccttaggaggtcgggagtacggggaacgagtacccgtaaaccccgttaaccgacccgggtaggaacccaaaccgaaaaccgaaccggacctaaacgaacggtaaaacggttttccggaaggggtacccgtaacggggttaccaaacccgtaacggtacggaacccggtaacggggtaacccgttaaccccggtttacccgtttaacaccggtaaccgtaaacccgtaaccggtaccccgtttaaacggttacgggggtaacgggttacgggtaaacggtaccggtaacgggtcgttaagggaaccggttacgtccggtaacgggtaacccggaaccgggtacccgggtcccggtttaagttaaccgtttacggtttcggaccggggtaacggttaaaccgggaagggtaaacgggtaaacgggtacgggttaacgggtaacgggtaacggtaacgttaaacggtcgggtacggttaaagggttacgggttaaaaagggtcgggttaacccgg

SEQ ID NO: 239284 - DNA, 702 bp, Homo sapiens
  misc_feature: GYAE6OF01A2JIW.4.18.B07.1.454.CMB.1.raw
tcagagcactgtagcacgaccggtgctcgatttagtcgctgcgtaaggggggagcatcacccagcaaccacatctgtcctctagagaatcccctgagagctccgttcctcaccatggactggacctggaggatcctcttcgttgggtggcagcagcctcaggagccccactcccaggtacaggttggtgcagtcgtggggctggaggtgaagacgccgtggggcctcgagtgaaggtctccgtgacgtaaggtcttcgtggactacaccttccgaccggcctactactactccgacgtgggtcgcgacgacggccccgtaggaccgaggtcgttgaggtggagtagggacggtactaccgaaacccgtaacgaccgggtacgaaccaaaccgaaacgaaccgaccgaacgtaacggtaacggtttaccggaggggtacgtaacggggtaccaaccgtacggtacggaacccggtagggtaacccgtaccgttaccgtacgacgtaccaaccgtacgtacgttacggtagggtagggtcgacgcggagtcgtaggtacgtgtccgtacggaccgacggtaccgggttcgtaaggttaacgttacgtggtacggtacggtagggtaagggaacggtaacggtacggttacggcggtacggtagtaacgtcgtaggttagggtaaggttaaggtaggttaaccgg

SEQ ID NO: 239285 - DNA, 730 bp, Homo sapiens
  misc_feature: GYAE6OF01B40JM.4.18.B07.1.454.CMB.1.raw
tcagagcactgtagcacgaccggtgctcgatttagtcgctgcgtaagggggagcatcacccagcaaccacatctgtcctctagagaactcccctgagagctccgttcctcacatggactggacctggagatcctcttcttggtgcagcagcctcgaggagcccactcccgaggtacagttgagcagtcgtgggctgaggtgaacgagccgtgggcctacgagtagaacggtctcgtagcgaaggtctttaccgtaggacttacctaccgttaccgaccggtacttaactattacgtaccgtaacgttcgggtcgacgaaccgacggtccccgtaggaacgaaggtcttaggaggtaggacgtacgggacgtacgtaccgaaaccgttaacgaccggtacggaaccaaccgaaaaccgaacgacgaacgaacggtaaacgtttcgacgggtacgacgggtacaacgagtacgaaccgaggacctacgtcgttcagtcactacgacttacgtaggagtagagacgacgtacgtgaacgtattacgacggaacgtaacggtaccggtacccgttaagttaacgttaacgtcggttacggtaaccggaaagggttaaacgggaacgggtaaacgttaacgggttacggtaaccgggttacgggttaaactaacggtaacggtacggtttaaccggggttaagggtttaaaaacggtggggtttaaaaccccggg

SEQ ID NO: 239286 - DNA, 813 bp, Homo sapiens
  misc_feature: GYAE6OF01BY9ME.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactccccaggtacaggttggtgctagtcgtggggctggaggtagaagacgccgtggggcctcgagtgaacggtccttccgtgacgaaggtcttcgtggtaactacctaacccgtttccgaacccggtctaaccgttaactaaccttacccgtacggttacgggggttcggacccggaaccggaccggggtaccccccgttaggggaaccgtaaacggggtccgtttaggggaacgggttaggggaacgttacggggggaaccggtaccgtaaacccgtaaaccccgtaaaccggtacccgggttaacggttaaacccaaaacgtaaccggaccaacgtaacggttaacgttacggtaacgggcgtacggggtacaacgactcggaaccgacgggacctaccgtccttacgacgacaacgacgtcctaacggttggacgggtagacggcgtacgggcgtacgagtacggtctaacggaaccggtaccgtaaccgggtccggttaacgttacgtttacgtcggtaacggccgggtaaaggacgggtaaacgggtaacgttacgggttaaggaccgggtacggtaacgtaacgagggtccggtttaaggggttaagggttaaacgggtacggggttaacgttaaccccgg

SEQ ID NO: 239287 - DNA, 835 bp, Homo sapiens
  misc_feature: GYAE6OF01A78KT.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctggaggtagaacggagtccgtggggcctgagtaggaaggtctccgtgacaaggtcttcgaggactacctacccttccgacccggtcttaacttactactacccgtaacgtgggtcgaccgacgaccggtccccgtagggaaccgaaggggtcgttagggaggtgggacggttaggggaaccggtaactaaccccgtaaacccgtaaccgaccgggtacggacaaaccgaaacgaacccgacgtaacgtaacgggtaacgtttaccggacgggtacggtaccgggtacctaaacccgtacgtaccggaaccgggaccgggtaacccgtaccccggttaccgtaacggaacccgacccgtaaccgacccgttaacccggttacggttacggggtaacgggttacggaaccggacccgggtacggtacgttaacggtaaccggtacgttaccgggacggtaacccggtaaccggggtacccggtttacggttacgtttaacggttacggtcggtacggtaacgggaacggtaaaggggtaacggtaacgggttacgggttacgggtaacgggtacggtaaacgtacggtacgggttacggttaggtttaacggggttaacgggttaacggttaaacccggg

SEQ ID NO: 239288 - DNA, 955 bp, Homo sapiens
  misc_feature: GYAE6OF01BLQQB.4.18.B07.1.454.CMB.1.raw
tcagagcactgtagcacgaccggtgctcgatttagtcgctgcgtaagggggagcatcacccagcaaccacatctgtcctctagagaactcccctgagagctccgttcctccaccatggactggacctaggaggatcctctttcgttggtggcagcacgcctcgaggacgccccaccgtcccaaggtactaggttcggtgcgtagtcgtggggctggaggtagaaagacgccgtggggcctcgagtaggaaggtcctccgtgacgaagtcttacgtaggactacctaccttccgaccggtctaactatacctccgtacgttggggtacgaccgaccgtacccgggccccggttagggaaccgtaacggggtccgttagggaggtacgggaggtcggggaacggtaaccttacccgaaaaccccgtaacggacccgggtacggaaccgaaaccgaaaccgaaaccgaccctaaacggtaacggtttaaaccggttccgggaacgggggtaccggtaaaccgggggtacccaaaccggtacgttaacccgggaaacccggttaaccggggtaaccccgttaacccggttaccccttaaccggaaacgtaccccggtaaaccgtaccggttacccgtttaacgggttacgggggtaaccggttaacgggaccgggtaacgaaccggggttcgtaacggaaacgggttacgttacccggtaacgggtaccccgggtaaacccggggttacccgggtaacccggtttaacgttaaccgtttaccgggttaacgggtccgggtaaaccggggtaacggggtaaaaccggggtaacgggttaaacgggtttacggttacgggttaaacgggttaacccggggtttaaacgaacgggtttccggttaacgggtttaaggggttttaaccgggttaaaaggggtacgggttttaaaccccggggg

SEQ ID NO: 239289 - DNA, 792 bp, Homo sapiens
  misc_feature: GYAE6OF01BD3O7.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccacctcccaggtacaggttggtgcagtcgtggggctggaggtagaaggaacggccgtcggggcctcgaggtaggaacggtcctccgtgacgaggtcttcgtggataccaccttcgaccggtctactactactccacgttgggtcgcgacgaccggccccgtaggacgaacgggtcgtggaggtggaggtcgggacggactaccgaaaccccgtacggaccgggtcgacaaaccaaacgtaaccgacaacgtaaaggtaaacgtttcggaacggggtaccgaacgggttaccaaccgtagtaccggaacccgaacgggtaacctaccggtacccgttacgacggtacccgaacgtaccggtacccttacgggttacgggtaagggtacgggaacggtaccggtacgggacttagggaacgtacgttccggtaaccgaccggtaaccggtaccgggtaccggtttacggttaaccgtttaggtcgggtaacggtacggaaacgggtaaggggtaaacggggtaaaccgttaaggggttacggtaaccggggttaaccgggtaacgttaacccggacggtttaagggtttagggggtaaacggtttaaaagggtcggggtttaaacccggg

SEQ ID NO: 239290 - DNA, 846 bp, Homo sapiens
  misc_feature: GYAE6OF01BDEVI.4.18.B07.1.454.CMB.1.raw
  modified_base (53)..(53): a, c, t, g, unknown or other
  misc_feature (53)..(53): n is a, c, g, or t
tcagagcactgtagcacgaccggtgctcgatttagtcgctgcgtaagggggancatcacccagcaaccacatctgtcctctagagaactcccctgagagctccgttcctcaccatcggactggacctggagactcctcttcttggtggcagcacgcctcgaggacgccccacctcccgaggtacaggttggtgcgagtcgtggggctggaggtagaacgagccgtcgggcctgaggtagaacggtctccgtgacgaaggtcttcgtacggactacctaccttaccgacccggtacctaacgttactacgtacctacggtcgggtcgaccgaccgacggccccgtaggaacggaacgggtccgttggaggtcgggaggtacggggtaccgaacgttacccgaaaccccgttaacggtacccgggtacgacaaaccgaaaaccaaccggaaccaacgtaacggttaacggtttaccggacggggtaccggtaacgggtaccaaaccgacggtaccggaaccgggtaacggaccttaccggttcccgttacaccgtaccgaacgtacgtaccgttacggtacgggtacggtacggaacggtccggaacggtacggttacgaacgtacgtaacgttaccgggaaccgtaacccgggtaccggttaccggttaaggttaccgttacgggttacggtacggtaccgggtaaagggaacggggtaaaccgggtaacgttaagggttacggggtaaacgggttacccgggtaaacggtaaccggttaccgggttaacggggtttaaggggtttaaacggggtttaaaccggggtaacggggtttaaaccccggg

SEQ ID NO: 239291 - DNA, 860 bp, Homo sapiens
  misc_feature: GYAE6OF01BS965.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagccgtgggcctcagtgaaggtctccgtgcaaggtcttgtggataccgtaccctttcgacccggtcttaacgttattacgttacccgaacgttcgggtacgaccggaaccgaccgggtcccccgttagggaaccgtaacggggtccttttacgggaacggttaggggtaacggttacgggggaaccggttaaccgttaacccgtaaaaccccccgttaaacggtaccccggggttacgggaccctaaaaccgaaaacccgaaccggacccgaacgttaaacggtaaacggttttccggaacggggtaccgtaacggggtacctaaccccgaaggtaccggaacccggtaacgggaacccttaaccggttacccttaccgaaacggaccccgtaaacgtaccggtaacccgtttacgggttacgggaacgggtttacggaaccgtcggtaaacgggtccttaaggaacggtacgtccgtaacgggtaaccggtaacccgtaaccgggttaccgtttaggtttaaccctttacgtcgggtacggtaaccggtaaacggaaggggtaaggtaaacggttaaccggttaggtaaacgggtacccggtaaagtacggtaggtacgtttagggttaacggttaaagggtggttaaaccggg

SEQ ID NO: 239292 - DNA, 709 bp, Homo sapiens
  misc_feature: GYAE6OF01A489P.4.18.B07.1.454.CMB.1.raw
  modified_base (108)..(108): a, c, t, g, unknown or other
  misc_feature (108)..(108): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (295)..(295): a, c, t, g, unknown or other
  misc_feature (295)..(295): n is a, c, g, or t
  modified_base (387)..(387): a, c, t, g, unknown or other
  misc_feature (387)..(387): n is a, c, g, or t
  modified_base (429)..(429): a, c, t, g, unknown or other
  misc_feature (429)..(429): n is a, c, g, or t
  modified_base (487)..(487): a, c, t, g, unknown or other
  misc_feature (487)..(487): n is a, c, g, or t
  modified_base (627)..(627): a, c, t, g, unknown or other
  misc_feature (627)..(627): n is a, c, g, or t
tcagagcactgtagcacgaccggtgctcgatttagtcgctgcgtaagggggagcatcacccagcaaccacatctgtcctctagagaatcccctgagagctccgttccncaccatggactggacctggaggatcctcttcgttggtgcagcagcctgaggacgtcccactcccaggtacagttggtgcagtcgtggggctggaggtgaagagccgtgggtcctcagtgaggtcctcngtcaaggtcttcgnggaactacaccttcgaccggtccgtatataacttccgacgtgggngtacgacgacggcccgtagacgtaggcgttagacggtggtagtagggacgatacccgaaccgtaacgaccggcgacaaccaaacgacacganacgtaacgttacgaggcgtacggtacactacggacgaaccgngggtaccacttacccgtagactaccgaaccgtacggtccttaacggtcgtaaacgggnggtccgaggacgtcgtacggtaagtacttaccggtaaccggaccgtaccgggtaaaccgggttacccgggttagtttaaccgttacggttacgggcggtaaccgggtaaagtaaggggtaaacgggttacgtaaacgggngggttaaccgttaccgggaattaaaccggtacggttacggtttaaaggggttacgggtttaaagggccgttaaacccggggg

SEQ ID NO: 239293 - DNA, 728 bp, Homo sapiens
  misc_feature: GYAE6OF01BVG9L.4.18.B07.1.454.CMB.1.raw
tcagagcactgtagcacgaccggtgctcgatttagtcgctgcgtaagggggagcatcacccagcaaccacatctgtcctctagagaactcccctgagagctccgttcctcaccatggactggacctggagatcctcttcttggtgcagcagcctcgaggacgcccactcccaggtacgtagttggtgctagtcgtggggctaggaggtagaacgacgtccgtgggacctagacggttagaaggttcctccgtggacgtaacggtctttacgaggtaactacctacccttcgaccggtactaactactactaccacgtggtcgacgtacgccggacccgtaggaacgtacggtcgttaggaggtggacgtcggggaacgtacgtaaccaaccgtaacgtaccggtacgacaaccaaacgaacgacaagaacgttacgttacgagggtaccgacgtaccacgtacgtacgaacgacggaccgtaccgttctacgacgcgaactacgtaccgttaggtcggagtcgacgcgaacggtcgtaggacgtacgtacggtacgaccggtaccgtacgggtaccgttagtttaaccgttacggtaggtaccgggtaagaacggggtaaaccggaagggtaaccgtttacgggttaacggtaccgggttaacggtaaccgtaacggttacgttacggttaagggttaaacggtttaacgggtaacggttaacccggg

SEQ ID NO: 239294 - DNA, 790 bp, Homo sapiens
  misc_feature: GYAE6OF01ASB2D.4.18.B07.1.454.CMB.1.raw
tcagagcactgtagcacgaccggtgctcgatttagtcgctgcgtaagggggagcatcacccagcaaccacatctgtcctctagagaatcccctgagagcctccgttcctcaccatggactggacctggaggatccttcttcttggtggcagcagcctcacggacgcccacctcccgaggtacagttggtgctaggtcgtggggctggaggtgaaggacgtccggtgggccctcgaggtaggaacggtctccttgacgtaacggtcttcgtaggactacctcccttacgtaccgtcttactatactccacggtgggtcgaccgacgcggccccgtaggaacgtaacgggtcgtaggtcggtagggacggtacggggacggtacctacccgaaaaccccgtaaccgggtaccgggtacggaaccaaaccgaaacccggtaaacgaccgaaacgaacggttaacggttacggacggggtaccgtacgggtacctaaccgtaacgtacggaccggaaccgggaccctaccggtcctacgtaccgacgtaaccggtacgtaccggttacggttacggggaacggttccgggacggtacggacgggtaccgtacggtaacggtacgtacgtaccggtaccggaacccgtaccgggtcccgttaacgttacgttaccggttggacggtacggtaacggaaggtaacggtaacggttacgttagggtaacgggtacggtaaaccgtcgggtaacggttacggttaagggtttaaccgggttaaggtaacggttacggg

SEQ ID NO: 239295 - DNA, 749 bp, Homo sapiens
  misc_feature: GYAE6OF01BGQJZ.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggattcctctttcttgggtggcagcacgcctcgaggacgcccacctcccgaaggtactaggtttggtgacgagttcgtggggcgtggaggtagaagacggtccggtcggggcctacgagtacgaacggttcctccgtaggacgaaggttctttcggtaggtaacctaccgtacccgttaccgacccgtattaaccgttatacctaccggtacggtcggggtacgacccgaccggtacccggtacccggtagggaacggtaacgggtcgtttaggacgggttggtacggtacggggaacctacgtaacccgaaacccgtacggtaccggacggacctaaacgaaaccacggacaacggtaacgttaggttcgaacgggtccgagggtaccaacgtagaccggaaaccggacggtaacctacccggttactaccgacgtacaaccgtactaccggttaggtacgggaggtacggacgtcggaaccgtgtaacgactgtaccgacgaccggtacgcggttcttagttactagtcggagtacggaggaaggaaggtacgtaggtaggacggtacggtaatacggtccggttaaggttaaggggttactaaagggtaggttaccgg

SEQ ID NO: 239296 - DNA, 765 bp, Homo sapiens
  misc_feature: GYAE6OF01B1WJ7.4.18.B07.1.454.CMB.1.raw
  modified_base (669)..(669): a, c, t, g, unknown or other
  misc_feature (669)..(669): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccaggtacagttggtgcgagtcgtggggctgaggtagaagacgccgtcggggcctcgagtggaaggtcctccgtgctaaggcttcgtggactaccgaccttccgaccggtctaacgtactactccgacggttgggtcgaccgaaccgaccgggcccccgtagggaaccgtaacggggtcttacgggaggttacgggacgttacgggggaacggtaacgttaaccccgaaaaccccgttaaacggacccgggttacggaaccaaaccgtaaaaaccgaaccgaccctaaacggtaaacggttaaacggtttaccggaaggggtaccgacgggttaaccaacccgtagtaccgaaccggacgggtaccctaaccggttccctacgacggtacccaacggtacgtacccttaacggttcgggaacggttcggaacgtccgagggtcgtaggaacgtacgtccgacggaaccgacggtaccggtacgttaggttacttacggngtacggacggaacggtaaggaacggtagtacggttaggtacggtacgtacgtaacgtacggttcggttagggtaacggttaagggtcggtaaccgg

SEQ ID NO: 239297 - DNA, 718 bp, Homo sapiens
  misc_feature: GYAE6OF01BCPUA.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacaggttggtgcagtcgtggggctggaggtgaagagccgtggggccctgagtgaaggtcctaccgtgaccgaaggtccttcgtaggaacttaccgacccttaccgacccggtaccttaacttactactacccgtacgttggggtacgaccgaaccgaccggtcccccgtaggaaccggaacgggttcgttaggaggttgggtaacggtggggaaccgaactacccgaaacccgtaaccgaccgggtcggaaccaaccgaaaacgaaccgacaacgaaggtaaacgtttcgacgggacgtacgggtccaacgagtacgaccgacggacaccgttcctacgagacaaccgtcgtaccgttacggtgggacggtacgacggcaggtctaggtacacgttcgtaccgacggaaccgtaccgggtacttagttaacgttaccgtggtacgtagaggtaagggaaacggtacggttaacgtcgggtaaacggtaccgtaagtaaccggtaggttacggttaaggtaagggttacggtaaggttacccgg

SEQ ID NO: 239298 - DNA, 750 bp, Homo sapiens
  misc_feature: GYAE6OF01AXF64.4.18.B07.1.454.CMB.1.raw
  modified_base (186)..(186): a, c, t, g, unknown or other
  misc_feature (186)..(186): n is a, c, g, or t
  modified_base (193)..(193): a, c, t, g, unknown or other
  misc_feature (193)..(193): n is a, c, g, or t
  modified_base (351)..(351): a, c, t, g, unknown or other
  misc_feature (351)..(351): n is a, c, g, or t
  modified_base (446)..(446): a, c, t, g, unknown or other
  misc_feature (446)..(446): n is a, c, g, or t
  modified_base (576)..(576): a, c, t, g, unknown or other
  misc_feature (576)..(576): n is a, c, g, or t
  modified_base (681)..(681): a, c, t, g, unknown or other
  misc_feature (681)..(681): n is a, c, g, or t
tcagagcactgtagcacgaccggtgctcgatttagtcgctgcgtaagggggagcatcacccagcaaccacatctgtcctctaggagaactcccctgagagctccgttcctcaccatggactcggacctggacggatccttcttcttggtggcagcacgcctgacggacgcccactcccgaggtacnggttggngccagtcgtagggctggaggtagaagacgtcgtggggtacctcgaaggtggtaacgtccgtccgtacgacgtacggtctttacggtacggaaccttaccaccgtttaccgaacccgggtaccttacgtaaccttactacccgtcggttcggggtaacnccggaacgccgggtaccccgtagggaccggtaacggtctttacggaggtccggaggttcgggaaccggtattacccgaaaccgttaccgtacggnggtaccaaacggaaactacgacgaactaacggttacgttacggacgggtacaagggttcccaacgtacgtaccggacgtaccgggactacgttccgtacgaacgacacggtacgttctaaggcggtacgngaacgcgggtacgagtacgaagtacgtcgttaacggaccggacgtaacgggtccgtacgtagtttaccggtgtaacggacggtaaacgagggtaaaggtaaccgnggtttaacgacccgggttatacgggtactacgtacggttaggtaaacgggttaaacgttcgggttaaac

SEQ ID NO: 239299 - DNA, 692 bp, Homo sapiens
  misc_feature: GYAE6OF01EWF5L.4.18.B07.1.454.CMB.1.raw
  modified_base (135)..(135): a, c, t, g, unknown or other
  misc_feature (135)..(135): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggagatcctnttcttggtggcagcagcctcgaggacgcccactcccaaggtacaggttggtgcaggtctggggcttaggaggtagaagaacgccgtggggcccttagacgtagaaggtcctacctaggcgtaaggcttcgtaggactacctacctttaccggacccggtacttaactaacttaactacccgtaaccgttggggtcgaccggtaccgtaccggtcccccgtagggaaccgaacggggtctttaggaggtaggagttcgggacggtactaccaaacccgtacgaccggtgaccaacgaaacgacgacaacgaagtaacgtttcgagggtactacggtacacagtacgaacgagggaacctcggtaccttcgagtaccacgtacgaccgtttacgtagggtaggtacgacgtacgaaggcgtagagactacgacgtacggaaccgtcggtaccggttagtaccgttatccgggtagtaccggaagagggtaaggacgttaagtacggtacgcggtaactacggtacgtacgttaggttacggttaaagtccgggtaaacg

SEQ ID NO: 239300 - DNA, 674 bp, Homo sapiens
  misc_feature: GYAE6OF01AY9QW.4.18.B07.1.454.CMB.1.raw
  modified_base (464)..(464): a, c, t, g, unknown or other
  misc_feature (464)..(464): n is a, c, g, or t
  modified_base (547)..(547): a, c, t, g, unknown or other
  misc_feature (547)..(547): n is a, c, g, or t
tcagagcactgtagcacgaccggtgctcgatttagtcgctgcgtaagggggagcatcacccagcaaccacatctgtcctctagagaactcccctgagagctccgttcctcaccatggactggacctggaggatcctcttcttggtggcagcacgcctcgaggacgcccacctcccaggtacaggttggtgcagtcgtggggctggaggtgaagacgccggtggggccctcgagtaggaacggttcctccgtggacgaaggtccgttcgtcggtactacctacccttccgacccggcttacgtactactaccgtacgtcggggtcgacgaccgaccggccccgtaggaacgacgggtcgttaggaggtggaggtcgggacgactaccgaacctaacggaccggtagaaccaaccaaacgaccgacaacgtagtaacggttagacggggtccgaggacccacgacncggaaccgacgggacctaccggtcctacgacgaccaacgtacgtaccgtaacggttgggacggttagacgtacgacggcgtanacggtactcgaggtaccgacgtccggtacgtagttacgtgtaggtcggacgaggaggaacggtacgtacggtaggtcggtacgtacgtacgtaggtacgttaggttaagtacgggtaggttacccgg

SEQ ID NO: 239301 - DNA, 697 bp, Homo sapiens
  misc_feature: GYAE6OF01EL29F.4.18.B07.1.454.CMB.1.raw
  modified_base (190)..(190): a, c, t, g, unknown or other
  misc_feature (190)..(190): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgtggtggcagcagcctcgaggacgcccactcccgaggtactagttggtgcngtcgtggggctggagtgaagacgtccgtgggcctgagtagacgtcctctgacgaggtcttcgtggactacctaccgttaccgaccgtctactactactccgtagtgggtacgccgaccgtaccggcccgtaggacgtagggtctggagtggagtagggacgactaccgaaccgacgaccggcgacaacaaacgacgacgacgtaacggtacgttacggacgggtacgtacggtaccaacgtcgtaccgaaccggacgggtaccctaccggttaccttacggaacgacccgaacgtaccgtaccgttacggtagggtacggtacgaccgtacggtacggcgtagacgtactcggtaaccggccggtaaccgtaccggtcggttacgttaaggttccgtacggaggacggtaagggagggtaacggtaacgttcggttaagggaccgggttaaccgaagtacccggtagttacggtaagggtttacggttaaaggtggttaaacccggg

SEQ ID NO: 239302 - DNA, 844 bp, Homo sapiens
  misc_feature: GYAE6OF01A18PE.4.18.B07.1.454.CMB.1.raw
  modified_base (53)..(53): a, c, t, g, unknown or other
  misc_feature (53)..(53): n is a, c, g, or t
  modified_base (79)..(79): a, c, t, g, unknown or other
  misc_feature (79)..(79): n is a, c, g, or t
  modified_base (694)..(694): a, c, t, g, unknown or other
  misc_feature (694)..(694): n is a, c, g, or t
  modified_base (723)..(723): a, c, t, g, unknown or other
  misc_feature (723)..(723): n is a, c, g, or t
  modified_base (799)..(799): a, c, t, g, unknown or other
  misc_feature (799)..(799): n is a, c, g, or t
tcagagcactgtagcacgaccggtgctcgatttagtcgctgcgtaagggggancatcacccagcaacacatctgtcctntagacgaactcccctagagacgtccttcccgtttccaccaccagttcggacctcggacctagggacgacctttcccttcgtttacggttgggacggcacgccgaccgcctacggacggtaccgcccctaccgtcccgtaaggtacgtaggtttggacggcgtacggttcggtcggggtgttgggaagggtaggaaacgtacggtcccgggttcgggtacctcggtaggttaggaaccggtttccgttacgcgtaaccggtacggtttaccttacgacggtaccttacccgtacccgttaccgtacccggttacttaaccgttacgtaccttaaccttacggggtcggtacgtaccggacccgtacccggggtacccgtacgggtaacccggtacgggttacggttacggggtaacgggttcggggtaacggggtacccggggtaaccgtaaccgttaaaaccccccggtaaccgtaaccggtacccgggttaaccgaacccaaacggtaaccgaaacgtaaccgtaacggtaaaccggtacgtacgggacggtccggaacgtccgaactacggacgaacgtcgacctacgtcctagaccgacgaccgcgttacgnggttaacgggtacgaccggagcgaacgtnacgtacgtcgacggtaccgtagggtcccgttattccggtaagttcgtacggtacgagacgggtaaggacggtacgngttacggagtacgtacacgtgttaggtgtaaggtacgcggttacg

SEQ ID NO: 239303 - DNA, 716 bp, Homo sapiens
  misc_feature: GYAE6OF01AJ9D5.4.18.B07.1.454.CMB.1.raw
  modified_base (628)..(628): a, c, t, g, unknown or other
  misc_feature (628)..(628): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacaggttggtcgcagtcgtggggctggaggtgaagacgccgtggggcctcgagtcgaaggtctccgtgacaggtcttcgaggactacctaccttcgacccggtcttacgtgtactccagtgggtgcgacgacggtccccgtaggacgaaggtcgtagacggtggacgttgggacgtacgtacccgaaaccgtaacgaccgggtaggaaccaaccgaaaacgtaacgccgaacgtaacggttaacgtttaccggaacggggtaccgtacggggttacccaaccgtaagtaccggtaacccggagggtaaccctaccggttccgtttaacgaccgaccgtaacgacctaccgttaacggttgggaacggttagacggtaccgaacggtcgttaggaacgtacgtaccggttacggaaccggacccgtacgggttccgttaagttaccgtttacgngggtaccgtaggaacggtagaaaggtacgtaggttggacgttcggtaatacggtagtaggttaggtagggttaaagtcggttaacggg

SEQ ID NO: 239304 - DNA, 790 bp, Homo sapiens
  misc_feature: GYAE6OF01EVG6H.4.18.B07.1.454.CMB.1.raw
  modified_base (298)..(298): a, c, t, g, unknown or other
  misc_feature (298)..(298): n is a, c, g, or t
tcagagcactgtagcacgaccggtgctcgatttagtcgctgcgtaagggggagcatcacccagcaaccacatctgtcctctagagaatcccctgagagctcccgttcctccaccatggactggacctgggagatccttctttcgttgggtggcagcgacgccctcgaaggacgccccacctaccccgaaggttaccaggtttggtgcgacggttccggtggggactggaggtagaaggacgccggtcgggccctagagttagaacggttccttccgaggaccgtaaggtcctttacgnggtaactaccctacccgtttaccgacccggtacttaacttatacctcccgtacggtcgggtacgaccggaaccgtacggacccccggttaggaaccggtaagggcgtttacgggtaaggtgggtacggtacggggaaccggtacctacccggtaaaaccccgtaacggtacccggggttacggaaccctaaacgaaaacccgaaacggtaacccgaaacgtaacggttaaaacggtttaccgggaacgggtacgggtaccggtaccaccgaacggtacgaaccggtacgggaaccccgtaccgttaccgtacgacgaccaacgtacctaccgtacgtagggtcggtagacggacgtcggatagtacgtcgtaacgaggaccggacgtacgtaccgttgtacgttacgtcggagtacgtaggaaggtagggaactaggtaggtacggtagggataacgtaggtcgttaaggtacggttaaggcgttaaccggg

SEQ ID NO: 239305 - DNA, 776 bp, Homo sapiens
  misc_feature: GYAE6OF01EG2VY.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgccccactcccgaggtactagttggtgcgagtcgtggggctggaggtagaaggagtccgtggggcctcgagtagaacggtcctccgtgacgaacggtcttcgtaggactactacccgttacgacccggtactactatactcctacggtgggtcgccgtacgaccggtccccgtagggaaccgtacggggtcgttaggtaggtgggtacgttacggggacgtactacccgtaaaccccgtaacggaccgggtacgaaccgtaaaccgaaaaccgtaaccggaccaacgtaaacggtaaacggtttccggaacgggggtacgtaccggggtaccaaccgtagtaccgaaccgggaacggacctaccggtacctacgacgtacccgacgtaccgtaccgttacggtacgggaaccgggttagacggacgtaggtacctaggtacgtagtccgtaggaacccggacgtaccgggtacgttacgttaacgtccgtacgggtaacgacgggtaagaacgggttaaacgggtaacgttaggggttaccggtaacgggtaccgtaacgttaacggtacggttacggtttaaggggtacgtttaaacggggaacggttaccggg

SEQ ID NO: 239306 - DNA, 799 bp, Homo sapiens
  misc_feature: GYAE6OF01C6AZP.4.18.B07.1.454.CMB.1.raw
  modified_base (53)..(53): a, c, t, g, unknown or other
  misc_feature (53)..(53): n is a, c, g, or t
  modified_base (168)..(168): a, c, t, g, unknown or other
  misc_feature (168)..(168): n is a, c, g, or t
  modified_base (669)..(669): a, c, t, g, unknown or other
  misc_feature (669)..(669): n is a, c, g, or t
tcagagcactgtagcacgaccggtgctcgatttagtcgctgcgtaagggggancatcacccagcaaccacatctgtcctctagagaatcccctgagagctccgttcctcacctagtggactggacctggagactcctcttcgttaggtggcagtcacgcctcgaggcncccactcccgaggtactaggtttggcgacaggttccgtggggacttggaggtagaagtacggcccggtcgggtacctacgaggtacggtaacgtccttaccgtaggacgtaacggttccgttacgtaaggtaacttacccgtacgttaccgaccggtacttaacttacgtacctccgtacggttaggcgtaccgtacgacccggtacccgtaggaaccgtaggtcgttaggaggtaggtacggtacggacgtacctacccgtaaaccccggtacggtaccggtaccgaaccaaaccgtaaaaccgaccgaaccgtaacggtaaacggtttaaccggtacggtaacggggtaccgtaacgggtaccctaacggtacggtaccggtaaccgggtaacgtacccgtaccgttaccgtaacgaccgaccgtacgaacgtccgttaaggtgggaacggtgacgtcgtacggtctagaccgtactcgaacggtaccgcgtaccggtntacttaggttcccgaggtacccgaggtaacgttacgggacggttaaacgtcggttaaggtacccggtaagtaacgtaaccggtttagggtacctttaaggggggtaaactacgggttggttaaacccggg

SEQ ID NO: 239307 - DNA, 672 bp, Homo sapiens
  misc_feature: GYAE6OF01E4VEL.4.18.B07.1.454.CMB.1.raw
  modified_base (163)..(163): a, c, t, g, unknown or other
  misc_feature (163)..(163): n is a, c, g, or t
  modified_base (535)..(535): a, c, t, g, unknown or other
  misc_feature (535)..(535): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcacgcctcaggacncccacgtcccgaggtactaggttggtgctaggttcgtggggctggagggtgaaaggagccggtcgggcctcgagtacgaacggttcctcctgacgaaggtccttcgtcggaactacctacccgttccgaaccggtacgttaacttactacctacccgtacgtcggggtcggaccgaccggtaccgggccccgtaggaacggtaaggtcgtaggagtggagtcgggaacgtactaacccaacccgtaaccgccggtcgaacaacaaacacccgacaacgtacgtagttacgaggtccgaggtccacgtacgtacgacgacggctaccgtcctacgacgcaccgtacgtctacggtgggacggtgacgtacggngtacgtcgagtacgtcgagaccgacggtccggtacttggttaacttcggagtcgacgggagaagggaacggtagtaaggttcggtaccggtacggacttaagtcggtacgttagggttaaggtaacggtggtaaccg

SEQ ID NO: 239308 - DNA, 504 bp, Homo sapiens
  misc_feature: GYAE6OF02G847I.4.18.B07.1.454.CMB.1.raw
tcagagcactgtagcacgaccggtgctcgatttagtcgctgcgtaaggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtccttcagcacagcctactggaggtgagcaggctgagatctgacgacacggccgtgtattactgtgcgagagaggaagacttgagtcggatacgagctggtggttagagtacgg

SEQ ID NO: 239309 - DNA, 507 bp, Homo sapiens
  misc_feature: GYAE6OF02G4YEU.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagttcaggcagggtcaccatgaccagggacacgtccttcagcacagcctactggaggtgagcaggctgagatcgtgacgacacggccgtgtattactgtgcgagagaggaagacttgagtcggatacgagtctaggtggttaagagtacgg

SEQ ID NO: 239310 - DNA, 512 bp, Homo sapiens
  misc_feature: GYAE6OF02GP8L8.4.18.B07.1.454.CMB.1.raw
  modified_base (456)..(456): a, c, t, g, unknown or other
  misc_feature (456)..(456): n is a, c, g, or t
  modified_base (505)..(505): a, c, t, g, unknown or other
  misc_feature (505)..(505): n is a, c, g, or t
tcagagcactgtagcacgaccggtgctcgatttagtcgctgcgtaagggggagcatcacccagcaaccacatctgtcctctagagaatcccctggagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtcctcagcacagccacttggaggtgagcaggctgagatctagacgacacggccgttgtattacngtgcgagagaggaagacttaggagttcggatacgagctggtggttaagngtaacgg

SEQ ID NO: 239311 - DNA, 513 bp, Homo sapiens
  misc_feature: GYAE6OF02IGWFE.4.18.B07.1.454.CMB.1.raw
  modified_base (280)..(280): a, c, t, g, unknown or other
  misc_feature (280)..(280): n is a, c, g, or t
tcagagcactgtagcacgaccggtgctcgatttagtcgctgcgtaagggggagcatcacccagcaaccacatctttcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtncgacaggcccctggacaagggcttgagtggatgggacgatcaacctaacaccggtggcacaaacaacgcacagaagttcagggcagggtcaccatgaccaggacacgtccttcagcacacgcctacgttggaggtgagcaggctgagatcgtagacgacacggccgtgtacttactgtgcgagaggaggaagacttgaggtcgatacgagctggtaggtaagaggtagtaccg

SEQ ID NO: 239312 - DNA, 518 bp, Homo sapiens
  misc_feature: GYAE6OF02HV3E0.4.18.B07.1.454.CMB.1.raw
  modified_base (461)..(461): a, c, t, g, unknown or other
  misc_feature (461)..(461): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggacacaaacaacgcacagaagtttcagggcagggtcaccatgaccagggacacgtccttcagcacagcctacgttggaggttgagcaggctagagatctagacgacacgggccgtgtattacngttgcgagagaggaagacttggagtcggatacgagctggtaggttaggagttacggg

SEQ ID NO: 239313 - DNA, 508 bp, Homo sapiens
  misc_feature: GYAE6OF02HUTLC.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtccttcagcacagcctactggaggtgagcaggctgagatctagacgacacggccgtgtattactgtgcgagagaggaagacttgagtcggatacgagctggtaggttaagagtacgg

SEQ ID NO: 239314 - DNA, 504 bp, Homo sapiens
  misc_feature: GYAE6OF02F8ZG4.4.18.B07.1.454.CMB.1.raw
  modified_base (486)..(486): a, c, t, g, unknown or other
  misc_feature (486)..(486): n is a, c, g, or t
  modified_base (498)..(498): a, c, t, g, unknown or other
  misc_feature (498)..(498): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcacatgacagggacacgtccttcagcacagcctactggaggtgagcgaggctgagatctgacgacacggccgtgtattacgtgtgcgagagaggaagacttggagtcggatacngctgtggttagngtacgg

SEQ ID NO: 239315 - DNA, 569 bp, Homo sapiens
  misc_feature: GYAE6OF02IVRDO.4.18.B07.1.454.CMB.1.raw
  modified_base (230)..(230): a, c, t, g, unknown or other
  misc_feature (230)..(230): n is a, c, g, or t
tcagagcactgtagcacgaccggtgctcgatttagtcgctgcgtaagggggaggcatcacccagcaaccacatctgtcctctagagaatcccctgagagctccgttcctcaccatggactggacctggaggatcctcttcttggtggcagcagcctcaggagcccactcccaggtacagttggtgcagtctgggctgaggtgaagaagcctggggcctcagtgaaggtcncctgcaaggcttctggatacaccttcaccggctactatatccactgggtgcgacaggcccctggacaagggcttgagtggatgggacgatcaacctaacgaccggtggacacaaacacgcacagaagttcagggcagggtcacgatgacaggacaacgtccttacagtcacgacgacctacgttgggaggtgaacgcgaagggctaggagacgttacgtgaaccgaagaccgggtccgttaggtaacttacgtcggtagtccggagaggaacgggaagtaacggtgtaacggtacggtaagtacgaaggtcgttagggtaggtttaaggaggttaacgg

SEQ ID NO: 239316 - DNA, 509 bp, Homo sapiens
  misc_feature: GYAE6OF02GXI3D.4.18.B07.1.454.CMB.1.raw
  modified_base (496)..(496): a, c, t, g, unknown or other
  misc_feature (496)..(496): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccgatgaccagggacacgtccttcagcacagcctacttggagttgagcaggctgagatctagacgacacggccgttgtacttactgtgcgagagaggaagacttggagtcgatacagctggnggttagagtacgg

SEQ ID NO: 239317 - DNA, 568 bp, Homo sapiens
  misc_feature: GYAE6OF02JLIXP.4.18.B07.1.454.CMB.1.raw
  modified_base (428)..(428): a, c, t, g, unknown or other
  misc_feature (428)..(428): n is a, c, g, or t
  modified_base (500)..(500): a, c, t, g, unknown or other
  misc_feature (500)..(500): n is a, c, g, or t
  modified_base (560)..(560): a, c, t, g, unknown or other
  misc_feature (560)..(560): n is a, c, g, or t
tcagagcactgtagcacgaccggtgctcgatttagtcgctgcgtaagggggaggcgatcacccagcaaccacatctgtccctcctagagaatccccgtcgacgagctccggttcctcaccatggactggacctggaggatcctcttcttggtggcagcagcctcaggtagcccactcccaggtacagttggtgcagtctcggggctcgaggtgaagaagcctaggggacctacagttgaacggtctccgttgcaagggcttctggatacaccttcaccggctactatatccactcgggtgcgacaggccccctggacaagggcttggagtggagtgggacgatcaaccctaacaccggtgcaacaaacacgcacagaagtttcgagggctagggtcacagtcgaccgagggacacgtccttcagccanacgcctacgtggacggttcgacgcaaggtctacgcgtactcctagaccgacgacggccgttagtacttacgngtgaccgagaggaggaaacgtacgttagaggtacggatacgacggcttaggtgggttaanggtaacgg

SEQ ID NO: 239318 - DNA, 509 bp, Homo sapiens
  misc_feature: GYAE6OF02GGDIS.4.18.B07.1.454.CMB.1.raw
  modified_base (490)..(490): a, c, t, g, unknown or other
  misc_feature (490)..(490): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgacagggacacgtccttcagcacagcctacttggacggttgagcaggctgagatctgacgacacggccgtgtattactgtgcgagagaggaagacttgagtcggagtacagngtgtggttaagagtaacgg

SEQ ID NO: 239319 - DNA, 513 bp, Homo sapiens
  misc_feature: GYAE6OF02GHDKI.4.18.B07.1.454.CMB.1.raw
  modified_base (438)..(438): a, c, t, g, unknown or other
  misc_feature (438)..(438): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtgcacaaacaacgcacagaagtttcagggcagggtcacatgacagggacacgtcttcagcacagcctacgtggaggttgagcaggctgagatcgtgacgacncggccgtgtattacgtgtgcgagaggaggaagacgttggagtcggatacgaggtctggtaggttagagtaacggg

SEQ ID NO: 239320 - DNA, 533 bp, Homo sapiens
  misc_feature: GYAE6OF02H3YOE.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaaggcttgagtggatgggacggatcaaccctaacaccggtggcacaaacaacgcacagaagtttcagggcagggtcaccatagaccgagggacacgtccttacagacacagcctacgttaggaggtgagcgaggctgagatctagacgacgacggccgtagtattactgtagcgaggagaggaagtacgttaggaaggtacggatacgaggtcgttggtaggttaagtaggtaacgg

SEQ ID NO: 239321 - DNA, 510 bp, Homo sapiens
  misc_feature: GYAE6OF02GATAR.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtccttcagcacagcctactggaggtgagcaggctgagatcagacgacgacggccgtgtattactgtgcgagagaggaagacttggagtcggatacgagtcgtggtaggttagagtacgg

SEQ ID NO: 239322 - DNA, 517 bp, Homo sapiens
  misc_feature: GYAE6OF02GP4AK.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtccttcagcacagcctacttggaggttgagcgaggctgagagtctagacgacgacggccgtgtattactgtgcgagagaggaagacgttggagtcggaatacgagcgtgtaggttagaggttacgg

SEQ ID NO: 239323 - DNA, 505 bp, Homo sapiens
  misc_feature: GYAE6OF02FHGN2.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtcttcagcacagcctactggaggtgagcaggctgagatctagacgacacggccgtgtattacgtgtgcgagagaggaagacgttagagtcggatacagctgtggtagagtacgg

SEQ ID NO: 239324 - DNA, 511 bp, Homo sapiens
  misc_feature: GYAE6OF02I6IN9.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtccttcagcacagcctactggaggtgagcaggctgagatctgacgacacggccgtgtattactgtgcgagaggaggaagtacttggagtcggatacgagctggtggttaagaggtaacgg

SEQ ID NO: 239325 - DNA, 510 bp, Homo sapiens
  misc_feature: GYAE6OF02G9432.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtccttcagcacagcctactggaggtgagcaggctgagatcgtgacgacacggccgtgtattactgtgcgagagaggaagacttggagtcgagtacgagcgtggtaggttagaggtacgg

SEQ ID NO: 239326 - DNA, 536 bp, Homo sapiens
  misc_feature: GYAE6OF02JAPPE.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggccccgtggacgaagggcttggagtgggatgggacggatcaacctaacaccggtggcacaaacacgcacagaagtttcgaggcagggtcaccatcgacagggacacgtcctacagcacacgcctactggaggtgagcaggcctaggagatcgcgacgacgaccggaccgtgtagttacgtgtgacgagaggaggaagtacgttaggaggttacggatacgaggtctaggtacggttaagaggttaacggg

SEQ ID NO: 239327 - DNA, 508 bp, Homo sapiens
  misc_feature: GYAE6OF02G71BT.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacgatcaacctacaccggtgcacaaacaacgcacagaagtttcagggcagggtcaccatgaccagggacacgtccttcagcacagcctacttggagttgagcaggctgagatctagacgacgacggccgttgtatactgtgcgagaggaggaagacgttggagtcggatacgagctggtaggttagagtacgg

SEQ ID NO: 239328 - DNA, 544 bp, Homo sapiens
  misc_feature: GYAE6OF02H6QW6.4.18.B07.1.454.CMB.1.raw
  modified_base (410)..(410): a, c, t, g, unknown or other
  misc_feature (410)..(410): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacacggcccctggacaagggcttgagtggatgggacggataccaaccctaacgaccggtggacaacaaacaacgcacagaagttcgagggacagggtcaccatcgaccgaggacacgtccttcagcanacgcctagttggaggtgagcaggctagagtatcgtagacgacgacggccgttagtacgttactgtagcgagagagggaagtacgttggaacggttcggaatacgaggtcgttaggtaggttaagaggttaacgg

SEQ ID NO: 239329 - DNA, 607 bp, Homo sapiens
  misc_feature: GYAE6OF02IF8LU.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagctggggcctcagtgaaggtctcctgcaaggcttctggatacacttcaccggctactatatccactgggtgcgacacggcccctggacgaagggcttgagtggatgggacgataccaaaccctaacaccggtggacaacaaacaacgcaacagaagtttacgagggacagggtcaccagtcgaccgaggacacggtccttcgagcaacacgtacctacgttggaggttaggagacgaaggcgtaggagagtcgtagaccgaacgacgggacccgttagttacgttacgtcgtagaccggaagaggtagggtaaacgtaaccggtttaggaacgggttaacgggaacgttaacggagggtaccgttagggtttaacgggtttaaaggagggtttaaccggg

SEQ ID NO: 239330 - DNA, 512 bp, Homo sapiens
  misc_feature: GYAE6OF02HV71I.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacgaccttcaccggctactatatccactgggtgcgacaggcccctggaccaagggccttgagtggatgggacggatcaaccctaacaccggtggcacaaacaacgcacagaagtttcagggcagggtcaccatgaccaggacacgtccttcagcacagcctacttgaggtgagcaggctgagatctgacgacacggccgtgtattactgtgcgagagaggaagacttagagtacggatacgagctggtaggttagagttaacgg

SEQ ID NO: 239331 - DNA, 510 bp, Homo sapiens
  misc_feature: GYAE6OF02H6ZNI.4.18.B07.1.454.CMB.1.raw
  modified_base (490)..(490): a, c, t, g, unknown or other
  misc_feature (490)..(490): n is a, c, g, or t
  modified_base (504)..(504): a, c, t, g, unknown or other
  misc_feature (504)..(504): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcacatgaccagggacacgtccttcagcacagcctacttggaggttgagcaggctgagatctagacgacacggccgtgttattacgtgtgcgagagaggaagacttggagtcggatacngctgtaggttaagngtacgg

SEQ ID NO: 239332 - DNA, 505 bp, Homo sapiens
  misc_feature: GYAE6OF02GGJ8K.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtccttcagcacagcctactggaggtgagcaggctgagatctgacgacacggccgtgtatactgtgcgagagaggaagacttggagtcggatacgagctggtggttagagtacgg

SEQ ID NO: 239333 - DNA, 508 bp, Homo sapiens
  misc_feature: GYAE6OF02GBLPT.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactccccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagttcagggcagggtcaccatgaccagggacacgtccttcacgcacagcctacgtggaggtgagcgaggctgagatctgacgacacggccgtgtatactgtgcgagagaggaagacttgagtcggagtacagcgtagtggttagagtacgg

SEQ ID NO: 239334 - DNA, 527 bp, Homo sapiens
  misc_feature: GYAE6OF02J0UH1.4.18.B07.1.454.CMB.1.raw
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctgggcctcagtgaaggtctcctgcaaggcttctggatacaccttcaccggctactatatccactgggtgcgacaggcccctggacaagggcttgagtggatgggacggatcaaccgtacaccggtggcacaaacaacgcacagaagttcagggcagggtcaccagtacgaccgaggacncgtccttcagcacngacctactgaggtgagcaggctggagactcgtgacgacgacggccggtagttacgttacctgtcgcggagaggaggaaggacttaggagtcggatacgaggcgtgtacgggttagagtaacggg

SEQ ID NO: 239335 - DNA, 621 bp, Homo sapiens
  misc_feature: GYAE6OF02H9YK1.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtgggcctcagtgaaggtctcctgacaaggcttcgtggatactaccttcaccggcttaactatactccacgtgggtgacgacgacggcccctggacgaagggcttgagtggagtgggacggataccaaccctaacgacggtggacaaccaaacaacgacaacaaggtaagtttacgagggacgtacgggtaccaaccgatacggaaccgtaacgggtaccaaccgttcccttacgacgacaaccgacgaccgttacgttagggtaaggtgagcgaaggtcgtagagtatcgtacgacgacgtacggtccgttagttacgttacgtggtagacgtaggacggtaaggtaaggtaccgttaggaacggttacggaagtacgtaggtcgttagggtaggttaaggagttaccgg

SEQ ID NO: 239336 - DNA, 519 bp, Homo sapiens
  misc_feature: GYAE6OF02FZ885.4.18.B07.1.454.CMB.1.raw
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcgtggatacaccttcaccggctactatatccactgggtgcgacaggcccctggacgaagggcttggagtggatgggacggatcaaccctaacaccggtggcacaaacaacgcacagaagtttcagggcaggtcacatcgacagggacacgtccttcagcacagacctactggagtgagcaggctgantcngacgacacggcgtgtattacgtgtgcgagagaggaagacgttaggaggtacggaatacgagtcgtggtagggttaagaggttaacgg

SEQ ID NO: 239337 - DNA, 507 bp, Homo sapiens
  misc_feature: GYAE6OF02HXXHE.4.18.B07.1.454.CMB.1.raw
  modified_base (347)..(347): a, c, t, g, unknown or other
  misc_feature (347)..(347): n is a, c, g, or t
  modified_base (423)..(423): a, c, t, g, unknown or other
  misc_feature (423)..(423): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacgatcaaccctacaccggtgcacaaacaacncacagaagttcaggcaggtcacatcgaccagggacacgtccttcagcacacgctacgtggagtgagcgaggctganatcagacgacacggcgtgtatactgtgacgagagaggaagtacttggagtcggatacgacgtcttagggtagttagagtaacgg

SEQ ID NO: 239338 - DNA, 512 bp, Homo sapiens
  misc_feature: GYAE6OF02FOFT7.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgagaagcctggggcctcagtgaaggtctcctgcaaggcttctggatacaccttcaccggctactatatccactgggtgcgacaggcccctggacaagggcttgagtggatgggacggatcaaccctaacaccggtggacacaaacacgcacagaagtttcagggcgagggtcaccatgacgaggacacgtcttcagcacagcctactggaggtgagcaggctgagagtctagacgacgacggccgtgtattacgtgtgcgagagaggaagagttgacgtcgatacgacgacgtggtaggttagaggtacgg

SEQ ID NO: 239339 - DNA, 528 bp, Homo sapiens
  misc_feature: GYAE6OF02JXFCN.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaacccgtacaccggtggacacgaaacacgacacagtaagttcagggcagggtcacatcgaccaggacacgtccttcagacacgagacctacgtggaggttgagcgaggctagagatcgagacgacgaccggtcgtgtatacgtgtgcgagaggaaggaagtacgtaggaggtacgatacgagccgtggttaggtaggtagtaacgg

SEQ ID NO: 239340 - DNA, 527 bp, Homo sapiens
  misc_feature: GYAE6OF02I517T.4.18.B07.1.454.CMB.1.raw
  modified_base (435)..(435): a, c, t, g, unknown or other
  misc_feature (435)..(435): n is a, c, g, or t
  modified_base (467)..(467): a, c, t, g, unknown or other
  misc_feature (467)..(467): n is a, c, g, or t
  modified_base (499)..(499): a, c, t, g, unknown or other
  misc_feature (499)..(499): n is a, c, g, or t
  modified_base (518)..(518): a, c, t, g, unknown or other
  misc_feature (518)..(518): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagagcctggggcctcagtgaaggtctcctgcaaggtcttctggatacaccttcaccggctactatatccactgggtgcgacgaggcccctggacaagggcttgagtggatgggacggatcaaccctaacaccggtgcacaaacaacgcacagaagtttcagggacagggtcaccatgaccgaggacacgtccttcagcacagcctacgttggaggttgagcgaggctgganatctgacgacgacggccgttgtattactgtgngacgagaggaacgcttaggagtacggagtacngtaccgtggtgggttaagngttaacggg

SEQ ID NO: 239341 - DNA, 530 bp, Homo sapiens
  misc_feature: GYAE6OF02GYS6Z.4.18.B07.1.454.CMB.1.raw
  modified_base (466)..(466): a, c, t, g, unknown or other
  misc_feature (466)..(466): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctggggcctcagtgaaggtctcctgcaaggcttctggatacaccttcaccggctactatatccactgggtgcgacaggcccctggacaagggcttgagtggagtgggacggatcgaaccctaacaccggtggcacaaacacgcacagaagtttcagggcagggtcaccgatgaccgagggacacgtccttcgagcacagcctacgtggaggtgagcaggctgagatcgtgacgacgacggccgtgtacttacgtgtgngagaggaggtaagacgttaggaggtacggatacgagtcgttaggtaggttaaggagttaacggg

SEQ ID NO: 239342 - DNA, 519 bp, Homo sapiens
  misc_feature: GYAE6OF02HBPQR.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagttcagggcagggtcacatgaccagggacacgtccttcagcacagcctacttggagtgagcgaggctgagatcgtgacgacgacggccgtagtagttactgtgcgagaggaggaagtacttggagtacggatacgagtcgtggtaggttaagaggttaacgg

SEQ ID NO: 239343 - DNA, 515 bp, Homo sapiens
  misc_feature: GYAE6OF02GT6DV.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtgcacaaacaacgcacagaagtttcaagggcagggtcaccatcgaccaggacacgtccttcagcacagcctactggaggtgagcaggctgagatctagacgacacggccgtgtacttacgtgtgcgtagagaaggaagacttaggagtcggatacagtcctggtaggttagagtaacgg

SEQ ID NO: 239344 - DNA, 524 bp, Homo sapiens
  misc_feature: GYAE6OF02FYNI3.4.18.B07.1.454.CMB.1.raw
  modified_base (477)..(477): a, c, t, g, unknown or other
  misc_feature (477)..(477): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcaacagaagtttcagggcagggtcaccatagaccagggacacgtccttcagcacagcctacttaggaggttgagcaggctggagatctagacgacacggccgtgtatactgtagcgagaggaggaanagttagagtacggattacgagccgtggtacggttaaggaggtaacgg

SEQ ID NO: 239345 - DNA, 546 bp, Homo sapiens
  misc_feature: GYAE6OF02IFAZG.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacacggcccctggacaagggcttgagtggatgggacggatcaaccctaacaccggtggacacaaacaacgcacagaagttcagggcagggtcacatgaccagggacacgtccttcagcacagcctagttggagttagacgcagggctgagatcgtagacgacgacggtccgttagttacttacgtgttacgcggtaggaggagggaagtacttaggaagttcggaattacgaggtccgtaggttagggttaagaggttaacggg

SEQ ID NO: 239346 - DNA, 518 bp, Homo sapiens
  misc_feature: GYAE6OF02IM4AA.4.18.B07.1.454.CMB.1.raw
  modified_base (434)..(434): a, c, t, g, unknown or other
  misc_feature (434)..(434): n is a, c, g, or t
  modified_base (473)..(473): a, c, t, g, unknown or other
  misc_feature (473)..(473): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacagggcccctgggacaaggggcttggagtggatgggacggatcaacctaacaccggtggcacaaacaacgcacagaagtttcagggcagggtcaccatgacagggacacgtccttcagcacagcctacttggaggttgagcaggctggagntctgacgacacggcgtgtattactgtgcgagagaggaanacgttggagtcggaatacgagtcgtggtaggttaagagtaacggg

SEQ ID NO: 239347 - DNA, 570 bp, Homo sapiens
  misc_feature: GYAE6OF02HQ313.4.18.B07.1.454.CMB.1.raw
  modified_base (182)..(182): a, c, t, g, unknown or other
  misc_feature (182)..(182): n is a, c, g, or t
tcagagcactgtagcacgaccggtgctcgatttagtcgctgcgtaagggggagcatcacccagcaaccacatctgtcctctagagaatcccctgagagctccgttctcaccatggactggacctggaggatcctcttcttggtggcagcagcctcaggagcccactcccaggtacagttggngcagtctggggctgaggtgaagagcctgggcctcagtgaaggtctcctgcaaggcttctggatacacctttcaccggctactatatccactgggtgcgacacggcccctggacaagggcttgagtggatgggacgatcaacccgtaagaccggtgacacaaacacgcacgagaagttcgagggcacgggtcaccgaagtcgaccgaggacacgtccgttcaacgcaacacgtcctacgttggaggttgacgacaggctgaagagtcgtagacgacgaccggtcgtagtacttactggtcgacgagtaacggacgggtaaacgtacgttaggaacggttacggagttacgaggtccgttagggttaacggttaacggaggttaaccggg

SEQ ID NO: 239348 - DNA, 515 bp, Homo sapiens
  misc_feature: GYAE6OF02HXTKQ.4.18.B07.1.454.CMB.1.raw
  modified_base (490)..(490): a, c, t, g, unknown or other
  misc_feature (490)..(490): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtccttcagcacagcctacttggaggtgagcaggctgagatctgacgacacggccgtgtacttactgtgcgagaggaggaagtacgtggacggtgagacgngtcgtggttaggtagtaggtaacgg

SEQ ID NO: 239349 - DNA, 509 bp, Homo sapiens
  misc_feature: GYAE6OF02G4IWD.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactccccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacacggtgcacaaacacgcacagaagtttcaggcagggtcaccatgaccagggacacgtccttcagcacagcctacttggaggtgagcgaggctgagatcgtgacgacgacggccgtgtacttactgtgcgagagaggaagactaggagtacggatacgagctgtaggttagagtacgg

SEQ ID NO: 239350 - DNA, 569 bp, Homo sapiens
  misc_feature: GYAE6OF02F8FHU.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttctggatacaccttcaccggctactatatccactgggtgcgacacggccccgtggacaaggggcttggagtggagtgggacggatcaaccctaacaccggtggcaacaaacaacgcacagaagttcgaggcgagggtcacgatgacgaggacacgtcctcagcacagcctacgtggagtgagcgaggctgacgatcgacgaccggacgaccggtcggttagttacgttacgtcggtaggccggaggaggaacgggaaagtaccgttaggaacggtacgggtaataacggaggtaccggttggttaacgggttaagaggttaaccggg

SEQ ID NO: 239351 - DNA, 502 bp, Homo sapiens
  misc_feature: GYAE6OF02G8MMO.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaacccctaacaccggtggacacaaacacgcacagaagttcaggcagggtcacatgacaggacacgtccttcagcacagcctactggaggtgagcaggctgagatcgtgacgcgacggcgtgtattcgtgtgcgagagaggaagacgttgagtcgatacgagctggtaggttagagtacgg

SEQ ID NO: 239352 - DNA, 530 bp, Homo sapiens
  misc_feature: GYAE6OF02JBIN9.4.18.B07.1.454.CMB.1.raw
  modified_base (448)..(448): a, c, t, g, unknown or other
  misc_feature (448)..(448): n is a, c, g, or t
  modified_base (507)..(507): a, c, t, g, unknown or other
  misc_feature (507)..(507): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggtcttctggatacaccttcaccggctaccgtatatccacttgggtgcgacaggcccctggacagggcttgagtggatgggacgatacaaccctaacgaccggtgcaacaaacaacgcacagaacgtttcagggcacgggtcaccagtcgaccgagggaccacgtccttcgagcaacacgcctacgttggaggtgagcgaggctgagatcngacgacacggccgtgtacgttactgtgcgagagaggaagtactggacgtcgaagtacgngtcgttgtaggttagagtaacgg

SEQ ID NO: 239353 - DNA, 518 bp, Homo sapiens
  misc_feature: GYAE6OF02IN1KR.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcgaaccctaacaccggtgcacaaacacgcacagaagttcaggcagggtcacatgacagggacacgtccttcagcacagcctacgttggaggtgagcaggctgagatcgtgacgacgacggccgttagtattactgtcgacgagagaggaagacgttggagtacggatacgagccgttggtaggttagaggttaacgg

SEQ ID NO: 239354 - DNA, 523 bp, Homo sapiens
  misc_feature: GYAE6OF02FGO37.4.18.B07.1.454.CMB.1.raw
  modified_base (436)..(436): a, c, t, g, unknown or other
  misc_feature (436)..(436): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccgagggacacgtccttcacgcacagcctactgggaggtgagtcaggctgagatcngaccgacgacgggtccgttgtaattcgtgtcgtcgagagaggaagacgttggagtcggaatacgagtctggtaggttagagtaacgg

SEQ ID NO: 239355 - DNA, 510 bp, Homo sapiens
  misc_feature: GYAE6OF02G7SBF.4.18.B07.1.454.CMB.1.raw
  modified_base (433)..(433): a, c, t, g, unknown or other
  misc_feature (433)..(433): n is a, c, g, or t
  modified_base (489)..(489): a, c, t, g, unknown or other
  misc_feature (489)..(489): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaacccctaacaccggtggcacaaacacgcacagaagtttcagggcagggtcaccatgaccagggacacgtccttcagcacagcctacttggaggtgagcaggctgagatcngacgacacggccgtgtacttacgtgtgcgagagaggaagacttgagtcggatacgngctggtaggttacgagtacgg

SEQ ID NO: 239356 - DNA, 510 bp, Homo sapiens
  misc_feature: GYAE6OF02IB5YG.4.18.B07.1.454.CMB.1.raw
  modified_base (502)..(502): a, c, t, g, unknown or other
  misc_feature (502)..(502): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcacatcgacagggacacgtcctcagcacagcctactggaggtgagcaggctgagatcgtgacgacacggccgtgtattactgtgcgagagagggaagacgttgaggtcggaatacgagctggtaggttagnggtaacgg

SEQ ID NO: 239357 - DNA, 557 bp, Homo sapiens
  misc_feature: GYAE6OF02J21Y1.4.18.B07.1.454.CMB.1.raw
  modified_base (243)..(243): a, c, t, g, unknown or other
  misc_feature (243)..(243): n is a, c, g, or t
  modified_base (529)..(529): a, c, t, g, unknown or other
  misc_feature (529)..(529): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctggggcctcagtgaaggtctcctgcaaggcttcnggatacaccttcaccggctactatatccacgtgggtgcgacaggcccctggacaagggcttggagtggagtgggacgataccgaaccctaacgaccggtggaccacaaacgaacgcacgagtaagttcagggcgaggtcacatcgaccgaggacacgtccttcacgcacacgtcctacgttggagtcgagcgagcgtgagtatcgtagacgacgacggtccgttagtaacgttacgagtgacggagaggtagggaaacgtcgtaggtacggtacgagtacgtaggngttaggtaagggttaggaggttaacggg

SEQ ID NO: 239358 - DNA, 515 bp, Homo sapiens
  misc_feature: GYAE6OF02F1SQD.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccaggacacgtccttcagcacagcctactggaggtgagcaggctgagatcgtgacgacgacggccgtagtacttactgtgcgagaggaggaagacttggagtcggatacgagcgttggtaggttaagagtaacgg

SEQ ID NO: 239359 - DNA, 543 bp, Homo sapiens
  misc_feature: GYAE6OF02ITHSL.4.18.B07.1.454.CMB.1.raw
  modified_base (244)..(244): a, c, t, g, unknown or other
  misc_feature (244)..(244): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcnggatacaccttcaccggctactatatccactgggtgcgacaggcccctggacaagggcttgagtggatgggacggatcaacctaacacggtggcacaaacaacgcacagaagttcaggcaggtcacatcgacaggacacgtccttcagcacagcctagttggaggtgagcaggctagagatctagacgacgacggccgttgtacgttacgtgtcgcgaggaaggagggaaacggacgttagggaacggttacgggaactaacgtaggtcgttaggttagggttaaaggaggttaacggg

SEQ ID NO: 239360 - DNA, 555 bp, Homo sapiens
  misc_feature: GYAE6OF02JH40F.4.18.B07.1.454.CMB.1.raw
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggcgtgaggtagaagaagccgtggggcctcagttgaaagggtctacctggccaagggcctttactggattacaccctttcaaccggctaacctanagtccactgggtncggacagggccccctggaccaagggccttggagtggatgggacgatcaacccgtaacaccggtgaccacgaaacaacgcaacagaagtttcagggcagggtcacgatagaccagggacacgtccttacgagcacagcctacgtggagtgagcaaggctagagatctagacgacgacggccgtagtattacgtgtagacgagagaggaagacgttagagtacggagtacgagacgtggtaggttagaggtaacgg

SEQ ID NO: 239361 - DNA, 580 bp, Homo sapiens
  misc_feature: GYAE6OF02HR2V1.4.18.B07.1.454.CMB.1.raw
  modified_base (358)..(358): a, c, t, g, unknown or other
  misc_feature (358)..(358): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcgagtgaaggtctccgtgcaaggcttcgtggatacaccttcaccggctactatatccactgggtgcgacaggcccctggacaagggcttgagtggatgggacgatcaaccctaagaccggtggacaacaaacgacgcanaagtaagttcgaggcgagggtcaccagtcgaaccgaggacacgtccttacgagcacgacgtactacgtaggaggtacggtagacaaggcgtagacgtagtcgtacggaccgtacgaccgggaccgttagttacgttacgcggttacgacggagaggaaggaacggaagttacggagtacggaattacgacggtacgttaggtaggttaaggagttaacgggg

SEQ ID NO: 239362 - DNA, 525 bp, Homo sapiens
  misc_feature: GYAE6OF02HAGJU.4.18.B07.1.454.CMB.1.raw
  modified_base (425)..(425): a, c, t, g, unknown or other
  misc_feature (425)..(425): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacgaccttcaccggctactatatccactgggtgcgacaggcccctggacaagggcttgagtggatgggacgatcaacctaacaccggtgcacaaacaacgcacagaagttcagggcagggtcaccatgaccaggacacgtccttcagcacagcctactggaggtgagcaggctgagntacgtgatcgacaccggaccgttgtaacttacgtgtacggcgagaggaaggaagagttaggagtacggatacgaagtcgtaggttaggttaagtaacggg

SEQ ID NO: 239363 - DNA, 522 bp, Homo sapiens
  misc_feature: GYAE6OF02ION98.4.18.B07.1.454.CMB.1.raw
  modified_base (472)..(472): a, c, t, g, unknown or other
  misc_feature (472)..(472): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaaggggcttgagtggatgggacggatcaaccctaacaccggtggcacaaacaacgacacagaagtttcagggcagggtcaccagtgaccagggacacgtcttcagcacagcctacttggaggtgagcaggctgagatctagacgacacgggccgtgtacttatgtgccgagaaggnggtaagacgttaggagtacggatacgagtctggtaggttagagttacggg

SEQ ID NO: 239364 - DNA, 539 bp, Homo sapiens
  misc_feature: GYAE6OF02G3GG0.4.18.B07.1.454.CMB.1.raw
  modified_base (498)..(498): a, c, t, g, unknown or other
  misc_feature (498)..(498): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttggagtggatgggacggatcaaccctaacaccggtggcacaaacacgcacagaagttcagggcagggcaccatcgaccagggacacgtccttcagcacagcctacgtggaggtgagcgaggctaggagtatcgtaggacgacgaccgggtccgtagttacgttacgtgtcgcgagaggagggaacgtacttaggnggtacggatacgaggtcttaggtaggttaggaggttaacgg

SEQ ID NO: 239365 - DNA, 538 bp, Homo sapiens
  misc_feature: GYAE6OF02GR3SL.4.18.B07.1.454.CMB.1.raw
  modified_base (480)..(480): a, c, t, g, unknown or other
  misc_feature (480)..(480): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggataccaccttcaccggctaactatactccactgggtgcgacacggcccctggacaagggtcttagagtggagtgggacggatacaacccgtaacgaccggtggaccaacaaacaacgcaacgagaacgtttcgagggcagggtacaccgatcgaccgaggacacgtccttcacgcacacgcctagtggagtgacgcaggctgagatcgagacgacgacggtccgtagtattacngtcgacgagagaggaagtactggaagtcgatacgaggcgttaggtaggtagagtacgg

SEQ ID NO: 239366 - DNA, 660 bp, Homo sapiens
  misc_feature: GYAE6OF02H54RZ.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtgggctgaggtgaagaagccgtgggcctcgaggtgaaggtctccgtgcgaaggtcttcgtggatacctaccttccgaccggtctactatactccacgtgggtcgacgacgaccggccctaggaacgaaggtcttgaggtgggagtgggaacggataccgaaacccgtaacgaccgggtcgaccaaaccaaacgaacgacaacgaggtaacgttacgaggggactacgggtacaccgagtacggaccgaggactaccgtcttacgacgacgaacgacgtaccgttacgtagggtacggtacgtacgacgacggtcgtaggaacgtacggttccaaggtaccgaccggtaccggtaccgttagttacgttacgtggtacgacggtaggacggaaggtaacgtacggttaggaaccggttacggaagtacggtacggtccggttagggttaacggttaaggacggttaacgg

SEQ ID NO: 239367 - DNA, 516 bp, Homo sapiens
  misc_feature: GYAE6OF02HTO4I.4.18.B07.1.454.CMB.1.raw
  modified_base (398)..(398): a, c, t, g, unknown or other
  misc_feature (398)..(398): n is a, c, g, or t
  modified_base (431)..(431): a, c, t, g, unknown or other
  misc_feature (431)..(431): n is a, c, g, or t
  modified_base (496)..(496): a, c, t, g, unknown or other
  misc_feature (496)..(496): n is a, c, g, or t
  modified_base (509)..(509): a, c, t, g, unknown or other
  misc_feature (509)..(509): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacacctttcaccgggctactatatccactgggtgcgacaggcccctggacaagggcttgagtggatgggacggatcaaccctacaccggtggacacaaacaacgcacagaagtttcagggcagggtcaccatgacagggacacgtccttnagcacagcctacttggaggtgagcaggctgagntctgacgacacggccgtgtacgttactgtagcggagaggaggaagacgttgaggtcggatacagntggtaggttaagngtaacgg

SEQ ID NO: 239368 - DNA, 539 bp, Homo sapiens
  misc_feature: GYAE6OF02H87Q5.4.18.B07.1.454.CMB.1.raw
  modified_base (402)..(402): a, c, t, g, unknown or other
  misc_feature (402)..(402): n is a, c, g, or t
  modified_base (462)..(462): a, c, t, g, unknown or other
  misc_feature (462)..(462): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacgaccggtggacacaaacaacgcacagaagtttcagggcagggtcacatgacagggacacgtccttcagcanacgcctacttggaggtgagcgaggctgagatctggaccacgacggccgttagtacttagngtgacgaggaggaggaacgtacgttggacggttacggagtacacggtcgttaggttacggtttaaggagttaacggg

SEQ ID NO: 239369 - DNA, 553 bp, Homo sapiens
  misc_feature: GYAE6OF02FF5T6.4.18.B07.1.454.CMB.1.raw
  modified_base (244)..(244): a, c, t, g, unknown or other
  misc_feature (244)..(244): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcnggatacaccttcaccggctactatatccactgggtgcgacaggcccctggacaagggcttgagtggagtgggacggagtcaacccctaacgaccggtggccaacgaaacaacgacacagaagtttcgagggcagggtcaccatgacagggacacgtccttcagcacacgcctacgtggaggtgaggcgacgggctgagngtcgngacgacgacggccgttagtaacttacgtgtacgcggagaggaggtaaaggacttagggtaacgtaggaagtacgaggtcgttaggtacggttaagaggttaacgg

SEQ ID NO: 239370 - DNA, 797 bp, Homo sapiens
  misc_feature: GYAE6OF02HTXGF.4.18.B07.1.454.CMB.1.raw
  modified_base (222)..(222): a, c, t, g, unknown or other
  misc_feature (222)..(222): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctgaggtgaagaagccgtggggcctnagtgaaggtctccgtgcaaggcttcgtggactaccgtaccttacgaccggcttaactactactaccgaacgttgggtcgacgaccgacggtcccctagggaaccgtaagggccgtttgaggtcggagtgggaacggtactaccgaaacccgtaacgaccggtcggacaacgaaaaccacgacaacgtaagaacgtttacgacgggacacggggtaccaaccgtaagtacggaacccgaaggggaacctaccggttaccgttacgaacgtccaaacgtaacggtacccgttaaggtttacgggaagggttacggacggtaaccggacgggtaccgtaggaaacgtacgttaaccgtacggtaacccggaaaccggtaacccgggtaccggtttaaacggtttaacggtttaaaccgtacgggttacgggaaccggtaacggggtaagggtaaacggggtaaacggttaaccgggtttaagggaaccggggtttaacgggaaccggttaaccggttaacgggttccgtttaagggggtttaaccgggttttaaaaggggaacggtttaaacccgggg

SEQ ID NO: 239371 - DNA, 538 bp, Homo sapiens
  misc_feature: GYAE6OF02GTH1R.4.18.B07.1.454.CMB.1.raw
  modified_base (288)..(288): a, c, t, g, unknown or other
  misc_feature (288)..(288): n is a, c, g, or t
  modified_base (411)..(411): a, c, t, g, unknown or other
  misc_feature (411)..(411): n is a, c, g, or t
  modified_base (438)..(438): a, c, t, g, unknown or other
  misc_feature (438)..(438): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcgagtgaaggtctccgtgcgaaggtcttcgtggatacaccttcaccggctactatatccatggtgcgacnggccctggacaagggcttgagtggagtgggacggataccaacctaacaccggtggacaacaaacaacgcaacagaagttcgagggcaggtcacatacgaccgaggacacgtcttcagcacgancctacgtggagtgagcgaggctagganagtctacgacgaacgaccggtccgttagtacgttacgtgtgcgaggaggaggtaagacgttagagtacggatacgagtagtaggtagttaggagttacgg

SEQ ID NO: 239372 - DNA, 536 bp, Homo sapiens
  misc_feature: GYAE6OF02GFZRL.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacacggcccctggacaagggcttgagtggatgggacggatccaaccctaacgaccggtggcacaaacaacgcacagaagtttcagggcagggtcacatgaccgaggacacgtccttcacgcacagcctacgttggaggtgacgcaggctgagatcgtgacgacgacggtccgtagttacttacgtgtgacggagaggaggaagacgttggaagtcggaagtacgagtcgttaggtaggttaaggaggttaacgg

SEQ ID NO: 239373 - DNA, 632 bp, Homo sapiens
  misc_feature: GYAE6OF02H10FW.4.18.B07.1.454.CMB.1.raw
  modified_base (243)..(243): a, c, t, g, unknown or other
  misc_feature (243)..(243): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagctggggcctcagtgaaggtctcctgcaaggcttcnggataccaccttcgaccggctaactatatccacgtgggtgcgacacggcccctggacaagggcttgagtggagtgggacgataccaacctacgaccggtgacaacaaacacgacacgaagaacgttcagggcacgggtacacagtcgaaccgagggaccacgtccttcacgcacgagcctacgttagggaggtgacgtcgacggtctaggacgtagtccgtaggaaccgtacgaccgggtaccggttacgttacgttacgtcggttacgggaccggtagggaacgggtaacgggtaaacggtaccgtttaggggtaacggttacgggtaacgttacggaacggtaccggtttacggggtttaagggtttaacgggtaagttaaccgggg

SEQ ID NO: 239374 - DNA, 513 bp, Homo sapiens
  misc_feature: GYAE6OF02GSRAR.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacgatcaacctacacggtggcacaacacgcacagaagttcaggcagggtcacatgaccaggacacgtccttcagcacagcctactggaggttgagcgaggctggagatcgtagacgacacgggccgttagtattacgtgtgcgagaggaggaagtacttaggagtcggatacgagtcttaggtaggttaagagtacgg

SEQ ID NO: 239375 - DNA, 521 bp, Homo sapiens
  misc_feature: GYAE6OF02HC6EC.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctggggcctcagtgaaggtctcctgcaaggcttctggatacaccttcaccggctactatatccactgggtgcgacaggcccctggacgaagggcttggagtggatgggacggatccaaccctaacaccggtggcacaaacaacgcacagaagtttcgaggcgagggtcacagtgacgagggacacgtccttcagcacagcctactggaggtgagcaggctgagatcgtagaccgacgacggcgtagtattacgtgtagcgagagaggagtacgttgaagtggactacgagtgtaggtaggttaagagtaacgg

SEQ ID NO: 239376 - DNA, 564 bp, Homo sapiens
  misc_feature: GYAE6OF02GWVHS.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgtacaggcccctggacaagggcttggagtggatgggacggatcaaccctaacaccggtggcaacaaacaacgcacagaagtttcgagggcagggtccaccgatgaccagggaccacggtccttcgagcacacgcctacgttggaggtgagcgaggctagagatcgagacggacgacggccgttagttaacttaccgtggtacgaccggtagacggagggtaagtacgttaggaacggttacggaataccgaggtccttaggtaggttaaggaggttaaccggg

SEQ ID NO: 239377 - DNA, 557 bp, Homo sapiens
  misc_feature: GYAE6OF02I0RBW.4.18.B07.1.454.CMB.1.raw
  modified_base (58)..(58): a, c, t, g, unknown or other
  misc_feature (58)..(58): n is a, c, g, or t
  modified_base (279)..(279): a, c, t, g, unknown or other
  misc_feature (279)..(279): n is a, c, g, or t
  modified_base (438)..(438): a, c, t, g, unknown or other
  misc_feature (438)..(438): n is a, c, g, or t
tcagagcactgtagcacgaccggtgctcgatttagtcgctgcgtaagggggagcatcncccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctgggcctcagtgaaggtctctgcaaggcttctggatacaccttcaccggctactatactccacgttgggncgacacggcccctaggacgaaggcttagagtggatgggacggtatacgaaccctaacgaccggtggacaacaaacacgacacgagaagttcgaggcaggtcacatcgacgaggacacgtcttacgacgcacagactacgttggaggtgagcaggctagngtatcgtagacgacgaccggcgttacgtacttacgtgtgtacgacgtaaggacggtaaggaccgttaggacggtacggaatacgacggtacgttaggtaaggttacggagttaaccggg

SEQ ID NO: 239378 - DNA, 513 bp, Homo sapiens
  misc_feature: GYAE6OF02JB7WC.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacgatcaaccctaacaccggtggcacaaacaacgcacagaagtttcagggcagggtcacatgaccagggacacgtcctcagcacagcctacgtggaggtgagcaggctggagatctagacgacacggcgtagtattactgtgcgagagaggaagtacttggagtcggatacgagcgttgtaggttaagaggttaacgg

SEQ ID NO: 239379 - DNA, 514 bp, Homo sapiens
  misc_feature: GYAE6OF02GIJT2.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggagtgggacggatcaaccctaacgaccggtggcacaaacaacgcacgagaagttcagggcagggtcaccatcgacagggacacgtcttcagcacagcctacgtggaggtgagcaggctgagatctgacgacgacgcgtgtatactgtgcgagagaggaagtacgttggacgtcggatacgagtgtaggtaggttagaggttacgg

SEQ ID NO: 239380 - DNA, 585 bp, Homo sapiens
  misc_feature: GYAE6OF02IUJ1Z.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttctggatacaccttcaccggctactatatccactggtgcgacacggcccctggacaagggcttgagtggagtgggacggataccaaccctaacgaccggtggaccaaccgaaacaaccgacaacaacgtaacgtttacgaagggtcgagggtaccaaccgatacgaaccgagggaaccaccgtcccttacgacgcaacgacgtacctacgtggaggtgagacgagcgtgagtactcgtacgacgacgacggccgttagttaacttacgtgtgacggagtacggagggtaagtacgttaggaacgtacggatacgagtcgtaggttaggttaagaggttaacgg

SEQ ID NO: 239381 - DNA, 540 bp, Homo sapiens
  misc_feature: GYAE6OF02FZ54A.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacgatcaaccctaacaccggtgcacaaacaacgcaacagaagtttcaggcagggtcacatcgacgaggacacgtccttcagcacagcctacgtggaggtgagcgaggctagagatcgtagacgacgaccgggccgttagtacttacgtgtacggacgtagaggaaggaacggtacgttaggaacgtcggaatacgaggcgttaggtaggttaaggagttaacggg

SEQ ID NO: 239382 - DNA, 529 bp, Homo sapiens
  misc_feature: GYAE6OF02JXH4L.4.18.B07.1.454.CMB.1.raw
  modified_base (283)..(283): a, c, t, g, unknown or other
  misc_feature (283)..(283): n is a, c, g, or t
  modified_base (378)..(378): a, c, t, g, unknown or other
  misc_feature (378)..(378): n is a, c, g, or t
  modified_base (489)..(489): a, c, t, g, unknown or other
  misc_feature (489)..(489): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagccctcaggagccccactcccaggtacagttggtgcagtctggggctgaggtgaagaagcctggggcctcagtgaaggtctcctgcaaggcttctggatacaccttcaccggctactatatcccactgggtncgacaggcccctggacaagggcttgagtggatgggacgatacaaccctaacaccggtggacacaaacaacgacacagaagttcaggcaggtcacntgacgaggacacgtcctgagcacagcctacgtggagtgacgacaggctagagatacgtggaccgacgaccggccgttagtacttacgtggtagacggagaggaggtaacgntaggacgtcggatacgtagcgttagtaggtagaggtacgg

SEQ ID NO: 239383 - DNA, 603 bp, Homo sapiens
  misc_feature: GYAE6OF02F0R2V.4.18.B07.1.454.CMB.1.raw
  modified_base (249)..(249): a, c, t, g, unknown or other
  misc_feature (249)..(249): n is a, c, g, or t
  modified_base (576)..(576): a, c, t, g, unknown or other
  misc_feature (576)..(576): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtctggggctgaggtgaagaagccgtggggcctcagtgaacggtctcctgcaaggtcttcgnggactaccaccttcgaccggctaactatactccacgtgggtcgcgacacggccccgtaggacgaagggtcttggagtggagtgggacgactaccaaacccgtaacgaccgggtgaccaaacgaaacacgaccaacgaagtaacgttcgagggcgtacgggtccaacgatacgaccgaggaccaccgttcctacgacgcacacgcctagtggaggtacgacgacgaggtcgtaggacgtatccgtacgaccgtaccgacggtccgttagttacgttacgtggtacgcgagaggaacgaacggtacgttaggaacggtacgaagtacgngtacgttaggtacggttagaggtacgg

SEQ ID NO: 239384 - DNA, 528 bp, Homo sapiens
  misc_feature: GYAE6OF02GRFYN.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcactatggactggacctggaggatcctcttcttggtggcagcagcctcaggagcccactcccaggtacagttggtgcagtctggggctgaggtgaagaagcctggggcctcagtgaaggtctcctgcaaggcttcgtggatacaccttcaccggctactatatccactgggtgcgacaggcccctggacaagggcttgagtggatgggacgatcaaccctaacgaccggtggcaacaaacaacgcacagaagtttcgagggcaggtcaccatcgaccagggacacgtccttcagcacacgcctactggaggtgacgcgaggctgagactcgtagaccgacgacgggtcgttagtattacgtgtcgagaggagaggaaggacttggagtcggatacgagtcgtggtaggttaagagtacgg

SEQ ID NO: 239385 - DNA, 569 bp, Homo sapiens
  misc_feature: GYAE6OF02GOOF0.4.18.B07.1.454.CMB.1.raw
  modified_base (382)..(382): a, c, t, g, unknown or other
  misc_feature (382)..(382): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttctggatacaccttcaccggctactatactccactgggtgcgacacggccccgtggacaagggcttggagtggatgggacgatcaacccgtaacgaccggtgcaacaaacaacgcacagaagttcgagggcaggtcacancgacgaggacacgtcctcacgcacacgcctacgtggaggtagacgcgaggcgtggagagtcgtacggacgaacgtacggccgttagttaacgttacgtggtacgacggagagggaaggaaaggtacgttaggaacgggttacgaacgtacgtacggtcgtaggttacgggttaaggaggttaacggg

SEQ ID NO: 239386 - DNA, 522 bp, Homo sapiens
  misc_feature: GYAE6OF02FLEZP.4.18.B07.1.454.CMB.1.raw
  modified_base (244)..(244): a, c, t, g, unknown or other
  misc_feature (244)..(244): n is a, c, g, or t
  modified_base (332)..(332): a, c, t, g, unknown or other
  misc_feature (332)..(332): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcnggatacaccttcaccggctactatatccactgggtgcgacaggcccctggacaagggcttgagtggatgggacggatcaaccctaacnccggtgcaacaaacaacgcacagtaagttcagggcagggtcaccatagaccgagggacacgtccttcagcacagcctacgtggaggtgagcgaggctgagatcgtagacgacgaccggcgtagtattctgtgcgagagaggaagtacgttgaggtacgagtacagtcgtaggtagggttagagttaacgg

SEQ ID NO: 239387 - DNA, 527 bp, Homo sapiens
  misc_feature: GYAE6OF02GGB1B.4.18.B07.1.454.CMB.1.raw
tcagagcactgtagcacgaccggtgctcgatttagtcgctgcgtaagagggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatactccactgggtgcgacaggccccctggaccaagggccttgagtggatggggacggatcaaccctaacgaccggtgacacaaacaacgacacagaattcgagggcagggtcacatcgacaggacacgtccttcagcacagcctacgttggagtgagcgaggctgagagtcgtcgacgacgacggccgttgtacttacgtgtgcgagaggaaggaagcgttagacgtcggaactacgagcgtaggtaggtaagtaacggg

SEQ ID NO: 239388 - DNA, 529 bp, Homo sapiens
  misc_feature: GYAE6OF02G6FW0.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctggggcctcgagtgaaggtctcctgcaaggcttcgtggatacaccttcaccggctactatatccactggtgcgacaggcccctggacaagggcttgagtggatgggacgatacaaccctaacgaccggtgcacgaaacaacgcacagagtttcaggcaggtcacatacgacgaggacacgtcttacagcacagcctacgttggaggttgagcgaggctagagatcgtagacgacgacggtccgtagtattacgtgtgcgagaggaaggaaggtacttggagtcggaatacgaggtcctaggtaggttagaggttaaccgg

SEQ ID NO: 239389 - DNA, 551 bp, Homo sapiens
  misc_feature: GYAE6OF02HGMEZ.4.18.B07.1.454.CMB.1.raw
  modified_base (458)..(458): a, c, t, g, unknown or other
  misc_feature (458)..(458): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccacgtgggtgcgacacggcccctggacgaaggcttgagtggagtgggacggataccaaccctacgaccggtgacaacaaacaacgcaacagtaacgtttcgacgggacgagggtaccaaccgagtcgaccgagggaccacgtccttcacgcacgacgacctacgtggagtgacgcgaggcgtgagtntcgtagacgacgacggtcgtgtattacgtgtagcgagaagaggaagtacgttggagtacggatacgagtacgtggtacggttagacccgtagg

SEQ ID NO: 239390 - DNA, 517 bp, Homo sapiens
  misc_feature: GYAE6OF02GP3SK.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcacatgaccagggacacgtccttcagcacagcctactggaggtgagcaggctggagatctagacgacacggccgttgtattactgtgacgagaggaggaagtacgttgagtcggatacgaggtctaggtaggttagaggtaacgg

SEQ ID NO: 239391 - DNA, 549 bp, Homo sapiens
  misc_feature: GYAE6OF02GBN42.4.18.B07.1.454.CMB.1.raw
  modified_base (282)..(282): a, c, t, g, unknown or other
  misc_feature (282)..(282): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagccgtggggcctcgagtgaaggtctcctgcaaggcttcgtggatacaccttcaccggctactatatccactgggtncgacaggcccctggacaagggcttggagtggagtgggacggatcaaccctaacgaccggtgcaacaaacaacgcacagtaagtttcgagggcagggtcacgatacgaccgagggacacgtccttcagacacacgcctacgtggaggttgagcgaggctagagactcgtacggacgaccgacggtccgtagttattacgtgtcgacgagaggaggaagtacgttaggacgtacggatacgacgtgtaggtaggttaaggagttaacgg

SEQ ID NO: 239392 - DNA, 664 bp, Homo sapiens
  misc_feature: GYAE6OF02HSONV.4.18.B07.1.454.CMB.1.raw
  modified_base (219)..(219): a, c, t, g, unknown or other
  misc_feature (219)..(219): n is a, c, g, or t
tcagagcactgtagcacgaccggtgctcgatttagtcgctgcgtaaggggagcatcacccagcaaccacatctgtcctctagagaatcccctgagagctccgttcctcaccaatggactggacctggaggatcctcttcttggtgcagcagcctcaggagcccacctcccaggtacagttggtgcagtctggggctgaggtgaagaagcctggggcctnagtgaaggtctcctgcaaggtcttcgtggatacaccttcaccgctactatatccactgggtgcgacaggccccttggaacaaagggtcttgagtggagtgggacgagtccaacctaacgaccggtggacaacaaaacaacgcaactaagaagtttacaggggcaacggggtcaacgtaactacgaaccgaggggtaacctaaccgggttcccctttagacgaccacgaaacggtcccttaacggttagggtaagggtcggtaaacgcgacggtacctgaacggaattccgtaagaacgaaccgaaccggtcccggtttagttaacgttaaccgttagagggacccgtaaggacggaaaggtaaaacggcgtttaagggacgttaacgggaacgtttacggaacccgttagttacggtttagggtttaaacgtagggttaaaccgg

SEQ ID NO: 239393 - DNA, 536 bp, Homo sapiens
  misc_feature: GYAE6OF02HXH69.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcgagtggaaggtctcctgcaaggcttctggatacaccttcaccggctactatatcccactgggtgcgacaggcccctggacaagggcttgagtggatgggacggatcaaccctaacgaccggtggacacaaacacgcacagaagtttcagggcaggtcaccatgacagggacacgtccttcagcacacgcctacgttggacggtgagcgaggctagagctcgtgacgacgacggccgttgtaacttcgtagtgacgtagaggtaaggaagtacgttgacggttacgatacgagcgttggtaggttagagttaacggg

SEQ ID NO: 239394 - DNA, 587 bp, Homo sapiens
  misc_feature: GYAE6OF02GIQ79.4.18.B07.1.454.CMB.1.raw
  modified_base (448)..(448): a, c, t, g, unknown or other
  misc_feature (448)..(448): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcgagtgaagggtcctccgtgcaaggcttctggatacaccttcaccggctactatatccactgggtgacgacacggcccctggacgaagggcgttgagtggagtgggacggatacaaaccctaacaccggtggacaacaaacaacgcacagaacgtttacgaggggacagggtccaccagtcgacgaggacacgtcttacgagacacacgtcctacgttacggaggtagngacgaggctgacgagtcgagaccgacgaccggtcgttgttacttacgtcgtagaggaggaaggaagggaacggtacgttaggtaggtaccggtaagtaccggtaggtcgttaggttagggttaacggtaggttaaccgg

SEQ ID NO: 239395 - DNA, 535 bp, Homo sapiens
  misc_feature: GYAE6OF02FWCRZ.4.18.B07.1.454.CMB.1.raw
  modified_base (527)..(527): a, c, t, g, unknown or other
  misc_feature (527)..(527): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaacccctaacaccggtggcacaaacaacgcacagaagtttacagggcagggtcaccatcgacgagggacacgtccttcacgcacagcctactggaggtgagcgaggctggagactcgagacgacgaccggcgtagtacttacgtgtgtcgagacggagggaagacgttaggaggtcgagtacgaggccgtaggtcgggttaaggnggtaacgg

SEQ ID NO: 239396 - DNA, 527 bp, Homo sapiens
  misc_feature: GYAE6OF02GCOYG.4.18.B07.1.454.CMB.1.raw
  modified_base (520)..(520): a, c, t, g, unknown or other
  misc_feature (520)..(520): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcaacaaacaacgcacagtaagtttcagggcagggtcacatcgaccagggacacgtcctcacgcacacgcctacgttggaggttgagcgaggctgagtatcgtgaccgacgacggtccgtatacttacgtgtgcgagaggaggaagtacttggagtcggatacgagcgtaggtaggttaagngtaacgg

SEQ ID NO: 239397 - DNA, 643 bp, Homo sapiens
  misc_feature: GYAE6OF02HHKH9.4.18.B07.1.454.CMB.1.raw
  modified_base (247)..(247): a, c, t, g, unknown or other
  misc_feature (247)..(247): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagaagccgtggggcctcagtgaggtctccgtgacaaggcttcnggataccaccttcaccggctactatactccacgtgggtgcgacacggcccctggacgaagggcttggagtggagtgggacgataccaaacccctaacgaccggtggaccaaccaaacaacgacaacaagtaagtttcgaggggacagggtacaccgagtcgaaccgacgggactaccgtccttacgacgacacacgtcccttaacgttcgggaaggtgacggacgacggcgtacggagacgttcgtacgaacggaccgaccgggtccgttagttaacgtttaccgtaggtacgtacggaggaagggtaacgggaaacggttacggttaggaacgggttacgggtaagtacgtacggtacgttagggtttaacgggttaaggtacggtttaaccggg

SEQ ID NO: 239398 - DNA, 521 bp, Homo sapiens
  misc_feature: GYAE6OF02GQ54D.4.18.B07.1.454.CMB.1.raw
  modified_base (434)..(434): a, c, t, g, unknown or other
  misc_feature (434)..(434): n is a, c, g, or t
  modified_base (469)..(469): a, c, t, g, unknown or other
  misc_feature (469)..(469): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttggagtggatgggacgataccaaccctaacgaccggtggacaacaaacaacgcacagaagtttcgaggcagggtcacatcgaaccgaggacacgtccttcgagacacacgctacgttggagtgagcaggcngagatctacgacgacgacggccgttgtacttacgngtgacgagagaggaagtacgtgagtcgatacgagcgtggtagtagagtacgg

SEQ ID NO: 239399 - DNA, 553 bp, Homo sapiens
  misc_feature: GYAE6OF02FRX96.4.18.B07.1.454.CMB.1.raw
  modified_base (335)..(335): a, c, t, g, unknown or other
  misc_feature (335)..(335): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagccgtgggcctcagtgaaggtctcctgcaaggcttctggataccaccttcaccggctactatatcccatgggtgcgacacggcccctggacgaagggcttgagtggatgggacggatccaaccctaacnccggtggccaacaaacacgccacagtaacgttcagggcagggtcaaccatcgaccagggacacgtccttcagccacacgcctacgtggaggtcgagcagggctgagactcgtagacggacaccgggtccgttagtactttacgtgtcgacgagagagggaagtaccgttaggacgtcgggaatacgacggtcgttaggtaggttaaggaggttaacgg

SEQ ID NO: 239400 - DNA, 523 bp, Homo sapiens
  misc_feature: GYAE6OF02G86F1.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcgtggatacaccttcaccggctactatatccactgggtgcgacaggcccctggacaagggcttgagtggatgggacggatcaaccctaacaccggtggcacaaacaacgcacagaagtttcagggcagggtcaccgatcgaccaggacacgtccttcagcacagcctacttggaggtgagcgaggctagagatcgtgacgacacggccgtgtacttactgtgcgagagaggaagacttaggagtcggaatacgagtccgtaggtagggttagaggtaacgg

SEQ ID NO: 239401 - DNA, 576 bp, Homo sapiens
  misc_feature: GYAE6OF02GI5CN.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgagtgaagaagcctgggcctcagtgaaggtctccgtgcaaggcttctggatacaccttcaccggctactatactccactgggtgcgacacggcccctggacaagggcttgagtggatgggacgatcaaccctaacaccggtggacaacaaacacgacacagaagttcgagggcagggtcaccgagtcgaccgaggactacgtctcacgcacacgcctaactggacgtggagtacgaggcgtgagacgtcgtacgacgtaccgacggtaccgttgttaacgttacgtggtacgacggagtagggaacggtaacggtaactttagggacgttacgggtaactacgtacggtacgtagggttaggtttaacggaggtaccggg

SEQ ID NO: 239402 - DNA, 532 bp, Homo sapiens
  misc_feature: GYAE6OF02F2H3L.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctggggcctcagtgaaggtctcctgcaaggcttctggatacaccttcaccggctactatactccactgggtgcgacacggcccctggacaagggcttggagtggagtgggacggataccaaccctaacgaccggtggacaacaaacaacgcacagaagtttcagggcagggtcacatgacaggacacgtccttcagcacacgtcctacgtggaggtgagcgaggctgagatcgtagacgacgacggccgttagtattacgtgtcgacgagaggaggaagtacttaggagtcggagtacgagtcgtaggtaggttaagagtacgg

SEQ ID NO: 239403 - DNA, 527 bp, Homo sapiens
  misc_feature: GYAE6OF02GB79D.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagaagcctggggcctcagtgaaggtctcctgcaaggcttctggataccaccttcaccggctactatatccactgggtgcgacacggcccctggacaagggcttggagtggagtgggacgatccaacctaaccgacggtgcaacaaacaacgcacagaagttcagggcaggcacatacgacagggacacgtcctcagcacacgacctacgtgggagtcgagcgagacgtgagatcgtagacgacgacggccgttacgttattacgtgtcgcgagaggaggaagacgttggagtcggatacgagtcgttggtaggtagagtacgg

SEQ ID NO: 239404 - DNA, 583 bp, Homo sapiens
  misc_feature: GYAE6OF02H4DQF.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctccgtgcaaggcttcgtggatacaccttcaccggctactatactccactgggtgcgacacggcccctggacgaagggcttgagtggagtgggacgatacaacctaacgaccggtggacacaaacacgcaacagaagttcagggcagggtccacgatcgacgaggacacgtcttcacgcacgacgcctagttaggaggttgaagcgaggctaggacgtagtccgtagaccgacgaccgggtccgttacgtaacgttacgtgttacgacgtagacggtaacggaacggtacgttagggaacgttacggaatacgtaacggtcgttaaggttacgggtttaaggtaggttaaccggg

SEQ ID NO: 239405 - DNA, 605 bp, Homo sapiens
  misc_feature: GYAE6OF02FRO0U.4.18.B07.1.454.CMB.1.raw
  modified_base (536)..(536): a, c, t, g, unknown or other
  misc_feature (536)..(536): n is a, c, g, or t
  modified_base (578)..(578): a, c, t, g, unknown or other
  misc_feature (578)..(578): n is a, c, g, or t
  modified_base (597)..(597): a, c, t, g, unknown or other
  misc_feature (597)..(597): n is a, c, g, or t
tcagagcactgtagcacgaccggtgctcgatttagtcgctgcgtaagggggagcatcacccagcaaccacatccgtctctagagaataccctcgagagctccgttcctcaccactggacgtggaccgtggagggatcctccttctttggttgggcgagcgagcctccaggaggccccacctcccacggtacacgttggtgcagtcgtgggcgtgaggtggaagaagccgtggggccgtcagtgaaggtctcctgcaaggcttctggatacacctccaccggcgtactatatccacgtgggtgcgacacggccccgtcggacagggcttgaggtggacgtggggacggatccaacccgtaacgaccggtcggacaaccaaaacgaacgcacaagtaacgtttcgagggcgaagggtcaacccagtacggacccaaggggaacctacgtccttcaagcaacacgaccttacgtgggaggtacggcgacgacggctaggacgatccgaggaccgacgcgggtcccgttatagttaccgnggtcgacggagaggagggaatcgttaggagtacgggatacgngcgttagggtgttaaaggngtaggtcc

SEQ ID NO: 239406 - DNA, 517 bp, Homo sapiens
  misc_feature: GYAE6OF02FSKCZ.4.18.B07.1.454.CMB.1.raw
  modified_base (495)..(495): a, c, t, g, unknown or other
  misc_feature (495)..(495): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggagtgggacggatcaaccctaacaccggtggcacaaacaacgcacagaagtttcagggcagggtcaccatcgaccgagggacacgtccttcagcacagcctactggaggtgagacaggctgagatctagacgacgacgggccgtagtatacgtgtgcgagagaggaagacgttgagtcggatacgngtcgtggtaggtagaggtacgg

SEQ ID NO: 239407 - DNA, 806 bp, Homo sapiens
  misc_feature: GYAE6OF02IU7LF.4.18.B07.1.454.CMB.1.raw
  modified_base (247)..(247): a, c, t, g, unknown or other
  misc_feature (247)..(247): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcgtgggcctcgagtgaaggtcctcctgacaaggtcttcgnggatacaccttcgaccggactactatactccacgtgggtcgcgacaccgggccccgtagggacgaacggggtccttagggaggttagggagttacggggaaccggtactaccgaaacccgtaaccgaccgggtacggaccaaaccgaaaccgaacggtaccgaagtacggtaacggtttacggaacggggtaccgaacggggtaccaaccgtaacgtacggaacccgggtaagggtaccccgtaaccgtttacccggttaccgaacggtaacccgtaaccggtaaccggtacccgttttaaaccggggttcggggtaacgggttaacggaccgggttaacggtaacgggtacgtaacggtaagggtacctttacgaaccgggtaaccggtaacccggtaaccgggtccggtttaacgtttaaaccgtttcgtaagggttccggaacgggtaacggaacggggaaggtaaacggttaacggttacgggtacgggttacgggtaacgttacggtacggttaccggttaagggtttacgggttaacggtagggtttacccgg

SEQ ID NO: 239408 - DNA, 606 bp, Homo sapiens
  misc_feature: GYAE6OF02G4FJQ.4.18.B07.1.454.CMB.1.raw
  modified_base (249)..(249): a, c, t, g, unknown or other
  misc_feature (249)..(249): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagaagccgtggggcctcgagtgaaggtctcctgcaaggcttcgnggatacaccttcaccggctactatactcctacgtgggtgcgacacggccccgtggacgaagggtcttaggaggtggagtgggacggataccgaaccctaacgaccggtcggacaacaaaccaacgacacagtaagtttcgagggcaggtcacatacgaccgaggacaccgtccttcacgcacacgccttacgtggaggtgagcgagcgtgagtagtcgtacgacgacgtaccggtcgttacgttaacgttacgtgtacggaccggaggaacggtaagggtaacgtaacggttacggtaacggtacggtaagtacgtacggtaccgttagggttaacgggtttaagaggttaaccggg

SEQ ID NO: 239409 - DNA, 527 bp, Homo sapiens
  misc_feature: GYAE6OF02FLGL7.4.18.B07.1.454.CMB.1.raw
  modified_base (519)..(519): a, c, t, g, unknown or other
  misc_feature (519)..(519): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctgggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccgatgaccagggacacgtccttcagcacagcctacttggaggttgagcaggctggagatcgtagacgacgacggccgtgtaacgttactgtgcgagaggaggaacgtacgttaggagtcggatacgagctaggtacggttagnggtaacgg

SEQ ID NO: 239410 - DNA, 543 bp, Homo sapiens
  misc_feature: GYAE6OF02FUW4C.4.18.B07.1.454.CMB.1.raw
  modified_base (485)..(485): a, c, t, g, unknown or other
  misc_feature (485)..(485): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagccccactcccaggtacagttggtgcagtctggggctgaggtgaagaagccgtggggcctcagtgaaggtctcctgcaaggcttctggatacaccttcaccggctactatatccactgggtgcgacacggcccctggacgaagggcttgagtggatgggacggatacaaccctaacaccggtggacacaaacaacgcacgagaacgtttcgagggtcgagggtccaccgatacgaccgagggaacaccgtccttcacgccacacgcctactgggagtagacgcgaggctgagatccgtagacgacgacggccgtagtattactgngcgagagaggaagtacgtagacgtacgatacgagtcgtaggtggtaagaggttaacgg

SEQ ID NO: 239411 - DNA, 533 bp, Homo sapiens
  misc_feature: GYAE6OF02GCO5T.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgagaagcctgggcctcagtgaaggtctcctgcaaggcttctggatacaccttcaccggctactatatccactgggtgcgcaggcccctggacaagggcttgagtggatgggacggatcaacctaacaccggtggcacaacaacgcacagaagtttcacgggcagggtcaccatagaccagggacacgtccttcagcacagcctactggaggtgagcgaggctgagactcgtgacgacgacgggccgttgtacttacgtgtgcggtagaagacgggaaggaccttggacggttacggatacgaggtactggttaggttaacgtaggtaacggg

SEQ ID NO: 239412 - DNA, 516 bp, Homo sapiens
  misc_feature: GYAE6OF02HYVKE.4.18.B07.1.454.CMB.1.raw
  modified_base (451)..(451): a, c, t, g, unknown or other
  misc_feature (451)..(451): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcgagtgaaggtctcctgcaaggcttctggatacaccttcaccggctactatatccactgggtgcgacaggcccctggacaagggcttgagtggagtgggacggatcaaccctaacaccggtgcacaaacacgacacagaatttcgaggcaggtcacgatgacgaggacacgtcctcagcacagcctatggagtgagcgagctggagagtcagacgacacggcgtgtaacttcngtgcgagaggaggaagtacgttaggagtcggagtacgagccgttaggtaggttagaggttaacgg

SEQ ID NO: 239413 - DNA, 553 bp, Homo sapiens
  misc_feature: GYAE6OF02F9EGM.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctggggcctcagtgaaggtctcctgcaaggcttcgtggatacaccttcaccggctactatatccactgggtgcgacaggcccctggacaagggcttggagtggagtgggacggatcaaccctaacaccggtgcacaaacacgcacagaagttcaggcaggtcacgatgaccgaggacacgtccttacgacgcacgacgcctacgttggaggtgacgacgaggctgaagtatcgtagacgaccgaacggtccgttagtacttacgtgtcgacgagaacggaggaacggtacttaggacggttacggaagtaccgtaggtcgttaggtaggttaaggagttaacggg

SEQ ID NO: 239414 - DNA, 630 bp, Homo sapiens
  misc_feature: GYAE6OF02GT0UM.4.18.B07.1.454.CMB.1.raw
  modified_base (522)..(522): a, c, t, g, unknown or other
  misc_feature (522)..(522): n is a, c, g, or t
  modified_base (601)..(601): a, c, t, g, unknown or other
  misc_feature (601)..(601): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttcgtggatacaccttcaccggctactatatccacgtgggtgcgaccgacggccccctaggaccgaagggtccttaggaggtggacgtggggaccggtataccgaaaccccgtaacgaccgggtggaccaaacgaaaaccgaacgaccaacgaagtaacggtttcgaacggggacgtacgggtaccaccacgtacgaacccgaacgggacctaccggttaccttacgacgtaccaacgacgacccttacgtagggacggttaggacgcgacggactgacgntacgaggacgacgaccggaccgttgtaacgttacgtgtgacgaggacggaggaacgtacgttagacggtagagttacgnggtaccgttaggtacggtaaggagtacgg

SEQ ID NO: 239415 - DNA, 515 bp, Homo sapiens
  misc_feature: GYAE6OF02GHXS4.4.18.B07.1.454.CMB.1.raw
  modified_base (280)..(280): a, c, t, g, unknown or other
  misc_feature (280)..(280): n is a, c, g, or t
  modified_base (394)..(394): a, c, t, g, unknown or other
  misc_feature (394)..(394): n is a, c, g, or t
  modified_base (438)..(438): a, c, t, g, unknown or other
  misc_feature (438)..(438): n is a, c, g, or t
  modified_base (457)..(457): a, c, t, g, unknown or other
  misc_feature (457)..(457): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtncgacaggcccctggacaagggcttgagtggatgggacggatcaaaccctaacaccggtggacaacaaacaacgcacagaagttcaggcaggtcacatgacaggacacgtccttnacgcacagcctactggaggtgagcaggctgagatgtagacgacncggccgtagtacttactgngcgagagaggaagtacgttgagtcggaatacgagacgttggtaggttagaggtaacgg

SEQ ID NO: 239416 - DNA, 513 bp, Homo sapiens
  misc_feature: GYAE6OF02F98YL.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtcctcagcacagcctactgggaggtgagcaggctgagatcgtagacgacacggcgtgtatactgtgcgagaggaggaagacttggagtcggatacgagtcgttggtaggttaagagtaacgg

SEQ ID NO: 239417 - DNA, 660 bp, Homo sapiens
  misc_feature: GYAE6OF02G7PXT.4.18.B07.1.454.CMB.1.raw
  modified_base (293)..(293): a, c, t, g, unknown or other
  misc_feature (293)..(293): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctgggaggatcctcttcttggtggcagcagcctcaggacgcccactcccgaggtacagttggtgcagtctggggctggaggtgaagaagccgtggggcctcgagtgaaggtctccgtgcgaaggtcttcgtggataccgaccttcaccggctactatatccacgtgggtncgacacggcccctggacgaacgggcttggacgtgggagtggggacgtactaccaaaccccgtaacgaccgggtcggacaaacgaaaaccaacggaccaacaaggtaacgttttcggaaggggctaacgggggtacacccgtaatcggaacccgaagggaacctaccgtacccgtttacgacgtcaaacgtacgaccgttaacgttgggaaggttgaacggcgaaggcttaggagtactcgtacggacgactaccgggcttagtaacgttacgtggtcgacggagaggaacgggaacgacgtttaaggacggttacgggaattacggtacggtacgttacgggttaaggttaaggtaggttaaccggg

SEQ ID NO: 239418 - DNA, 552 bp, Homo sapiens
  misc_feature: GYAE6OF02H3603.4.18.B07.1.454.CMB.1.raw
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctctgcaaggcttctggatacacttcaccggctactatatccactgggtgcgacacggcccctggacaagggcttgagtggagtgggacggatcaaaccctagaccggtggacacaaacgaacgcacagaaagtttcagggcagggtcacatcgacaggacacgtccttnagcanacgctacgttggagtgagcgagctgacgagtctaggacgtaccgacggtcgtagtacgttactgtacgacggtagaggagggaacgtacttaggaacggttacggaagtacggaagtccggttaggtacggtttaaggaggttaacggg

SEQ ID NO: 239419 - DNA, 622 bp, Homo sapiens
  misc_feature: GYAE6OF02HPQGN.4.18.B07.1.454.CMB.1.raw
  modified_base (530)..(530): a, c, t, g, unknown or other
  misc_feature (530)..(530): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctgggctgaggtgagaagcctggggcctcgagtgaaggtctcctgcaaggcttctggactacaccttcaccggctacgtactactcccagtgggtcgcgacacggcccctaggaccagggcttggagtggagtgggacgtatccgaaccctaacgacggtgacacgaaacacgacgacagtaacgttcgacgggactagggtccaaccgtagtacgaccgaacgggacctacggttcccttacgacgtcaacgacgtacccttaacgttgggaggttacgacggactacgggcctaggacgtacgtcgtaggaccgacgtacgggaccgttgttacgttacnggttacgcggtaggtaggaaggtaacgtacggtaggtaggttaccggaatacggacggttcgtaagggtttacggttaaggacggttaacgg

SEQ ID NO: 239420 - DNA, 535 bp, Homo sapiens
  misc_feature: GYAE6OF02G0NZG.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctggggcctcagtgaaggtctcctgcaaggcttctggatacaccttcaccggctactatatccactgggtgcgacaggcccctggacaagggcttggagtggatgggacggatcaaccctacgaccggtggcacaaacacgcaacagaagttcagggcagggcaccatgaccagggacacgtccttcagcacacgcctacgtggaggtgagcaggctggagatcgtaggacgacgaccgggcgttagtacttacgtgtgacgaggagaagggaagacgttaggaggtcggaagtacgagtccgtaggttggttaagaggttaacggg

SEQ ID NO: 239421 - DNA, 509 bp, Homo sapiens
  misc_feature: GYAE6OF02HZW96.4.18.B07.1.454.CMB.1.raw
  modified_base (244)..(244): a, c, t, g, unknown or other
  misc_feature (244)..(244): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcnggatacaccttcaccggctactatatccactgggtgcgacaggcccctggacaagggcttgagtggatgggacggatcaaccctaacaccggtggcacaaacaacgcacagaagtttcagggcagggtcaccatcgaccagggacacgtccttcagcacagcctacgttggagttgagcaggctgagatctagacgacacggcgtgtatactgtgcgagagaggaagacttgagtcggatacgagctggtaggttagagttacgg

SEQ ID NO: 239422 - DNA, 545 bp, Homo sapiens
  misc_feature: GYAE6OF02INKDG.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacacggcccctggacaagggcttggagtggagtgggacggatcaacctaacgaccggtgcaacaaacaacgacacagtaagttcgaggcaggtcaccatcgaccgagggacaccgtccttacacgcacacgcctacgttggaggttgagcgaggctgagatcgtaggacgacgacggcgttagtacgttacgtgtggacgaggaggaaggaagtacgttaggaggttacggagttacgagtcgtaggtaggttagagtaacgg

SEQ ID NO: 239423 - DNA, 535 bp, Homo sapiens
  misc_feature: GYAE6OF02F2UBM.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacgatcgaaccctacgaccggtgacacaaacacgcacagagttcaggcaggtcacatcgacaggacacgtcttcagcacacgcctacgtggtaggtgacgcgtacggctaggagtactcgtagaccgacgaccggtcgttagtacttacgtgtcgacgagaggaagggaagacgttaggaggtacggagtacgagtcgtggtaggttaggtaggtaacgg

SEQ ID NO: 239424 - DNA, 631 bp, Homo sapiens
  misc_feature: GYAE6OF02F0CFH.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatactccactgggtgcgacaggcccctggacgaagggcttggagtggagtgggacgatcgaaccctaacgaccggtggaccaacaaacaacgcaacgagtaacgtttcgaggcgagggtacaccgatcgaccgacgggaacaaccgtccttacgacgtacaacgacgtaccgttaaccgttggaagggtacgacggtacgaacgggtcgtaggacgtagttcgtacggaccgaacgtaccgggtacccgttagttaacttacgtgtacggacggtaggacggaacgggtaacggtacgtttacgggtaacgtacgggtaagttaccgaggtaccgttagggttacggttaaggaggttaaccggg

SEQ ID NO: 239425 - DNA, 643 bp, Homo sapiens
  misc_feature: GYAE6OF02GS2F0.4.18.B07.1.454.CMB.1.raw
  modified_base (244)..(244): a, c, t, g, unknown or other
  misc_feature (244)..(244): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtgggctgaggtgaagacgcgtgggcctgagtgaaggtctctgcaggtcttcgngataccaccttcgaccgctactatactcctacgtgggtcgcgaccgacggccccgtggacgagggtcttggacggtgggagtcggggacgtacgtacccgaaacccgtaaccgaccggtcgacaacgaaaaccgtaacgacgaacgagtaacgttcgacggacgacggtacaccgatacgaaccgtacggaactaccgtccttacgaagaccacgacgtaccgttacggttacggtagggtacgtacgacgtaggaccgtaggacgtacgtcgtacggaccgacgtacggtaccgttagttaacgttacgtagtacggacggtaggacggaaggtaacgtacgttaacgggtacgtacggaagtacgtaggtacgttaggtacggttaggaggttacgg

SEQ ID NO: 239426 - DNA, 606 bp, Homo sapiens
  misc_feature: GYAE6OF02GOBR3.4.18.B07.1.454.CMB.1.raw
  modified_base (421)..(421): a, c, t, g, unknown or other
  misc_feature (421)..(421): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcgtggatacaccttcaccggctactatatccactgggtgcgacacggcccctggaacgaagggcttggagtggagtgggacggataccaaccctaacgaccgggtggaccaacaaaacgaacgacacaagtaagttcgaagggcgagggtccaccgatgaaccgagggacacgtccttnacgcacagcctacgtggaggtagagcgaggctaggagagtacgtacgacggaaccgtaccgggtaccgttagttaattaccggtggtacggacggaggagggaaggtaaacggtacgttagggaacgttacgggtaacgttaacgacggtacgttacgggttagggttaaggtaggttaaccggg

SEQ ID NO: 239427 - DNA, 611 bp, Homo sapiens
  misc_feature: GYAE6OF02HWKHT.4.18.B07.1.454.CMB.1.raw
  modified_base (247)..(247): a, c, t, g, unknown or other
  misc_feature (247)..(247): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagaagccgtggggcctcagtgaaggtctcctgcaaggcttcgnggatacaccttcgaccggctactatactccacgtgggtcgcgacgacggccctaggacaagggctggagtggagtgggacgataccaaccctacgaccggtggacaaccaaaacgaccgacaacgaaggtaacggtttcggggacacggggtacaaccgagtacgaaccgagggaccacgtcctcgacgcacgagctacgttggaggtgacgacgaggcgtagagacgtcgtacggaaccggacggaccggtcggttaggttaacttacgtggtacgacggagagggaacggaaggtacggttaggacggtaccggtaagtacgacggtcgttagggttaagggttaaggaggtaacggtaccg

SEQ ID NO: 239428 - DNA, 582 bp, Homo sapiens
  misc_feature: GYAE6OF02GG4IS.4.18.B07.1.454.CMB.1.raw
  modified_base (220)..(220): a, c, t, g, unknown or other
  misc_feature (220)..(220): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagagccgtggggcctnagtgaaggtctcctgcaaggcttcgtggatacacccttcaccggtctaactatactccacgtgggtcgaccgacgacggcccctagggacgaaggggtccttggaggtggagtggggacgataccgaaccctaacgaccggtggacaacaaacaacgcaacagtaacgttcgagggcacgggtcaccgagtacgaccgagggaccacgtcctacacgacacgacgtcctacgtgggagtacggagacgagggctagagtatcgagaccgacgcggcgttagttagtacgtgacgacgagacggaaggaagtacgtggacgtacggatacggcgtacgttaggtaggttaagaggttaaccgg

SEQ ID NO: 239429 - DNA, 645 bp, Homo sapiens
  misc_feature: GYAE6OF02H8HEI.4.18.B07.1.454.CMB.1.raw
  modified_base (636)..(636): a, c, t, g, unknown or other
  misc_feature (636)..(636): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagaagccgtggggcctcgagtagaaggtctccgtgacaaggcttcgtggatactaccttcaccggtctactatactcccacgtgggtgcgtacacggccccgtaggacgaagggtcttaggaggtgggagtcgggacggacgtaccaacccgtaacgtaccgggtacgacaaccgaaaccgaacgaccaacgtaagtaacggtttccgaagggaccgtacgggtaccaaccgtagtacggaccgacggggacctaccgtcccgttacgaccgtcacgacgtaccttaccggtagggacggtggacgcggacggtcgtaggactacgtgtacgaaccgaccgacggtccgttagttacgttacggtcgtagtcgagaaggaggtaacggtacttagggagttacggaagtcaggtccgtaggtacggttaagnggtaaccgg

SEQ ID NO: 239430 - DNA, 695 bp, Homo sapiens
  misc_feature: GYAE6OF02I8K05.4.18.B07.1.454.CMB.1.raw
  modified_base (182)..(182): a, c, t, g, unknown or other
  misc_feature (182)..(182): n is a, c, g, or t
tcagagcactgtagcacgaccggtgctcgatttagtcgctgcgtaagggggaggcatcacccagcaaccacatctgtcctctagagaatcccctgagagctccgttcctcaccatggactggacctggaggatcctctttcttggtggcagcagcctcaggagcccacctcccgaggtaacnggttggtgcgagtccgtggggctaggtaggtagaaggaacgcgtcgggggcctcgagtggacggtctctcgcgaggcttcgtggactacgtaccttcggaccggtactaactagttactaccctacggttcggggtcgaccggacgaaccggggtccccgtcgggaaccgaacggggtccgttaggcggtacgggagttcggggacggtactccgaaccgtaccggacggtcgacaacaaacgacgacaacgaggtacttacggaggcgtacggtaccgacagtcgacggacggacgaccgtctaccgagcacgacgtaccgtacgtacgggagttacggagacgtacggacgagtacgtagtcgtaggaaccgtacggtacggtacgttagttaacgttaccgttaggaccggtagacgggtacgaaggggtaacgtacggtttacggaacgttacgggaaacgtaaccggttcgtaccgggttaggttacgggtaagttacgggtaacggg

SEQ ID NO: 239431 - DNA, 562 bp, Homo sapiens
  misc_feature: GYAE6OF02GTAEZ.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggagtggggacggataccaaccctaacgaccggtggacacaaacaacgcacagaagtttcagggcagggtacaccatcgaccgagggacacgtccttcagcacacgccttacgtggaggtgagcgaggctaggagatcgtacggacgaccgacgggtccgttagttaacttacgtgtacggcggtaggaggtaggaaggtacgttaggaggtacggaatacgaggtcgttggttagggttaaggaggtaacggg

SEQ ID NO: 239432 - DNA, 656 bp, Homo sapiens
  misc_feature: GYAE6OF02G4M6L.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagaagccgtggggcctcgagtgaaggtctcctgacaggtcttcgtgatacaccttcaccggctactatactccactgggtcgcgacacggccccgtggacgaaggcttaggagtggagtgggacggataccaaccctaacgaccggtcgacaaccgaaacaacgacaacgaagtaacgtttacgagggtacgaacgggtacaccgagtacgaccgaacgggacaccgttccgttacgacgaccgaacgacgtacccgtaacgttggaggtacgacggtacgacgggcgtaggagtacttcgacggaacggaccgaccgggtaccgtagtttaacgttacgttaggtacgacggtaggtaacggtaagggtaacggtacggtttacggaacggtaccggtaagttaaccggacgtacggttagggtttaacgggttaaggtacggttaaccgg

SEQ ID NO: 239433 - DNA, 667 bp, Homo sapiens
  misc_feature: GYAE6OF02FT6CB.4.18.B07.1.454.CMB.1.raw
  modified_base (247)..(247): a, c, t, g, unknown or other
  misc_feature (247)..(247): n is a, c, g, or t
  modified_base (583)..(583): a, c, t, g, unknown or other
  misc_feature (583)..(583): n is a, c, g, or t
tcagagcactgtagcacgaccggtgctcgatttagtcgctgcgtaaggggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagagccgtggggcctcagtgaaggtctcctgcaagggcttcnggatacaccttcaccggctactatactccacgtgggtgcgacacggcccctaggacgaagggcttaggagtggagtgggacggtactccaaacccgttaacgaccgggtggtaccaaccaaaccgaaccggacaaccgaaggtaaacggttttacgaacggggtaccgtaacggggtaccaaccgtagtacgaaccggacgggaacctacccggtttccttaacgacggaccaaccgacgtacccgttaccgttagggtagggtacgtacggacgtacggcgttaggacgtacgtcgtaggaccgaacgaccgggtaccgttagtaacgtttacgngttgacgtaggaacggtaaggaacgtacgtaggaacggtcggtaagtacgacggtagttagggtaggttaaggaggttaaccgg

SEQ ID NO: 239434 - DNA, 807 bp, Homo sapiens
  misc_feature: GYAE6OF02JBCO9.4.18.B07.1.454.CMB.1.raw
  modified_base (192)..(192): a, c, t, g, unknown or other
  misc_feature (192)..(192): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagccccactccccggaagtacgtaggttggtcncgtacgtcgggtcgggtcgtagggtagggtaaggaaaggaccggtccgggtccgggtcctacgtaggtaggtacgttcctcgtcgacgtacggtcttcggtagtaactacctaccgtaccgaccgtacttactactacctaccgtacgggttcggtcgaccgaacgtaccccggtcccggtaggaacggtacggtcggtaggaggtagggagggtacggggaacgtacctaacccgaaccgaccggtaccggacgaccaaaccgaacgaccgacgaacgtaagttacggttacggaacggacggacggtaccaacgtagtaaccgacgggaacgtaccgtacccgtttccagaccgtacgtaaccgtacgttaccgttacgggtcggggtagaccggtacggaccggtacggtcggttaggaacgttacccgttacggtaaccggaaccgggtacccgggtacccgggttaccgtttaagttttaacccggtcggttacgggccggtaagggacggtaagggaacggtaacgttaccggtagggtaccgggtaacgttaactacgggacgggtttaggttaacgggttaacgggtttaacggtcggttaacccgg

SEQ ID NO: 239435 - DNA, 592 bp, Homo sapiens
  misc_feature: GYAE6OF02HBQ7U.4.18.B07.1.454.CMB.1.raw
  modified_base (247)..(247): a, c, t, g, unknown or other
  misc_feature (247)..(247): n is a, c, g, or t
  modified_base (417)..(417): a, c, t, g, unknown or other
  misc_feature (417)..(417): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcgagtgaaggtctcctgcgaaggcttcnggataccaccttcaccggctactatatccacgtgggtcgcgacacggcccctaggacgaagggtcttaggaggtggagtcgggacgataccaaaccctacgaccggtggacaacaaacacgacacagtaagttacgaggacaggtcacagtcgaccgaggcacgtcttanacgacacacgacctacgtggacggtagacgacgacggctagacgacgtacgtacggacgacgacggtccgttagttacgttacgtcggtcgacggaggacggaagggtaaaggtacggttaggacggttacggaacgttacgaggtacttagggttaggtaaggtaggttaacgg

SEQ ID NO: 239436 - DNA, 530 bp, Homo sapiens
  misc_feature: GYAE6OF02FHETF.4.18.B07.1.454.CMB.1.raw
  modified_base (384)..(384): a, c, t, g, unknown or other
  misc_feature (384)..(384): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaacaacgcacagaagttcaggcaggtcacatgaccagggacncgtcctcagcacagcctactggaggtgagcgaggctgagagtctagacgacgacggtccgtgtattactgtgcggagaggagggaaagacgttaggtaacggtcggtataacgtaggtacgtggtagggttaaggaggttaacggg

SEQ ID NO: 239437 - DNA, 527 bp, Homo sapiens
  misc_feature: GYAE6OF02GS29E.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaacctaacacggtggacacaaacaacgcacagaagttcagggcagggtcacatgacagggacacgtcctcagcacacgacctacgtggaggtgacgcaggctgagatcgagacgacacggtccgtgtaacgttactgtacgcgagagagggaagacgttaggacggttcggagtacgtaggccgttaggtaggttagagtaacgg

SEQ ID NO: 239438 - DNA, 593 bp, Homo sapiens
  misc_feature: GYAE6OF02GMTV5.4.18.B07.1.454.CMB.1.raw
  modified_base (312)..(312): a, c, t, g, unknown or other
  misc_feature (312)..(312): n is a, c, g, or t
  modified_base (413)..(413): a, c, t, g, unknown or other
  misc_feature (413)..(413): n is a, c, g, or t
  modified_base (440)..(440): a, c, t, g, unknown or other
  misc_feature (440)..(440): n is a, c, g, or t
tcagagcactgtagcacgaccggtgctcgatttagtcgctgcgtaagggggagcatcacccagcaaccacatctgtcctctagagaatcccctgggagctccgttcctcaccatggactggacctggaggatcctcttcttggtggcagcagcctcaggacgcccactcccaggtacagttggtgcagtcgtggggctgaggtgaagaagccgtgggcctcgagtgaaggtcctcctgcgaaggtcttcgtaggacttaccaccttccgaccggtctacttattatccctacgtgggtcgcgacacggcccnggacgaggcttggagtggagtggacgatcaacctacacggtgacaacaacgacgacacagacgttacgaggcaggtcacatcgacgaggacacgtctcgancacagccttacgtaggaggtcgagcgngggactggagtacgtacgtacgaccggtacgaccgggcgttagttacgttacgtggtacgcggaggagggaaggtaacggtaaggttacggaacggtacggaagtcgaacggtcgttacgggttaagggttaacggtaggtacggttaacccg

SEQ ID NO: 239439 - DNA, 557 bp, Homo sapiens
  misc_feature: GYAE6OF02F4UT9.4.18.B07.1.454.CMB.1.raw
  modified_base (456)..(456): a, c, t, g, unknown or other
  misc_feature (456)..(456): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactccccaggtacagttggtgcagtctggggctgaggtgaagaagccgtgggcctcagtgaaggtctcctgcaaggcttcgtggatacaccttcaccggctactatatccactgggtgcgacaggccccctggacaaggctgagtggatgggacggatccaaccctaacgaccgggtaggacaaccgaaacaacgacacaagaagtttcgagggcagggtcacatcgaccagggacacgtccttcagcacagcctactggagtagagcgaggctagagatcgtacgcgaacnccgggaccttagtacttaccgtgtcgacgagagaaggaacgtaacgttaggagttacggaacttacgacgttaccgtaggtacgggtttaagaggttacgg

SEQ ID NO: 239440 - DNA, 520 bp, Homo sapiens
  misc_feature: GYAE6OF02FV5U1.4.18.B07.1.454.CMB.1.raw
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttcgtggatacaccttcaccggctactatatccactgggtgcgacaggcccctggacaagggctgagtggatgggacgancaaccctaanaccggtggcacaaacacgcacagaagtttcaggcaggtcacatagacaggacacgtccttcagcacacgcctacgtaggaggttgagcgaggctagagatcgtagaccgacgaccggccgtgtatacgtgtgcgagagaggaagtacgtaggagtacggatacgacgtcgtggtaggtagaggtaacgg

SEQ ID NO: 239441 - DNA, 751 bp, Homo sapiens
  misc_feature: GYAE6OF02IOEPJ.4.18.B07.1.454.CMB.1.raw
tcagagcactgtagcacgaccggtgctcgatttagtcgctgcgtaagggggagcgatcacccagcaaccacatcctgtcctctagagaatcccctgagagctccgttcctcaccatggactggacctggaggatcctcttcttgggtggcagcagccctcgaggacgcccactcccgaggtaccagttggtgcgagtcgtggggactggaggtagaaggaacgccgtggggcctacaggtaggaaggttcctccgttggactaagggctttcgtaggactaaccgtacctttaccgaccggtaccttaaccgtaatacgtaccctaaccggttcggggtacgtaccggaccgtacgggtaccccccgtagggaaccggaaggggtccgttaggacggtagggacggtcggggaacggtactacccgtaaacccgtaacggaccgggtcggaccgaacgaaaccgaacggaccaacgtagtaacggttacgaggggaccgaacggggtaccaccgaacgtacggaaccgacgggacctaacgttccgttacgacggaccaacgacgtccttacggttaggaggttcgagacgaggctaggacgtactcgtacgaccgacgaccggtacgtagttaacgttaggtagttacggacgtaacggaaggtacgggaaacgttacggttaacggcggttaacgggaattacggacgggttccgttaagggttacggttaagggtacggttaaccggg

SEQ ID NO: 239442 - DNA, 743 bp, Homo sapiens
  misc_feature: GYAE6OF02J11IN.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctccgtgcgaaggtcttcgtggactacaccttcgaccggtctactatactcctacgtgggtcgcgaccgtacggccccgtaggacgaacgggtcttggacgtggtagtcgggaacggactaccaacccgtaacgaccggtcggacaacaaacgacgacaaccgaaggtaacgtttcgaaggggctacggggtaccaaccgagtacggaacccgaagggacccgaccggttccgttaccgaacgacccgtaaccgtaacggtacccttaacggttaacgggaacgggttaaccggaggtaccggtacgggaccgtttagggtaacggtaagttacccgggttaacggaacccgggtaaccgtacgggggttaaccccgtttagggttaaccgtttcggtacggtacggtaccgggagaacgggtaacgggtaacggtaccggttacggtaacgggtacgggtaacttacgtaccgggtagttaacggggtaaggtttaacgggacgttaaccgggg

SEQ ID NO: 239443 - DNA, 763 bp, Homo sapiens
  misc_feature: GYAE6OF02JDN2N.4.18.B07.1.454.CMB.1.raw
  modified_base (304)..(304): a, c, t, g, unknown or other
  misc_feature (304)..(304): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcaggagcccactcccaggtacaggttggtgcagtcgtggggctggaggtgaagagccgtggggcctcgagtggaaggtcctccgtgacgaaggtcttcgtaggactacctaccttcgacccggtcttaactatactccgacgtgggtnaccgacgaccggcccctaggacgtaagggtccttaggacggttgggagtacggggaacggtactacccgtaaaccccgtaacggtaccgggtcgaaccgaaaccgaaaaccgaaccgacgtaaccgaaggtaaacggtttcgaacggggacgtaacggggtacccaacgtaacgtacggaaccggaacgggtaccctaaccggttccttaccggaacgtaccgaccgtaaccgtacccgttaacggttacgggaacggtacggtaacgaccgacgggttacctagggtacgtaacgttacggtacgaaccggtaccgaacccgggttacgttacgttaacgttacgtacggttacggaaccggtaggtaacgggtaagggtaaacgttacggttagggtaacggtacggtaacgtacggacggttagttacgggtaacggtttacggaaggttaaccgg

SEQ ID NO: 239444 - DNA, 677 bp, Homo sapiens
  misc_feature: GYAE6OF02G4UOA.4.18.B07.1.454.CMB.1.raw
  modified_base (247)..(247): a, c, t, g, unknown or other
  misc_feature (247)..(247): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagagccgtggggcctcagtgaaggtctccgtgcaaggcttcgnggactacacctcgaccggctactatactccacgtgggtgcgacacggccccgtaggacgaagggcttaggacggtggagtgggacgataccaacccgtaacgaccggtggacaacaaacgaacgcaacgagtaagttcgaggcgaggtcacagtcgacgacggactaccggtccttacgacgacgaacgtacgacccttacgtagggacggttcggacgacgtaggccgttaggaacgtacgtacgtacgggaaccggtacgaaccggggtccgttacggttaacgttaaccggtacggtacggacggacgggaagggtaacgggtaaacggttaaccggtttacgggaacggtttaccgggaacgttaaccggtaacggtccggttttaaggggttaacgggtttaaagggtacgggtttaaaccgggg

SEQ ID NO: 239445 - DNA, 512 bp, Homo sapiens
  misc_feature: GYAE6OF02GFQLV.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaacctaacaccggtgcacaacaacgcacagaagtttcagggcaggtcaccatgacaggacacgtcttcagcacacgcctacgtggaggttgacgcgaggctggagatctagacgacgacggccgttgtattacgtgtgcgagagaggaagacttagagtcggatacgagcgtggtaggttagagtaacgg

SEQ ID NO: 239446 - DNA, 632 bp, Homo sapiens
  misc_feature: GYAE6OF02G8PQE.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagaagccgtggggcctcgagtgaaggtctcctgcgaaggcttcgtggatacaccttcaccggctactatactccacgtgggtcgcgacacggccccgtaggacgaagggcttggaggtggagtggggacgagtcaaccctaacgaccgggtggaccaacaaacacggaccaacgaggtaacgtttcgagggtcgacgggtcacgatacgacgacgggacacgtcctacgacgacacgtacgccttacgttcgggtaggtacggacggcgaaggcgtaggacgtagtccgtaacgaaccggaacgtaccgggtacgtttacgttaacgtttaccgtggtacggacggtaggaaggtaagggtaacgacgttaggacggttacggtaataacgacggtacgttaggtacgggttaaggtaggtaaccggg

SEQ ID NO: 239447 - DNA, 546 bp, Homo sapiens
  misc_feature: GYAE6OF02JE1N2.4.18.B07.1.454.CMB.1.raw
  modified_base (359)..(359): a, c, t, g, unknown or other
  misc_feature (359)..(359): n is a, c, g, or t
  modified_base (454)..(454): a, c, t, g, unknown or other
  misc_feature (454)..(454): n is a, c, g, or t
  modified_base (516)..(516): a, c, t, g, unknown or other
  misc_feature (516)..(516): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcgtggatacaccttcaccggctactatatcccactgggtgcgacaggcccctggacaacgggcttgagtggagtgggacggatcaacccctaacgaccggtggcacaaacaacgcanagaagtttcagggcagggtacaccgatcgaccagggaccacgtccttcgacgtacacacgcctacgttggaggttgagcgaggcgtagagacgtngacgacgacggtcgtgtactcgtgtgacgtagaggaggaagacgttagagtacgtagtacgnggtacgtggttacggttaagaggttaacgg

SEQ ID NO: 239448 - DNA, 558 bp, Homo sapiens
  misc_feature: GYAE6OF02HDQ6S.4.18.B07.1.454.CMB.1.raw
  modified_base (399)..(399): a, c, t, g, unknown or other
  misc_feature (399)..(399): n is a, c, g, or t
  modified_base (548)..(548): a, c, t, g, unknown or other
  misc_feature (548)..(548): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgagaagcctggggcctcagtgaaggtctcctgcaaggcttctggatacaccttcaccggctactatatcccactgggtgcgacaggcccctggacaagggcttgagtggatgggacggatcgaaccctaacgaccggtgcaacaaacaacgcacagaagtttcaggcaggtcacatcgaccagggacacgtccttacngaccacacgtcctactcggaggttcgagcgaggctgagtactcgtcggacgacgacgggtccggttagttactttacgtggttcgacggtagaacggaagggtaagacgttggaggtcggtagtaacgaggtccgtggtaggttaaggnggttaacggg

SEQ ID NO: 239449 - DNA, 616 bp, Homo sapiens
  misc_feature: GYAE6OF02HMSNQ.4.18.B07.1.454.CMB.1.raw
  modified_base (249)..(249): a, c, t, g, unknown or other
  misc_feature (249)..(249): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtctggggctgaggtgaagaagccgtggggcctcagtgaacggtctccgtgcaaggtcttcnggatacaccttcaccggctactatactcacgtggtgcgacacggcccctaggacaggcttagagtggatgggacgataccaaccgtaacgacggtgacacaaacaacgacaacgagaacgtttcgaacgggacgaggggtacctaaccgagtacgaaccgacgggaccaccgtaccgttacgacgtaccacgtaacgacccttaagtacggaggtacgtacggaccgaaggcgtagacgtatacgtaggacgaccgacggtccgtagtacgttactagtcgagagagaggtaaaggtaccgttaggaacggttacggaagttaccgaaggtaccgttagggttaacgggttaaggtaggttaaccgg

SEQ ID NO: 239450 - DNA, 540 bp, Homo sapiens
  misc_feature: GYAE6OF02GDNQ1.4.18.B07.1.454.CMB.1.raw
  modified_base (400)..(400): a, c, t, g, unknown or other
  misc_feature (400)..(400): n is a, c, g, or t
  modified_base (531)..(531): a, c, t, g, unknown or other
  misc_feature (531)..(531): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtgcacaaacaacgcacagaagtttcgagggcagggtacaccatgaccgagggacacgtccttanacgcacagcctacgtggaggtagagacaggctagagtatcgtagaccgacgacggccgttagtacgttacgtgtgcggagaggaagggaagtacgttaggagtacggatacgagtctaggtaggttaaggnggttaacgg

SEQ ID NO: 239451 - DNA, 642 bp, Homo sapiens
  misc_feature: GYAE6OF02FPGEA.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccagtacagttggtgcagtctgggctgaggtgaagagccgtggggcctcagtgaacggtctcctgacaaggcttcgtaggactaccacctttcaccggtctaacttatactccacgttgggtgcgaccgacggcccccttaggaccgaaggggtccttggagtggagtgggacgatccgaacctacgaccggtcggacaacaaacaccgacaacgaacgtaacgttcgagggtacgacggtaccaacgactacgaaccgacgggacctacccggttccttacgacgtccgaacgaaccgtccgttaacggtagggtacggttaggacggtcgaacgggcgtaggacgttgtccgtacggacgtaccgaacgggtccgttagttacgttacgtggtcgacgtagacggtaaggtaacggtgttaggacggtacgtaatacgtacggttagttggtaaggtttaggacggttaacg

SEQ ID NO: 239452 - DNA, 944 bp, Homo sapiens
  misc_feature: GYAE6OF02HZX98.4.18.B07.1.454.CMB.1.raw
  modified_base (186)..(186): a, c, t, g, unknown or other
  misc_feature (186)..(186): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcaggacgcccactcccaggtacagttggtncagtcgtggggctgaggtagaagagccgtgggcctcgagtgaaggtctccgtgacaaggtctttcgaggataccgtacctttccgaccggtccttaactaacgttacttacccgaacgttcggggttacggaccgaaccgtaaccgggtaccccccggttaaggggaaaccggtaaaacgggggttccgttttagggaaacggttcgggggtaacggtttacgggggaaccgggttaacgttaaccccgaaaacccccgttaaaccggtaaccccggggttacggggaacccaaaacccgtaaaaaacccgtaaacccggacccgtaaaccggtaaaacggttaaacgggttttaaccggacggggtccggaaacggggttacccaacccgtaacgtacggaacccggtaacggggtaaacccgtaccggtttacccgttaaccgaacggtacccgtaaaccgtaaccggtacccgttaaccgggtttacgggtaacgggttacggaacgaccggtaacgggtaccgtaggaacgttacgttaccgtaacgggtacccggtaaaccgaaccggggttccggttaaggtttaaccgttttaacggttacgggttacggtaccgggaaggtacgggtaaaacggggtaaacgggtttaacgggtttacgggtaacggggttaacggtaacggttacggtaacgggtaccgttttaacgggggtttaacgggtttaaacggtagggttttaaaccccgggg

SEQ ID NO: 239453 - DNA, 515 bp, Homo sapiens
  misc_feature: GYAE6OF02GATJA.4.18.B07.1.454.CMB.1.raw
  modified_base (486)..(486): a, c, t, g, unknown or other
  misc_feature (486)..(486): n is a, c, g, or t
  modified_base (496)..(496): a, c, t, g, unknown or other
  misc_feature (496)..(496): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcgagtgaaggtctcctgcaaggcttcgtggatacaccttcaccggctactatatccactgggtgcgacacggcccctggacaagggcttggagtggatgggacggatcaaccctaacaccggtgcaacaaacaacgcacagaagtttcagggacaggtcaccatcgaaccgaggacacgtcctcgagcacagcctactggagtgagcgaggctgagatccgtgacgacgacggccgtgtacttacgtgtgcgagagaggaagattggngtggatacgngcgtgtaggttagagtacg

SEQ ID NO: 239454 - DNA, 541 bp, Homo sapiens
  misc_feature: GYAE6OF02IZLOU.4.18.B07.1.454.CMB.1.raw
  modified_base (444)..(444): a, c, t, g, unknown or other
  misc_feature (444)..(444): n is a, c, g, or t
  modified_base (478)..(478): a, c, t, g, unknown or other
  misc_feature (478)..(478): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcctggggcctcagtgaaggtctcctgcaaggcttctggatacaccttcaccggctactatactccactgggtgcgacacgggcccctggacaagggcttggagtggagtgggacggatcgaaccctaacgaccggtgacaacaaacaacgcacagaagtttcgaggcaggtcacagtcgacgaggacacgtccttcagacacgacgtacctacgtggaggtgagcgaggcgtgagtntcgtagacgacgacggccgtagtacttacgtagngcgagagaggaagtacgtaggagtacgagtacgaggtacctaggtaggttaaggagtaacggg

SEQ ID NO: 239455 - DNA, 801 bp, Homo sapiens
  misc_feature: GYAE6OF02HZ4V0.4.18.B07.1.454.CMB.1.raw
  modified_base (281)..(281): a, c, t, g, unknown or other
  misc_feature (281)..(281): n is a, c, g, or t
tcagagcactgtagcacgaccggtgctcgatttagtcgctgcgtaaggggggagcatccacccagcaaccacatctgtcctctagagaactcccctgagagctccgttcctcaccagtggactggaccgtggaggtactccttctttcgttgggtggcagcacgcctcgaggacgccccacctcccgaggtacgtaggtttggtgcgtagtcggtggggtcgtggagggtaggaaaggaacgtccggtcggggccctacgaggtaggaacggttcctccgngacgaggtccttcgaggtactacctaccgttccgaccggtactaactatactcctaggtgggtcgaccgaacgccggtaccccgtagggaaccggaacgggttcttagggaggtagggtacggtacggggtaacgacgtaaccgtaaaaccccgtaaccggaccgggtacggaaccaaaacccgaaacgaaccgaccgaacgtaaaggttaacgttacggaacggggtaccgtaacggggtaccaaccgtagtaccggaaccgacgggtaaccctaccgttaccgttacgacggtaccaacgaccgtaccgttacggttaggggaacgttcggagtacggacggtcgtaggaacgtacttcggtacggaaccgtaccggtaccgggtcgttaacgttacttacgtgggtcgtaggaagggacggtaacggtaacggttaaccggttaggtaaccgggttaacggtaactacggtacgggtccggtttaagggtaacgggtttaaggacggtttaaccggg

SEQ ID NO: 239456 - DNA, 560 bp, Homo sapiens
  misc_feature: GYAE6OF02HEE2O.4.18.B07.1.454.CMB.1.raw
  modified_base (245)..(245): a, c, t, g, unknown or other
  misc_feature (245)..(245): n is a, c, g, or t
tcagagcactgtagcacgaccggtgctcgatttagtcgctgcgtaagggggagcatcacccagcaaccacactcctgtcctctagagaatcccctgagagctccgttcctcaccatggactggacctggaggatcctcttcttggtggcagcagcctcaggagcccactcccaggtacagttggtgcagtctgggctgaggtgaagagcctggggcctcagtgaaggtctcctgcaaggcttcgngatacaccttcgaccggctactatactccacgtggtgacgacacggcccctggaccaaggccttagagtggagtgggacgactacaaccctaacgccggtcgacacaaacgacgcacagaagttcgaggcaggtcacgatacgacgaggaccacgtccgttcgacgtcacgacgtcctacgtggaggtgacgcgacgcgtagagactcgtacgacgacgacggtaccgtagttacgttacgtgtcgaggagagacggaagtaccgttaggaacggtccggaatacgagtcgttaggtacggttagacgttacggg

SEQ ID NO: 239457 - DNA, 561 bp, Homo sapiens
  misc_feature: GYAE6OF02GP4VD.4.18.B07.1.454.CMB.1.raw
  modified_base (465)..(465): a, c, t, g, unknown or other
  misc_feature (465)..(465): n is a, c, g, or t
  modified_base (552)..(552): a, c, t, g, unknown or other
  misc_feature (552)..(552): n is a, c, g, or t
tcagagcactgtagcacgaccggtgctcgatttagtcgctgcgtaagggggagcgatcacccagcaaccacatctgtcctctagagaatcccctgagagctccgttcctcaccatggactggacctggaggatcctcttcttggtggcagcagcctcaggagcccactcccaggtacagttggtgcagtcgtgggctggaggtgaagaagccgtgggcctcgagtgaacggtctccgtgcgaaggcttcgtggatacaccttcgaccggctactatactccactgggtgcgacgacggccctggacaggcttggagtggagtgggacgatacgaaccctaacgaccggtggacaacgaaacgaacgcaacgacgtaagtttcgaagggcagggtacaccgagtcgaccgaggaccacgtccttacagtacactacgacctacgtggacggttgacgcgagcaganatcgtagacgacgcggctagtactcgtgtgagagaggacggaaggtacttaggagtcggaatacgaggtcgtaggtaggttaacggnggttaacgg

SEQ ID NO: 239458 - DNA, 640 bp, Homo sapiens
  misc_feature: GYAE6OF02FX4B8.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctgggctgaggtgaagagctgggcctcgagtgaaggtctccgtgcaaggtcttcgtggatacaccttcaccggctactatactccacgttgggtcgtcgacacggcccctggacgaacgggctgacggtggagtgggacggactactaaccccgtaacgaccggtgacgaacaaacgaacgacaacgaaggaagtttccgagggacgaggtaccacgatcgaaccgaggaccgtacgtacccttacgacgtaccaacgacgtacccttacgtcgggtaaggtcgaagcgtaaggcgttaggaacgtagtccgtaggaaccgtaaccggtacggtaccgttagtaacgttaccgtagtacggacggaggtaaggaaggtaacggtacgttagggacggtaacgggtagtaacgtacggtacgttacggtagggtttaacggtgggttaaccgg

SEQ ID NO: 239459 - DNA, 539 bp, Homo sapiens
  misc_feature: GYAE6OF02FOOQG.4.18.B07.1.454.CMB.1.raw
  modified_base (357)..(357): a, c, t, g, unknown or other
  misc_feature (357)..(357): n is a, c, g, or t
  modified_base (382)..(382): a, c, t, g, unknown or other
  misc_feature (382)..(382): n is a, c, g, or t
tcagagcactgtagcacgaccggtgctcgatttagtcgctgcgtaagggggagcatcacccagcaaccacatctgtcctctagagaatccccctgagagctccgttcctcaccatggactggacctggaggatcctcttcttggtggcagcagcctcaggagcccactcccaggtacagttggtgcagtctggggctgaggtgaagaagcctgggggcctcagtgaaggtctcctgcaaggcttctggatacaccttcaccggtctactatatccactgggtgcgacaggcccctggacaagggcttgagtggatgggacggatcaaccctacgaccggtggcaacaaacaacacanagaagtttcagggcagggtcaccanacgacgaggacacgtcttcagcacagacctagttggaggtgacgcgacggctagagatcgtagacgacgacggccgtagttattacgtgtagcgaggagaggtaagacgttaggacgtacggtatacgagtcgtggttaggttaggtaggttaacgg

SEQ ID NO: 239460 - DNA, 576 bp, Homo sapiens
  misc_feature: GYAE6OF02IDUXK.4.18.B07.1.454.CMB.1.raw
  modified_base (315)..(315): a, c, t, g, unknown or other
  misc_feature (315)..(315): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctgatacacttcacggctactatatccactgggtgcgacagcccctggacaagggcttgagtggatgggacgntcaacctacaccggtgcacaacaacgcacagaagttcgagggcagggtcaccgagtcgaccgaggacaacgtccttacacgcacacgccttacgttaggaggttagacgacgacgggtctggagactcgacgtacgaccgacgggtccgttagttacgttacgtcgttagacgaggaggaagggtaaacggacgtttcggaaggttaccgggaacttaacgacggtccgttagggttaacggttacggtaggttaaccggg

SEQ ID NO: 239461 - DNA, 575 bp, Homo sapiens
  misc_feature: GYAE6OF02F39F8.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttctggatacaccttcaccggctaactatatccacgtgggtgcgacaggcccctggacaagggcttgagtggagtgggacgatcaacctaacgcggtgcaacaaacaacgcacagtaagttcagggcaggtcacatgaccaggacacgtctcacgcacgacgcctacgtggaggtcgagtcgaggctggaacgagttacgacggacgaccgaccggtaccgttagttacgttacgtggttcgacggtaggaaggaacgggtaaggtacgttgggtaacgttacgggtaataacggtggtaccggttaggttacgggttaagtaggttaaccggg

SEQ ID NO: 239462 - DNA, 789 bp, Homo sapiens
  misc_feature: GYAE6OF02GI083.4.18.B07.1.454.CMB.1.raw
  modified_base (779)..(779): a, c, t, g, unknown or other
  misc_feature (779)..(779): n is a, c, g, or t
tcagagcactgtagcacgaccggtgctcgatttagtcgctgcgtaagggggagcatcacccagcaaccacatctgtcctctagagaatccctgagagctccgttcctcaccatggactggacctggaggatcctcttcttggtggcgagcagcctcgaggacgcccacctcccaggtacagttggtgcagtcgtgggcgtggaggtagaagaagccgtggggcctacgagtggtaacggtccgtaccgtggacgaaggtcctttcgtggtaactacgtaccttaccgacccggacttaacttattaccgtacccgtaacgttcggggtacgacggaccgtaaccgggtcccccgtagggaacccggtaacggggttccgtaggtaaccggttagggaacggtacggggtaaccggtaccgttaccctaaaaccccggtaacgtacccgggttcggaacctaaacgaaacccgaacgaccgaaacgttaacgggtaaacgtttacggaagggtaccggggtaaccggtacgaaacccgagttacccggaaaccgggtaacgggtaacccttaccggttcccgttaacgaacgtaccctaacgaaacggttcccttaacgggtagggtacgtaaggacgacggacgtacggtagtaacgtacgtcggtaacgaccggtaacgaccgggtaccgttagttacgttaaacgttggagtacggacgaggaccgtaagtaatcggagtacccgaagaccgtaggaccgtttggaacggtttaagnggttaaccgg

SEQ ID NO: 239463 - DNA, 634 bp, Homo sapiens
  misc_feature: GYAE6OF02FXCSU.4.18.B07.1.454.CMB.1.raw
  modified_base (290)..(290): a, c, t, g, unknown or other
  misc_feature (290)..(290): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggagatcctcttcttggtggcagcagcctcaggacgcccactcccaggtacagttggtgcagtctggggctggaggtgaagagccgtggggcctcgagtgaaggtctccgtgacaaggtcttcgtggactacaccttcaccggtctactatactccacgtgggtnacgacacggccctaggacgaggtcttggaggtggagtggacggatccgaacctaacgaccggtggaccaacaaacgacgacaacgagtaacgtttacgacgggacgacgggtcaaccgatacgaccgaagggaccaccgttacctacgacgtaccacgacgtacccgttacgttgggggtacgaggacgacggtcgtagacgtacgtacgtacggaaccgaccggtaccggtaccgttagttacgttaacgtggttacgacgaggtaggaacggaagtaccgttagggacgtacggtaacgtacgacgtcgttaggttaggtaacggtaggtacggttaacccg

SEQ ID NO: 239464 - DNA, 769 bp, Homo sapiens
  misc_feature: GYAE6OF02HRSGR.4.18.B07.1.454.CMB.1.raw
  modified_base (734)..(734): a, c, t, g, unknown or other
  misc_feature (734)..(734): n is a, c, g, or t
tcagagcactgtagcacgaccggtgctcgatttagtcgctgcgtaaggggagcatcacccagcaaccacatctgtcctctagagaatcccctgagagctccgttctcaccatggactggacctggaggatcctcttcttggtggcagcagcctcaggagcccactcccaggtacagttggtgcagtctgggctgaggtgaagaagccgtggggccctgagtgaaggtcctccgtgcgaaggtcttcgtaggactacctaccttcaccggcctactagtactccaacgtggggtgccgaccgacggcccccgttaggaacgaacggggtccgtttaggacggtacgggaagttacgggggaaccggtaatacccgtaaacccccgtaaacggtaccccgggtaggtacccaaccgtaaaccgtaaacggaccgaaccgtaagtaaacgttttccgaacgggggtccaacgggggtcctaacccgaagttaccggaacccgtaacggggaaccctaaccgggttacccgtttaccgaacggaccgtaaccgtaaccggtcccgttaacccggtttagggaaccggggttaggtaacggaccgtaacgggcctacgggaacgtaacgtccgtacggaccgaccgtaaccgggaccgtttacggttaactttacgttggtacgtacggtaggtacggtaacggtaaggtaacttaggacggttacggtattaaccggngtaccgttagggttacgttaaggagtttaaccggg

SEQ ID NO: 239465 - DNA, 602 bp, Homo sapiens
  misc_feature: GYAE6OF02H7EZK.4.18.B07.1.454.CMB.1.raw
  modified_base (475)..(475): a, c, t, g, unknown or other
  misc_feature (475)..(475): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagctggggcctcgagtgaaggtctcctgcaaggcttctggatacaccttcgaccggctactatactcctacgtgggtgcgacacggcccctggacgaagggtcttggacgtaggagtagggacggactccaaccctaacgaccggtggacaacgaaacaacgacaagacgtaacgttcgagggacagggtacacatacgaccgagggaacctacgtccttcgacgcacacgacctacgttaggaggtcgaacgcgtaaggctaggaagngttcgtacggacgaccgtacggaccgtttagtacgttacgtggtacgacggaggaaggaacggaaggtaacgttggaaggtacggatacgtacggtacgttaggtaagggttaacggaggttaacgg

SEQ ID NO: 239466 - DNA, 682 bp, Homo sapiens
  misc_feature: GYAE6OF02H3OXB.4.18.B07.1.454.CMB.1.raw
  modified_base (244)..(244): a, c, t, g, unknown or other
  misc_feature (244)..(244): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtctggggctgaggtgaagaagctggggcctcgagtgaaggtctcgtgcaggcttcnggatactaccttcgaccggctaactatacgtctacgtgggtcgcgacacggtcccccgtagggaccgaaggggtcgttaggacggtggtacgtggggaacggacttaccgaaaccctaacgacccgggtacggaccaaccgaaaacgaacgaccgaacgtaaaggtaacggttttacgacggggtacgaacgggggttaccaaccgtaacgtaccggaacccgaacggggacctaccggttcccgtttacgacggacctaaccgacgtcccgttaacgttgggtaggttacgacgacggacggcgtaggacgtagtcgacgtacggacgtaccggtccgttagttacgttacgtgtcgtacgaggtaagacggaagtaccgttaggaacggtacgacgttaggacggtacgttggttaagggttacggaggttaacgg

SEQ ID NO: 239467 - DNA, 525 bp, Homo sapiens
  misc_feature: GYAE6OF02FYPIN.4.18.B07.1.454.CMB.1.raw
  modified_base (399)..(399): a, c, t, g, unknown or other
  misc_feature (399)..(399): n is a, c, g, or t
  modified_base (437)..(437): a, c, t, g, unknown or other
  misc_feature (437)..(437): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtgcaacaaacaacgcacagaagtttcgaggcagggtcacatcgaccagggacacgtccttacngcacagcctagtggaggttgacgcgaggctgagatcgngacgacacggccgtgtattctgtcgagagaggaggaagtacgttggaacgtcggatacgaggcgttaggtaggttaagaggttaacgg

SEQ ID NO: 239468 - DNA, 599 bp, Homo sapiens
  misc_feature: GYAE6OF02I0G1T.4.18.B07.1.454.CMB.1.raw
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttcnggatacaccttcaccggtctactatatcccatgggtncgacacggcccctggacaagggcttgagtggatgggacgatacgaacccgtaaccgaccggtgaacaacaaacgaaccgcacaagtaacgttacgagggcaagggtccaacagtacgaccagggacctaccggtccttacgagtccaacgacggaccttaaccgtgggaacggtgacgcgagcgtaggagactctaggacccgaacgaccgggtccgtagtttaacttactgtaggtccgaggtaacgaacgggaaggtaaccgttagggacgttacggaataacgaggtaccgttgggtaggttaagaggtaaccgg

SEQ ID NO: 239469 - DNA, 702 bp, Homo sapiens
  misc_feature: GYAE6OF02IIF8E.4.18.B07.1.454.CMB.1.raw
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagaagccngggcctcagtgaggtctccngcaggcttcngatacaccttcaccggtctactatactcccatgggtgccgtacgacgggcccccgtaggaccgtaaaggggctttggagtgggagtgggggaacggtactaccgaaacccctaaccggtaccggtacggacaacgaaaaccgtaacggaccaacaacggtaaagttttaccggacgggtacgacggggtaccaaccgatcggaaccgacgggactaaccggttcccttacgacgcaaccacgtcctaccgttggaacgggttcggaacggcgtacgggtcgtaggacggtacgttaccgtagggaaccgaaccgtaccgggtaccgttgttaacgttaacgttcggttacggacggagggacggtaacggaaggttaccggttaggaacgggtttacccggaagttaccggaggttaccggttaggggtttaagggttaacgggtaacggtttaaccggg

SEQ ID NO: 239470 - DNA, 548 bp, Homo sapiens
  misc_feature: GYAE6OF02I5DKT.4.18.B07.1.454.CMB.1.raw
  modified_base (244)..(244): a, c, t, g, unknown or other
  misc_feature (244)..(244): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtgggcctcagtgaaggtctcctgcaaggcttcnggatacaccttcaccggctactatatccactgggtgcgacacggccccgtggacgaagggccttaggagtggagtggggacggtagtccaaccctaacgaccggtgccaacaaacaacgcacagaagttcgagggcagggcacatcgacgaggacacgtcctcagcacacgacctacgtggaggtgagcgagcgtagagatcgacgacgacgacggtccgtagttacttactgtagcgagaggaacggtaagtacgttggaacggtcggataacgagtcgttggtagggttaagaggttaacgg

SEQ ID NO: 239471 - DNA, 578 bp, Homo sapiens
  misc_feature: GYAE6OF02HOMKH.4.18.B07.1.454.CMB.1.raw
  modified_base (514)..(514): a, c, t, g, unknown or other
  misc_feature (514)..(514): n is a, c, g, or t
  modified_base (534)..(534): a, c, t, g, unknown or other
  misc_feature (534)..(534): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactccccaggtacagttggtgcagtctggggctgaggtgaagaagcctggggcctcagtgaaggtctcctgacaaggctttcgtggatacaccttcaccggctactatatccactgggtgcgacaggcccctggacaagggcttgagtggatgggacggatcaaccctaacgaccggtggaccaacgaaacaaacggacaccgaagtaacgtttcgaaggggcaggggttccaaccgagtcgaaccgaagggacccaacggttcccttacgaagccaacgagccctacgttgggaggtgagcgaggctgagtactacgtgaacgacacgggtcccgttagtacgtttacnggttgacggagagagggaanacgttgagtacggatacgagtctaggtacggttagagttacggg

SEQ ID NO: 239472 - DNA, 583 bp, Homo sapiens
  misc_feature: GYAE6OF02FZPO1.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactggtgcgacaggcccctggacaaggcttgagtggagtgggacggatccaaccctaacaccggtggcaacaaacaacgcacagaagtttcagggcagggtcaccatgaccagggacagtcgtccttcagcacacgcctacgttggaggtgagcgaggctaggagtacgtcgtcggaaccgaccgtaccgggtaccgtgttaacgtttacgtggtacgacggaagtaagggaagggaaacggtaacgtttaggaacggttccgggaacttaacggacggttacgttagggtttacgggttaaggtaacggg

SEQ ID NO: 239473 - DNA, 615 bp, Homo sapiens
  misc_feature: GYAE6OF02IPH6D.4.18.B07.1.454.CMB.1.raw
  modified_base (468)..(468): a, c, t, g, unknown or other
  misc_feature (468)..(468): n is a, c, g, or t
  modified_base (584)..(584): a, c, t, g, unknown or other
  misc_feature (584)..(584): n is a, c, g, or t
tcagagcactgtagcacgaccggtgctcgatttagtcgctgcgtaaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttctggatacaccttcgaccggcctactatactccactgggtcgcggacaggccccctggacgaacgggcttggagtggagtgggacggataccaacccgtaacgaccggtggacaaccgaaaacaacgccaacgaggtaaacgttttacgaaggggaccgaaggggtaccaacccgagtacgaaccgaacgggaaccacggttacccgttacacggtacacgacnccgtaacgttgggaggtgaaggcaggcgtagacgtatctaggaccgacgacgtaccgtgtacttacgtgtcgcgagacgagggaacggtacgttaggtaacggtcggtaactacgnggtacgttaggtagggttaaggtagttacgg

SEQ ID NO: 239474 - DNA, 699 bp, Homo sapiens
  misc_feature: GYAE6OF02GDBDB.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttcgtggatacaccttcaccggtctactatactccacgtgggtgcgacacggcccctggacaacgggcttaggagtggacgtggggaacggataccaacccgtaacgaccggtggacaaccaaacaacgacaacgagtaaacgtttcgaaggggtcacggggttaccaaccgacgtacgaaccgacgggacctaaccggttcccttacgacgaccaacgacgtacccgttacgttacgggacggttagagtacgtaggccgtaggaacggtaacgttaccgttaggacccgaaccgtaccgggtaccggtttagttaacgtttaaccgttagggttcgtaaccggtagggtaacggtaaggggtaaacggtacggtttaacgggaacgggttaaccgggtaacgttaaccgacggttccggttaagggttaagggttaaccggtacggttaacccggg

SEQ ID NO: 239475 - DNA, 608 bp, Homo sapiens
  misc_feature: GYAE6OF02HYR67.4.18.B07.1.454.CMB.1.raw
  modified_base (511)..(511): a, c, t, g, unknown or other
  misc_feature (511)..(511): n is a, c, g, or t
  modified_base (518)..(518): a, c, t, g, unknown or other
  misc_feature (518)..(518): n is a, c, g, or t
  modified_base (601)..(601): a, c, t, g, unknown or other
  misc_feature (601)..(601): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtgcagcacgcctcaggacgccccactcccgaaggtacaggttggtgcagtcgtggggctggaggtgaagaagccgtggggcctcgagtgaaggttcctccgtgacgaaggcttcgtaggactacctaccttccgaccggcttaactatactaccacgtgggtacgcgaccgacggccccgtaggaaccgaagggtcttaggaggtggagtcgggaacgactacccgaaacccgtaacgaccggtgaaccaacgaaaccgaacgacaacgtaagtaacgttacgaagggcgacgggtacaccgtagtacgaaccgagggacctaccgttccttacgacgcaacgacgtaccttagtggagtgagcgagntagagtntacgagacgacgacggtacgttgtatcgtgcgacgaggagacggaagtacgttgacggtcgatacgagtcgtaggtagttagngtaacgg

SEQ ID NO: 239476 - DNA, 587 bp, Homo sapiens
  misc_feature: GYAE6OF02IKI5I.4.18.B07.1.454.CMB.1.raw
  modified_base (469)..(469): a, c, t, g, unknown or other
  misc_feature (469)..(469): n is a, c, g, or t
  modified_base (509)..(509): a, c, t, g, unknown or other
  misc_feature (509)..(509): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctgaggtgaagaagcctgggcctcagtgaaggtctcctgcaaggcttctggatactaccttccaccggctactatactcctacgtgggtcgccgacgacggccccgtggacgaagggcttaggacgtggagtgggacgataccaacccgtaacgaccggtggacaacgaaacaacgacaacgagtaacgttcgagggtacgaggacacgagtacgaccgaggacctacgtccttacgacgtccacgacgtcctacgtggacggtgacgcgagngagacgtgtacagacgacgaccggtcgtagttacgtacgngtagacgaggaagacggtaagtacgtaggtagtacggaagtacgacggtacgtaggtacggttaggtaggttaaccgg

SEQ ID NO: 239477 - DNA, 745 bp, Homo sapiens
  misc_feature: GYAE6OF02FNKTK.4.18.B07.1.454.CMB.1.raw
  modified_base (245)..(245): a, c, t, g, unknown or other
  misc_feature (245)..(245): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttcnggatacaccttcaccggctactatatccactgggtgcgacgacggcccccgtggaccaaggggcttaggaggtggagtcggggacggactaccgaaaccccgtaacgaccgggtacggaccaacgaaaccaaccggaccaccgaaggaaacggttttacgaacgggggacctaagggggttaccaacccgtaagtacggaacccggaacggggtaacccaaccggttcccctttaccgaacgacccaacgtacgcccttaaccggttggggaacggttcggaggccgtaaagggcgttacgggaacgtagttcgttacggaaccggtaaccgaacccggggttcgttacgttaacgtttaacgttcgggtagaccggtaggaacgggtaacgggaaggttaaccggtttagggaaccgggttaccgggtaaacgttaccggaacgggtttaccggttacggggtttaacgggttttaaaggggacgggtttaaaccgggg

SEQ ID NO: 239478 - DNA, 552 bp, Homo sapiens
  misc_feature: GYAE6OF02F8FR8.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactccccaggtacagttggtgcagtctggggctgaggtgaagaagccgtggggcctcgagtgaaggtctcctgcaaggcttcgtggatacaccttcaccggctactatatccactgggtgcgacacggcccctggacaagggcttggagtggagtgggacgatcaacctaacacggtgacaacaaacacgcacagaagttcgagggcaggtcacatacgacgaggacacgtccttcacgcacacgcctacgtggaggtgacgcgaggctgagatcgagacgacgaccgggccgttagtaacttactggtagacgagtaggaagggaacggtacgttaggacggtacggtaatacgacggtagtaggtacgggttaagaggttaacggg

SEQ ID NO: 239479 - DNA, 538 bp, Homo sapiens
  misc_feature: GYAE6OF02IH7DJ.4.18.B07.1.454.CMB.1.raw
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
  modified_base (410)..(410): a, c, t, g, unknown or other
  misc_feature (410)..(410): n is a, c, g, or t
  modified_base (530)..(530): a, c, t, g, unknown or other
  misc_feature (530)..(530): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctnagtgaaggtctcctgcaaggcttcnggatacaccttcaccggctactatactccacgtgggtgcgacgacggcccctggacgaagggcttggagtggagtgggacgataccaacctaacgaccggtggacaacaaacaacgcaacgagtaacgttcgagggcagggcacagtacgacagggacacgtcctnacgcacacgcctagtggaggtgagcgaggcgtgagctcgacgacgacgacggtcgtagtactgtgacgacgagagaaggaagtacgtgacggtacgagtacgacgtgtagtacggtaagnggtaacgg

SEQ ID NO: 239480 - DNA, 618 bp, Homo sapiens
  misc_feature: GYAE6OF02HGJFZ.4.18.B07.1.454.CMB.1.raw
  modified_base (240)..(240): a, c, t, g, unknown or other
  misc_feature (240)..(240): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacaggttggtgcagtctggggctggaggtgaagagcgtggggcctcagtgaggtctctgcaggctnggatacacctcaccggctactatactccacgtgggtcgccgacgacgggcccccgtaggacgagggtcgtgaggttggagtgggacgtataccaaccctaacgaccggtggaccaacgaaacaaccgacaacgaagtaacgttacggagggacgacgggtacaccagtcggaccgacgggacctacgtcctacgacgtacacgtacgtcctaaggtgggaggtagacgcggaggcgtaggtagtactcgttacggaccgaccgacggttccgtagttacttacgtggtgaccggaggtaagggtaaggaacggtaccggttggtaacggtacggtaagtacgacggtcgttagggtaggtttaacggagttaaccggg

SEQ ID NO: 239481 - DNA, 832 bp, Homo sapiens
  misc_feature: GYAE6OF02H9W7L.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccaggtacaggttggtgcagtcgtggggctgaggtgaagagccgtgggcctcagtgaagtctccgtgcgaaggcttcgtggtactacctaccttcgaccggtctactactactaccacgtgggtacgaccgaacgaccggtaccccgtaggaaccggaacgggtcgtttaggacggttagggacggttaggggaacggaacgtacccgaaaaccccgttacggaaccgggtcggaacccaaaccgaaaaccgaacggaccgtaaccgtaaaggttaaacggtttaccggaggggtaaccgtaacggggtaccaacccgtaacgtacggaacccggtaacgggtacccgtacccggttacccgtttacgaacggtacccgtaacgaacccgggtttaccgtaacggtttcgggtaacgggtacgtaacggacggtaacgggtcgtaacgggtaacgacgtttacggtaaccggaccggtaaacccggtaccgggtacccgggtttaagtttaaccggtttaaaccgttcggtaacggggttacggaagggttaaacgggtacgggtaaaggtaccggtttagggaaccggtttaccgggtaagttaaccgacggttaccgggttacggtttaaaggggtttaaccggtacgggtttaacccgg

SEQ ID NO: 239482 - DNA, 677 bp, Homo sapiens
  misc_feature: GYAE6OF02JYCNP.4.18.B07.1.454.CMB.1.raw
  modified_base (144)..(144): a, c, t, g, unknown or other
  misc_feature (144)..(144): n is a, c, g, or t
  modified_base (189)..(189): a, c, t, g, unknown or other
  misc_feature (189)..(189): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (549)..(549): a, c, t, g, unknown or other
  misc_feature (549)..(549): n is a, c, g, or t
  modified_base (555)..(555): a, c, t, g, unknown or other
  misc_feature (555)..(555): n is a, c, g, or t
tcagagcactgtagcacgaccggtgctcgatttagtcgctgcgtaaggggaggcatcacccagcaaccacatctgtcctctagagaatcccctgagagctccgttcctcaccatggactcggacctgaggatcctcttcttggnggcagcacgcctcgaggcgcccaccttcccaggtactagttggtnccgtagtccgtggggtctgaggtagaacgaacgtcccgnggggcccctgagtcgaacggttccnctagacgtaaggcttcgaggtactacctacccttgacccggtctactacgtactcctaacggtgggttcgcgtaaccgcggcccctaggaacgtaacggcgttaggaacggtgggtaaccggtggggtaccggtaacgtacccaaacccgtaaaccgtaccgggtaggaccaaccgtaaaacgaacgaccgaacgaagttaacgttacggacggacgacggggttacaacgtcgtacgacgacggaccgacgttctcgacgaccactaaccgtacgtggagtagtcgcgtaacggngttagngaacttcgtacgaccacggaccgtcgtagttactaaccgtggtaaccgcgtacgaggagtaacggtgtaccggtaggtccggaagtaccgagtacggtggttacggttaagcggtacgtacg

SEQ ID NO: 239483 - DNA, 518 bp, Homo sapiens
  misc_feature: GYAE6OF02FKJEN.4.18.B07.1.454.CMB.1.raw
  modified_base (395)..(395): a, c, t, g, unknown or other
  misc_feature (395)..(395): n is a, c, g, or t
  modified_base (402)..(402): a, c, t, g, unknown or other
  misc_feature (402)..(402): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttggagtggatgggacggatcaaccctaacacggtggcacaaacaacgcacagaagtttcagggcagggtcaccatgaccaggacacgtcctnacgcacngcctacttggaggtgagcaggctgagatcgtagacgacacggtccgtagtattacgtgtgcgtagagaggaagacgttggagtcggaatacgagtgtggtaggttaagagtaacgg

SEQ ID NO: 239484 - DNA, 747 bp, Homo sapiens
  misc_feature: GYAE6OF02IJ6HA.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccgaggtacaggtttggtgccagtcgtggggctggaggtgaagacgctgggcctcgagtgaaggtctccgtgacgtaaggcttcgtaggactaccgtaccgttccgaccggtctaactatactccgtacgtgggtcgccggaacgccggtccccgtaggaacgaagggtcgttagaggtggaggtcgggaacggtactaaccaaacccgtaacgaccgggtgaaccgaaacaaaccgaccgacaacgtaacggtaacgtttacggaacgggacgtaacggttacaaccgtacgtacggaaaccgtaaccgggaactacccggttaccgttacgaaccggacctaacgtaccggttacccgttacggttacggggtaacggttacgacggtaccgtacgggtactaggtaacgtacgttacgtacgggaccggtaaccggccgggtacccgttaggtttaccgttacggtaggtcgtaacggacggtaaggtaagggaacgtttacggttagggtaaccggtacggtaacgtcgtaaggttaccggttagggttaaggttaggttacggttaacccggg

SEQ ID NO: 239485 - DNA, 511 bp, Homo sapiens
  misc_feature: GYAE6OF02HV5XA.4.18.B07.1.454.CMB.1.raw
  modified_base (433)..(433): a, c, t, g, unknown or other
  misc_feature (433)..(433): n is a, c, g, or t
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
  modified_base (504)..(504): a, c, t, g, unknown or other
  misc_feature (504)..(504): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacgaagggcttggagtggagtgggacggatcaaccctaacaccgggtgacacaaacaacgcacagaagttcagggcaggtcacatcgacaggacacgtcctcagcacagcctacgtggaggtgagcaggctgagatcgngacgacacggccgtgtattacngtgcgagngaggaagtactgaggtcgagtacgagtgttggtaggttagngtaacgg

SEQ ID NO: 239486 - DNA, 630 bp, Homo sapiens
  misc_feature: GYAE6OF02GVD7Q.4.18.B07.1.454.CMB.1.raw
tcagagcactgtagcacgaccggtgctcgatttagtcgctgcgtaaggggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggataccaccttcaccggctactatatccacgtgggtgtcgacgacggccccctggaacaagggcttggagtggagtgggacggataccaaccctaacgaccggtggaccacaaacaacgcaacgaagaacgtttcgacgggcacgggtcaaccgtatcggaaccgagggacctacggtacccttagacgaccacacgccttaacgttagggacggtgacggcgacgggtctagagtacgtacgtaggaaccggaccgaccggggtaccgttacggttaacgttacgttggtacggcggaaggagggaaggaaacggtacgttaggaagggttaccggtaagtacgacggtacgttagggtttaggttaacggaggttaaccggg

SEQ ID NO: 239487 - DNA, 651 bp, Homo sapiens
  misc_feature: GYAE6OF02HI22E.4.18.B07.1.454.CMB.1.raw
  modified_base (188)..(188): a, c, t, g, unknown or other
  misc_feature (188)..(188): n is a, c, g, or t
  modified_base (225)..(225): a, c, t, g, unknown or other
  misc_feature (225)..(225): n is a, c, g, or t
  modified_base (417)..(417): a, c, t, g, unknown or other
  misc_feature (417)..(417): n is a, c, g, or t
tcagagcactgtagcacgaccggtgctcgatttagtcgctgcgtaagggggagcatcacccagcaaccacatctgtcctctagagaatcccctgagacgctccgttcctcaccatggactggacctggaggactcctcttcttggtggcagcagcctcaggacgcccactcccaggtacagttggtcnctagtctggggctgaggtgaagagcctgggcctcagngaagttctcctgcgaggcttcgaggctactaccttcaccggcttactagtactcctagtcgggtcgacgacacggccccgtaggtacgaagggcttgacggtgagtggacgtataccgaacctacgaccggtgacctacgaaacacgcacgaagtacgttcgaggacgcggtacacgtagcgacgaggtacnccgttaccttacgagacctaacgctaccgttacgtacgggtacgtaggacgtacgacggtacgtacggacgtacgttacgaccgggtacgtaaccgtacgggttacccgtaagttaaccgttaacgtcggttacgccgtacggtacggaacggtaacgttacggttagggtaacggttacccggaagttaccgtaggtcgttaacggttacgggttaaggtacggttaaccggg

SEQ ID NO: 239488 - DNA, 561 bp, Homo sapiens
  misc_feature: GYAE6OF02G5EX8.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccgaggtacagttggtgcagtctggggctgaggtgaagagccgtgggcctcagtgaggtctctgcaggctctgatacaccttcaccgcgtactatatccacgtgggtgcgacacggccctggacagggcttgagtgagtgggacgatccaaccctaacgaccggtgcaacaaaccaacgacacaagaacgtttcgaggggacgacgggtacaccatacgaccgagggacacggtccttcgacgcacgacgtcctacgtggaggtgagacgaggcgagagtactcgtacggacgaccgaccggaccggttgtaacgttacgtgtcgcgaggaggagggaacgtagtcggaaggtacgaagtacgacgtcgtggttaggttaaggagttaacggg

SEQ ID NO: 239489 - DNA, 576 bp, Homo sapiens
  misc_feature: GYAE6OF02HTV32.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggagtgggacggatcaaccctaacgacggtggacacaaacaacgcacagaagttcgagggcaggggtcaccatcgaccgagggactacgtcctttacagcacacgcctacgttggaggttgacgcgtaggctagacgtagtcgtacgacgaccgacggccgttagtaacgtttacgtggtacgacggaggaaggaaggaacggtacgttggtaaggttaccggaattacgacggtacgttaggttacggttaaggtaggttaaccggg

SEQ ID NO: 239490 - DNA, 542 bp, Homo sapiens
  misc_feature: GYAE6OF02GKA09.4.18.B07.1.454.CMB.1.raw
  modified_base (374)..(374): a, c, t, g, unknown or other
  misc_feature (374)..(374): n is a, c, g, or t
  modified_base (514)..(514): a, c, t, g, unknown or other
  misc_feature (514)..(514): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcgagtgaaggtctcctgcaaggcttctggatacaccttcaccggctactatatccactgggtgcgacaggcccctggacaagggcttgagtggatgggacgatcaacctaacgacggtgcacaaacacgcacagagttcgaggcaggcacatgacnggacacgtcctcagcacagccttacgtggaggtagacgacgaggctaggagtactcgaggacgaaccgacgggtccgtagttacgttaacgttgtacggcgaggtaggaaggaagtacgttggaacggtcggaagtacgnggtacctggtacggttaagaggttacgg

SEQ ID NO: 239491 - DNA, 611 bp, Homo sapiens
  misc_feature: GYAE6OF02FZ9VH.4.18.B07.1.454.CMB.1.raw
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccacctcccaggtacagttgtgctagtcgtggggctgaggtgaaggaagccggtggggcctcgaggtgaaggtctccgtgcaacggtcttcgtaggactacctaccttcaccggtcttaactatactccactaggtgcgacgacggcccgtaggacgaagggtcttggagtcggagtgggacgataccaacctaacgacggtgacaacaacaacncaanagtaagttcgaggtcacggtacactagcgacgaggacacgtcctcgagccacgacgtacctacgttggagtgacgacaggtctaggagtattcggacgacgaccgtaccggtacgttacgttacgtttacggtggtacgacggtagaacggtaagggtaagtaccggttacggtaacgggtacgtaacgttacgacggttcggtagggtttagggtaagaggttaaccgg

SEQ ID NO: 239492 - DNA, 756 bp, Homo sapiens
  misc_feature: GYAE6OF02GJ52L.4.18.B07.1.454.CMB.1.raw
  modified_base (259)..(259): a, c, t, g, unknown or other
  misc_feature (259)..(259): n is a, c, g, or t
tcagagcactgtagcacgaccggtgctcgatttagtcgctgcgtaagggggagcatcacccagcaaccacatctggtcctctaggagaactcccctggacgagctccgttcctcaccatggactcggacctggaggactcctcttcttaggtggccagcagcctcaggagcccactcccaggtacagtttggtgcagtctggggctggaggtgaagaacgccgtgggcctcgagtgaaggtctccgtgcaaggcttcgnggactacacctttcaaccgggctaactatactacccacgttagggttcgacgacgacggcccccttaggaaccgtaaacgggggcctttaggaaggttcgggacgttaggggaaccgggtacgtaccgaaacccccttaaacgaccccgggttggccgaaccaaaaccgtaaccggaccgaacaacggaaagtttttacccgaaggggtacctaacgggggttaccaaccgtacgttacggaaccgtaggggaaccacgttccctttacgacgcaacgagaccctacgttgggaggttagacggtcgaacggctacgggtacgacttccgtaggtaaccgaccgtaccgggccgttacggttaacttacgttcgggtacgtaccggaaggtacggaacgggtaaacggtaaccgtttagggaaccgttacgggtaacgttaccggtaacggtacgttacggtttaggggtttaaacggaacgggtttaaacccgggg

SEQ ID NO: 239493 - DNA, 647 bp, Homo sapiens
  misc_feature: GYAE6OF02GCGCA.4.18.B07.1.454.CMB.1.raw
  modified_base (185)..(185): a, c, t, g, unknown or other
  misc_feature (185)..(185): n is a, c, g, or t
  modified_base (246)..(246): a, c, t, g, unknown or other
  misc_feature (246)..(246): n is a, c, g, or t
  modified_base (453)..(453): a, c, t, g, unknown or other
  misc_feature (453)..(453): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgnagtctggggctgaggtgaagaagccgtgggcctcagtagaaggtctcctgcaaggcttcgnggataccaccttcaccggtctactatactccacgtaggtcgcgacgacggccccgtggaacgaacgggtcttggacggttggacgtagggacggactaccgaacccgtaacgaccgggtcggaccgaaacaaaccgaacgtaccgaacgaagtaacgtttccggagggacgtacggggtaccaccgtagtacgaccgagggtaaccnccgttaccgtacgagtacgaacctacgacccgttacgttgggaacggttacgacggcgtaacggccgtaaggacgtaacgtcgaacgtaccgacgtcccggtacgttagtacttacgtggacgtacgagaaggtacggaacggtacttagggacgttagtactacgaggtcttagggtacggtaagtggtaccg

SEQ ID NO: 239494 - DNA, 554 bp, Homo sapiens
  misc_feature: GYAE6OF02I4RGH.4.18.B07.1.454.CMB.1.raw
  modified_base (161)..(161): a, c, t, g, unknown or other
  misc_feature (161)..(161): n is a, c, g, or t
  modified_base (183)..(183): a, c, t, g, unknown or other
  misc_feature (183)..(183): n is a, c, g, or t
  modified_base (221)..(221): a, c, t, g, unknown or other
  misc_feature (221)..(221): n is a, c, g, or t
  modified_base (399)..(399): a, c, t, g, unknown or other
  misc_feature (399)..(399): n is a, c, g, or t
  modified_base (445)..(445): a, c, t, g, unknown or other
  misc_feature (445)..(445): n is a, c, g, or t
  modified_base (499)..(499): a, c, t, g, unknown or other
  misc_feature (499)..(499): n is a, c, g, or t
  modified_base (527)..(527): a, c, t, g, unknown or other
  misc_feature (527)..(527): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggancccactcccaggtacagttggngcagtctggggctggaggtgaagaagccgtggggcctnagtgaaggtcctcgtgacgaaggcttcgtggaataccgaccttcacccggctactatactcccattggtgcgacacggcccctggacgaagggccttgacgtggagtgggacggatccaacccgtaacaccgggtcgacaacaaacgaacgccacgagaagtttcagggcaggcaccntacgacgagggacctacgtcctacagacacacgcctacgtggaggngagcgaggctagagctcgtagacgacacgggccttgtacttatcgtgcgagganaggaagtacgttagaggtacgagtaacnggtcctaggtaggttagtagtaaccgg

SEQ ID NO: 239495 - DNA, 656 bp, Homo sapiens
  misc_feature: GYAE6OF02H3WM6.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtgggctggaggtgaagaagccgtggggcctcgagtgaaggtcctcgtgcgaaggcttcgtggataccacctttcgacccggtactaacgtatactacctacgtgggtgacgaacgaccggaccccgtagggaaccgtaaggccgttggaacggtggaagtgggaaccggataccaaacccgtaacgaccgggtcgacaaccgaaacgaacgacaacgtaagtaacggttacgaacgggtcaacgggtccaaccgagtcggaaccgagggtaacctaccgttacttaccgagactacgtacgaccttacgttagggacggtgacgacggacgtgtaggagtactcgtaacggacgtacgaccgggtacgttacgtagttacgtagtcggacgtaaggacgtaacgggtaagtacgttggtaacgtacgtaatacggattcgtaggtttaacggtaggtagttaacgg

SEQ ID NO: 239496 - DNA, 975 bp, Homo sapiens
  misc_feature: GYAE6OF02G4AY0.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccaggtacagttggtgcagtcgtggggctggaggtgaagaacgccgtcggggcctcgaggtgaacggtcctccgtgacgaaggtcttcgtggaacttacctacccgttaccgaccggtacttaacttacgttactacccgtacggttggggtcgtaccggaaccgaccgggtaccccccggtagggaaccggtaacggggtccgtttagggaacggttaggggtaacgggttacgggggaaccggtaacttaaccccgtaaaacccccggttaaacccggtaaccccggggtacggaaaccccgtaaaaccgaaaaacccggtaaccgaaccgaaacgtaaacgggttaaacggtttacgggaaacggggtccgaacggggttaacccaacccgtaacgtacggaacccggtaacggggaacccgttaaccggttcccttacgaaccggtaccctaaaccgtacccggttaaccgttacgggttacgggtaacgggttacgggaacggtaccggtaacggggtccgtaaagggtacgtaaccggttaccggtaaccgggtaaccggtaacccgggtaacccggggttacccgggtttacggtttaaaccggttttaccgggtaacgggtttaccgggaaccgggtaaacggggtaaccggggtaaacgggttaaaccgggttaaccgggtttaacgggggtaaaccgggtttaaccggggtaaaccgttaacccgggtaacgggttttcgggttaaacggggttttaacggggttaaaccggggttacggggtttaaacccgggg

SEQ ID NO: 239497 - DNA, 760 bp, Homo sapiens
  misc_feature: GYAE6OF02IMCOV.4.18.B07.1.454.CMB.1.raw
  modified_base (228)..(228): a, c, t, g, unknown or other
  misc_feature (228)..(228): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctgggctgaggtgaagagcctgggcctcgagtgaaggtcncctgcaaggcttctggactactacctcaccggtctactactatccactcggggtgaccgacgacggccccgtaggacgtaagggtcgttcggaggtacgggtaggtaggggaaccggtaactacccgaaccccgttaaaccgacccgggtaggaccgaaccaaaccgaacggtaccaacgagtaacggtttaccgaggggtaccgacgggtaccgaaccgtacgtacggtaaccgacgggtacccaacccggttacccttacgaacggaccctaccgtaccggtaccttaacgggttacggtagggtacggaggtccgacgggtacgtacggaaggtagtaccgttcggtaacccgaccgtaaccgggtcccgttaaggtttcggtttaaacttccgggtaagggtaccggtaacgggtaacgggtaacggtaacgggggtaacttacgggtaacggggttaccgttaaggttaccggtaacggttccggttaacgggtttaggggttaaccgggtaagggtttaaccgggg

SEQ ID NO: 239498 - DNA, 723 bp, Homo sapiens
  misc_feature: GYAE6OF02H1BIL.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcgagtgaagggtctccgtgcaaggtcttcgtggatacacctttcaccggctactatatccactgggtgcgacacggccctggacgtaagggcttgacgtggagtgggacgactacaacctaacgacggtggacaacaaacaacgacacgaagtaacgtttacgacggggacgtacgggtacctaacccgtaagtacgggaacccgtaacggggtaacccgtaaccggtttacccgtttaccgaaacggacccgtaaccgtaaaccggtacccgttaacccgtttaggggaacggtttacggaacggtaccgaagggtaccgtaggaacggtaataccggttacgaaccggtaaccgaaccgggtaccggttagttaacgttaacgtcggttacggacggtaacggaaggaacgggtaaacggtaacgtttagggaacggttaccggaacgttaacgacggtaccggtttagggttaaacgggtttaggtaacggttaaaccggg

SEQ ID NO: 239499 - DNA, 580 bp, Homo sapiens
  misc_feature: GYAE6OF02GQNLT.4.18.B07.1.454.CMB.1.raw
  modified_base (476)..(476): a, c, t, g, unknown or other
  misc_feature (476)..(476): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaggcttcgtggataccaccttcaccggctactatactcccacgtgggtgcgacgacggcccctaggacaagggtcttaggaggtggagtgggacggataccaaaccccgtacgaccggtgaccaaccgaaacaacgcaacgagtaacgtttcgacgggcgaggtccacgatacgaccgaggaccacgtccttacacgcacgacgtccgttacgtggaggtacgagacgacggactgagtntaccgtacgaccgacgaccggtccgttagttacttcgtagcgcgtaggagtaggaagtacgtggacgtagagtacgcgtacgttggtacggttagaggtaccgg

SEQ ID NO: 239500 - DNA, 662 bp, Homo sapiens
  misc_feature: GYAE6OF02FYLPR.4.18.B07.1.454.CMB.1.raw
  modified_base (378)..(378): a, c, t, g, unknown or other
  misc_feature (378)..(378): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactccccaggtacagttggtgcagtcgtggggctggaggtgaagaagccgtggggcctcagtgaaggtctcctgcaaggcttcgtggatacaccttcgaccggctactatactccacgtgggtgcgacacggcccctaggacgagggcttggagtggagtgggacgctaccaaccgtaacgaccggtgcaacaacacgcacagtagttcgaggngacggtaccacagtacgaccgacgggaccgtacgttccttacgacgccaaccgacggtacccttacgtagggtacggtacggtacggcgaacgggtcgtacgaggtactacgtacggaccgtaaccggaccgggtacccgtttagtaaactttacggtagggtacggaccggtagggagggtacgggttaaaacggtacggttaacgggtaacggttaccgggtaacgtacgtaacggttacggtttacggtttaacggggtttaaggtaccgggttaaccggg

SEQ ID NO: 239501 - DNA, 657 bp, Homo sapiens
  misc_feature: GYAE6OF02IWR07.4.18.B07.1.454.CMB.1.raw
  modified_base (283)..(283): a, c, t, g, unknown or other
  misc_feature (283)..(283): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagccgtggggcctcagtgaaggtctcctgcaaggcttctggatacaccttcgaccggtctactatactccacgtgggngcgacgacggccccgtaggacgagggtcgtgaggtggagtagggacggactacaacccgtacgaccggtgacaacaacaacgcaacgagtaacgtttacgagggtacgtacgggtaccaccgtagtacgaaccgaacgggtaacccgtacgttacccgttacgaacgccaacgtacgtacccgttaacggttgggagggttaggacggacgaggtcgtagagtactccgtaggaccgaacgtaccgggtacgttacgttaacttccggttagtcggtaggtaggaacggtaagggtaacggttacgttacgggtaacggttacggaacgttaacggtcggtacggttagggtaaggtttaaggtaggttaccgg

SEQ ID NO: 239502 - DNA, 639 bp, Homo sapiens
  misc_feature: GYAE6OF02JHMKJ.4.18.B07.1.454.CMB.1.raw
  modified_base (348)..(348): a, c, t, g, unknown or other
  misc_feature (348)..(348): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagccctcaggacgcccactcccgaggtacagttggtgcagtcgtggggctggaggtgaagacgccgtggggcctcgagtgaacggtctccgtgcgaaggcttcgaggactactaccttcgaccggtcttactactactcctacgtgggtcgacgacgacggtcccctaggacgaggtctggaggtggagtgggacganccgaacctacgacggtgacaacgaaacacgcaacgaagtacgttcgaggacgaggtaccactacgtacgaccgaggacctaccgtccttacgacgacaacgacgtaccgtacgtaggaggtgacgcgtaggctaggacgtagtacgtacggacgaccgacggtccgttagttacgttacggtaggtacgaccggaggtacggaacggtaacggttacgttacgggaaggtaaccggtaagtaccgtacggtaccggttagggtttaacggttaagggtaccggttaacggg

SEQ ID NO: 239503 - DNA, 643 bp, Homo sapiens
  misc_feature: GYAE6OF02JP76U.4.18.B07.1.454.CMB.1.raw
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (302)..(302): a, c, t, g, unknown or other
  misc_feature (302)..(302): n is a, c, g, or t
  modified_base (614)..(614): a, c, t, g, unknown or other
  misc_feature (614)..(614): n is a, c, g, or t
tcagagcactgtagcacgaccggtgctcgatttagtcgctgcgtaagggggagcatcacccagcaaccacatctgtcctctagagaatccctgagagctccgttcctcaccatggactggacctaggaggatcctcttcttggtggcagcagcctcgaggacgcccacgtcccaggtacaggttcggtgcaggtcgtggggctggaggtgaagaagtccgtggggcctcgagttgaaggtctcctagctaaggcttntggatacnccttacaccggtacgtactactatccgacgtgggtcnccgagacggaccccgtggaactaagggtcttggaggtggtacgtgggacggtactaccgaaaccgtacgcggtgacacgaaactacgacagaagtaacgttcgaagggcaacgggtcaaccgtagtacggaacgacggaacctaccggtacttcgaacggtcccaacgtacgtacccttaacggtagggaacggtcgaacgtacgaagggtctaggacggtcgtacgcggacgaacgtacggaccgttagttacgtacgtaggtcgtagacgagggtaacgaacggtacttaggacgtaccgtaagacccgngtttacgacggttagttaggacggtaacg

SEQ ID NO: 239504 - DNA, 585 bp, Homo sapiens
  misc_feature: GYAE6OF02FZ85O.4.18.B07.1.454.CMB.1.raw
  modified_base (297)..(297): a, c, t, g, unknown or other
  misc_feature (297)..(297): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcgagtgaaggtctcctgcaaggcttctggatacaccttcaccggctaactatactccactgggtgcgacacggccccgnggacgaagggcttgacgtggatgggacgatcaaccctaacgaccggtagcaacaaacaacgcacagagttcgaggcgagggtcacatacgacgagggacaccgtcctcacgcacacgtccctacgtggacggttagacgcgaaggtcgtaggacgtacgttacgtacgacggaacgaccgggtaccgttaggttacgtacgttagtacggacgagtacgggaaggtaacggtacttaggacggttacgtacgtacgagtacgtaggtaggttaacggtaggttaccgg

SEQ ID NO: 239505 - DNA, 755 bp, Homo sapiens
  misc_feature: GYAE6OF02H9Y2Z.4.18.B07.1.454.CMB.1.raw
  modified_base (621)..(621): a, c, t, g, unknown or other
  misc_feature (621)..(621): n is a, c, g, or t
  modified_base (743)..(743): a, c, t, g, unknown or other
  misc_feature (743)..(743): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagacgccgtggggcctcgagtgaacggttcctcctagcgaacggtcttcgtaggacgtacctaccctttaccgacccggtacttaaccttacgttaccgtccccgtaacggttcggggtcgaccggtaccgacgggcccccgtagggaaccgaagggtccgtttacggtagggttacgggaggtacgggggaacggtacctaaccccgtaaccccgttaacggtaccccgggtacggaccaacctaaaccgaacggaccaacgtacgtaacggtttaccggaggggaccgtaacggggtacctaaccggtacgtacggaacccggtacggggaccgtacccgttccgttacgacgacctacggtacacccggtttacggttcgggaggttacgacggcggtacggcgtagaacgtnaccgtacgacggacgaccgtacgttagttactacgtgacgacggtagaaccggtaggtaaccggtggttacgaaggttaccgggaatttaccggacggttcggtaaggttacgggttaacgnggtttaacccgg

SEQ ID NO: 239506 - DNA, 509 bp, Homo sapiens
  misc_feature: GYAE6OF02JHTZR.4.18.B07.1.454.CMB.1.raw
  modified_base (332)..(332): a, c, t, g, unknown or other
  misc_feature (332)..(332): n is a, c, g, or t
  modified_base (419)..(419): a, c, t, g, unknown or other
  misc_feature (419)..(419): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgacgtggatgggacggatcaaccctaanaccggtggcaacaaacaacgcacagaagtttcaggcaggtcacatgaccaggacacgtcttcagcacagcacttgaggtgagcaggnttcgagatcgtgacgacacggcgtgtactactgtgcgagaggaggaagtactgagtcggatacgagtctaggtagttaacggagtaacgg

SEQ ID NO: 239507 - DNA, 529 bp, Homo sapiens
  misc_feature: GYAE6OF02JT519.4.18.B07.1.454.CMB.1.raw
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
  modified_base (271)..(271): a, c, t, g, unknown or other
  misc_feature (271)..(271): n is a, c, g, or t
  modified_base (343)..(343): a, c, t, g, unknown or other
  misc_feature (343)..(343): n is a, c, g, or t
  modified_base (495)..(495): a, c, t, g, unknown or other
  misc_feature (495)..(495): n is a, c, g, or t
  modified_base (506)..(506): a, c, t, g, unknown or other
  misc_feature (506)..(506): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttcggtgcagtctggggctgaggtgaagagcgtgggcctcagngagtctcngacagctcngatacaccttcacgctactatactccagtggtncgacacggcccgtggacgaggtctgagtgagtaggacgacacaacctacgacggagacaacaacgacgacanagtacgtacgaggtcgaggtacacgagacgacgaggtaccacgtccgtacacgcacgtacgtactacgtacggacgtagacgacgacgcgtagcgaatcgtagaccgtacgacgtcgtagtatacgtgacgagaggacgaggaagtcgtagngtacgatacgngtacgtggtacgtagtgtaacgg

SEQ ID NO: 239508 - DNA, 599 bp, Homo sapiens
  misc_feature: GYAE6OF02I4SX4.4.18.B07.1.454.CMB.1.raw
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (590)..(590): a, c, t, g, unknown or other
  misc_feature (590)..(590): n is a, c, g, or t
tcagagcactgtagcacgaccggtgctcgatttagtcgctgcgtaagggggagcatcacccagcaaccacatctgtcctctagagaatcccctgagagctccgttcctccaccatggactggacctggagatcctcttcttggtgcagcagcctcgaggacgccccacctcccgaggtacagttggtgcagtcgtgggctggaggtgaagagcgtgggcctcgagtagaggtctctgacagcttcngatacncctcgacgtctatntactcgacgtggtncgacgacggcccgtaggacgaggtctggagtggagtaggacgactaccgaaccgacgacgtgacaacaaacacgacaacgagtacgtacgaggacgacggtaccactagacgaccgaggacctacgtcctacgacgcacgacgtacctaaggtggacggttcgacgacgtacgcgtagacgtacgtacggtacggaccgtacgaacccggttcgttaagttacgtacgtgtacgacggtaggaaggtaacgggtaacgtacgtaggtacggaccgtaagacgacggttagttacgggtaaggtaaccggnggttaacgg

SEQ ID NO: 239509 - DNA, 508 bp, Homo sapiens
  misc_feature: GYAE6OF02FGU5U.4.18.B07.1.454.CMB.1.raw
  modified_base (433)..(433): a, c, t, g, unknown or other
  misc_feature (433)..(433): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacacctttcacccggctactatatccactgggtgcgacaggcccctggacaagggcttgagtggatgggacggatcaaccctaataccggtggcacaaacaacgcacagaagtttcagggcagggtcaccatgaccagggacacgtcctcagcacagcctactggaggtgagcaggctgagatcngacgacacggccgtagtattactgtgcgagagaggaagactgagtcggatacgagcgtaggtaggtagagtacgg

SEQ ID NO: 239510 - DNA, 624 bp, Homo sapiens
  misc_feature: GYAE6OF02JH8HM.4.18.B07.1.454.CMB.1.raw
  modified_base (186)..(186): a, c, t, g, unknown or other
  misc_feature (186)..(186): n is a, c, g, or t
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccgaggtacagttggtncagtcgtggggctggaggtgaagagccgtgggcctcagtgaggtcnctgcaggcttcnggatacaccttcgaccggactactatactccgagtcgggcgtacgacgacggccccgtaggacgacggtcttagagtggagtgggacgtagtaccaaccgtaacgaccggtgacgaacaaacacgacacgagtaacgttcgaggacgacggtacacgagtacgaccgacggactaccgtaccgtacgacgacgaaccgagtccgtaggtcggtacggtagacgtacggaggtcgtaggtacgtcgtcgtacgacgaccgacggtaccggttagttaccgtagcgggtacgagggtacgtaacggacgggtaacgtagttacggaaggtacgtaagtaacggtacggtccgttagggtacggttaaggtaggttaacccgg

SEQ ID NO: 239511 - DNA, 582 bp, Homo sapiens
  misc_feature: GYAE6OF02FNTV1.4.18.B07.1.454.CMB.1.raw
tcagagcactgtagcacgaccggtgctcgatttagtcgctgcgtaagggggagcatcacccagcaaccacatctgtcctctagagaatccccctgagagctccgttcctcaccatggactggacctggaggatcctcttcttggtggcagcagcctcaggagcccactcccaggtacagttggtgcagtctggggctgaggtgaagaagccgtggggcctcgagtgaaggtctcctgcaaggcttcgtggatacgaccttcgacccggctactatactccacgtgggtcgcgacacggcccctggacgaagggtcttggacgtggagtgggacggataccaaaccccgtaacgaccggtggaccaacaaaccacgacacagaacgtttcgagggcaggtcaccatgaccgaggacacgtctcagcacgacgcctacgtggaggtagacgcgtaggctaggacgtatcgagacgacgaccggtccgttagtaacttacgtgtacggacgagacggaggaacgtacgttaggacggtacggactaacggtacggaccgttaggtacggttaaggaggttaacgg

SEQ ID NO: 239512 - DNA, 731 bp, Homo sapiens
  misc_feature: GYAE6OF02HX8AJ.4.18.B07.1.454.CMB.1.raw
  modified_base (219)..(219): a, c, t, g, unknown or other
  misc_feature (219)..(219): n is a, c, g, or t
tcagagcactgtagcacgaccggtgctcgatttagtcgctgcgtaagggggagcatcacccagcaaccacatctgtcctctagagaatccctgagagctccgttctcaccatggactggacctggaggatcctcttcttggtggcagcagcctcaggacgcccactccccaggtacaggttggtgcagtctggggctgaggtgagacgcgtgggctcgngtgaggtctctgacgagtctctggactaccgtacttccgaccggtcttactacgtactaccgacggtcggggtcgcgtaccgacgggtccccgtagggacgtaacgggcttacggtacggtcgggtacggtacgggaacggtacgtaccaaacccgtacgaccgggtcggacctaacgaaacgacgacgaacgtagtaacggttacgacgggacgtacgggaaccaccgtagtacggaaccggaggaccgtaaccgtcgttaccgagaccgtagaccgttacgtacggttacgggaacgttgggaccgacggtacggtaggtcgaaggtacgttccggaaccggtaccgtaaacccggggtacccggttaccggttaaaggttttaccgttaacggtacggttacgggacgggtacggttaagggaacggggtacgttaacggtaggggaacggttacgggaactacggtaggtaccggttaggggttaacggttaggtaggtttaaccggg

SEQ ID NO: 239513 - DNA, 750 bp, Homo sapiens
  misc_feature: GYAE6OF02GB07S.4.18.B07.1.454.CMB.1.raw
  modified_base (183)..(183): a, c, t, g, unknown or other
  misc_feature (183)..(183): n is a, c, g, or t
  modified_base (244)..(244): a, c, t, g, unknown or other
  misc_feature (244)..(244): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggngcagtcgtggggctgaggtagagaagccgtgggcctcagtgaagtctctgcacggcttcgngactactaccttcgaccgctactactactccgacgtgggtcgacgtaccgacggtccccgtagggaccgtaagggtcctttagggaggtagggagtcggggaacgtaacgtaaccgtaaacccgtaaccggaccgggtacgaaccgaaacgaaaccgtaacgccgtaacgaagttaacggtttccggaaggggtaccggtacggggtaccacccgtacgtacggaaccggacgggtaacctacccggttaccctttacgaacggtaccgaaccgtaacgtaccgttacgttacgggtaacggttaggaccggtacggacggtacgtacggtaagtaccgtacggttacggaaccggtaccggtaccggtacggttaacgttacgttacggtacgggtacggacggtacggaacgggtacgggtaaacgtaacgggttacggtaacgggttacgaacggttaacgacggtacggttaggtaacgggtttaaggtacggttaaccggg

SEQ ID NO: 239514 - DNA, 617 bp, Homo sapiens
  misc_feature: GYAE6OF02F6W6T.4.18.B07.1.454.CMB.1.raw
tcagagcactgtagcacgaccggtgctcgatttagtcgctgcgtaagggggaggcatcacccagcaaccacatctgtcctctagagaatcccctgagagctccgttcctcaccatggactggacctggaggatcctcttcttggtggcagcagcctcaggagcccactcccaggtacacgttggtgcctagtctggggctggaggtagaagaacgccgtggggcctcgagtgaacggtctctgacgaacggcttcgtggatactaccttcgaccggtctactatactcctacgtggtcgacgacacggccctggacgaggtcttggagtggtagtgggacgtagacctaacccgtaacgaccggtgacaacaaacacgacacgataacggttcgagggtcgaacggcctaacagtacgacgacggaactccgtactccgagtccaacgtcgaccgttaacggtacggtacggtacgacgacgtcggacgttgacggtacttcgagtacccggacgtacggtccgttagtacttacgtcgtaggacgtaggaacgtaggtaacggtacgttggaaggttcgaacgacgtgtaccgtaggttacggtagtacggtacgg

SEQ ID NO: 239515 - DNA, 622 bp, Homo sapiens
  misc_feature: GYAE6OF02IBMTK.4.18.B07.1.454.CMB.1.raw
  modified_base (161)..(161): a, c, t, g, unknown or other
  misc_feature (161)..(161): n is a, c, g, or t
  modified_base (184)..(184): a, c, t, g, unknown or other
  misc_feature (184)..(184): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggancccactcccaggtacagttggtncagtctggggctgaggtgaagaagccgtggggcctcgagtgaaggtctcctgcaagtcttcgtgatacaccttcgaccggtctaactatactccacgtgggtcacgacgacggcccctaggaccaagggtcttggagtggagtcgggacgataccaaaccctaacgaccggtgacaacaaacacgacacagtagttcgaggcagggtcaccgagtcgaaccgaggacctacgtccttacaacgcaacgcgaccttacggttaggaggttacgacgacgtacgggcttaggaagtcgttacgaggaacccggacgtaaccgggttaccgtagttaaccgttacgtgtacggacggacggaaggtaggtaaacggtacgttagggaacgtacggtaataccggtaggttacgtaggttaagggttaacgtaggttaacgg

SEQ ID NO: 239516 - DNA, 719 bp, Homo sapiens
  misc_feature: GYAE6OF02F6QEE.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggcgcccactcccaggtaccagttggtgcagtctggggctgaggtgaagagccgtggggcctcgagtggaaggtctcccgtgacgaacgggtcttcgtggactaaccgaccctttaccgacccggtcttaacgttactaccgtcctaccggttgggtcggaccgtaaccgacgggtcccccgtaggaccgtaacggggtccttaggaaggtagggacgtacggggacgtacctacccgaaaccccttaaccgaccgggttcggacaaccgtaaacaaccgcaacgaagtaacgtttcgaaggtccgtagggtaccacggatacgaaccggacggaactaccgtccttacgagaccaccgtacgtaccgtaccgttaggaggttacgtcgacgcggagttaccggaatcgttacgacgtacggaccgtacgggcctttacgtaactttacggtgtaccggcggtaacggaggaacgggtaacgtaacggttacgggtaaccgtacggtaattaaccggaggtacccgttaggggtttaacggttaaggtacggtttaacccgg

SEQ ID NO: 239517 - DNA, 596 bp, Homo sapiens
  misc_feature: GYAE6OF02G7LXE.4.18.B07.1.454.CMB.1.raw
  modified_base (287)..(287): a, c, t, g, unknown or other
  misc_feature (287)..(287): n is a, c, g, or t
  modified_base (484)..(484): a, c, t, g, unknown or other
  misc_feature (484)..(484): n is a, c, g, or t
  modified_base (571)..(571): a, c, t, g, unknown or other
  misc_feature (571)..(571): n is a, c, g, or t
  modified_base (590)..(590): a, c, t, g, unknown or other
  misc_feature (590)..(590): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagaagccgtggggcctcagtgaaggtctcctgcaaggcttcgtggatacaccttcacccggtctactatatcccacgtgggtncgacacggcccctggacgacgggtcttggagtggagtgggacggataccgaaccctaaccgaccggtggaccaacgaaacacgcaacgagtaacgtttcgagggtacgagggtaccacgacgtacgaacccggagggaccaaccgttccgttacgacgaccacgacgtcccttacgttgggacggtcgacggtacgnggctaggagtctacgtaggaccgtacgcggtccgtagttacgtacgttgcgcggagagaggaagtacgttaggacggtagagtacgnggtaccgtgtaggttaggngtacgg

SEQ ID NO: 239518 - DNA, 609 bp, Homo sapiens
  misc_feature: GYAE6OF02GE850.4.18.B07.1.454.CMB.1.raw
  modified_base (320)..(320): a, c, t, g, unknown or other
  misc_feature (320)..(320): n is a, c, g, or t
  modified_base (414)..(414): a, c, t, g, unknown or other
  misc_feature (414)..(414): n is a, c, g, or t
  modified_base (455)..(455): a, c, t, g, unknown or other
  misc_feature (455)..(455): n is a, c, g, or t
  modified_base (506)..(506): a, c, t, g, unknown or other
  misc_feature (506)..(506): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtagaagaagccgtggggcctcagtgaaggtctcctgcaaggcttctggatacaccttcaccggctaactatactccactgggtgcgacacggcccctggacaagggcttggagtggangggacgatccaaacccgtacaccgggtgacaacaaacaacgcaacagaagttcaggggctagggcacatagacagggacacgtctcagcacacncctaacgttgggaggtgagacggagcgtacgagacttacgnggtaaccgaaccgtcgggtaccggttacgttaacctttacgtcgttacggnggaacggaagggaacgggtaaacggtaacgtttagggaacggtttacggaacgttacggaggtaccggtttagggtaagggtttaacggtaggttaaccgggg

SEQ ID NO: 239519 - DNA, 683 bp, Homo sapiens
  misc_feature: GYAE6OF02I6RMZ.4.18.B07.1.454.CMB.1.raw
  modified_base (255)..(255): a, c, t, g, unknown or other
  misc_feature (255)..(255): n is a, c, g, or t
  modified_base (380)..(380): a, c, t, g, unknown or other
  misc_feature (380)..(380): n is a, c, g, or t
tcagagcactgtagcacgaccggtgctcgatttagtcgctgcgtaagggggagcatcacccagcaaccacatctgtcctctagagaatcccctgagagctccgttcctcactatggactggacctggaggatccctcttcttggtggcagcagcctcgaggagcccacctcccaggtacaggttggtgcagtcgtggggctggaggtgaagaagccgtggggcctcgagtgaacggtcctctgacaaggcttcgnggatacaccttcgaccggtctactacgtactaccctacgtcgggtcgcggtaccacgggccccctaggaccgaagggtcgtgacggtggaggtgggaccgagtaccaaaccccgtaacgaccggngaccgaacaaacgaaccgacaacgaagtaacgtttacggacgggacgacggggtaccaccgtagtacgaacccgacgggtaaccgtaccggtcccgtttaccgacgaccgtaacgacgttacccttaacggtttacggagggttccgacgacgtaccgggtgtacggtaacgtagtccgtacgaccggaaccgtacggtacccggtagttacgttacgtggaccgtagacggtaaggacgtaagtacggttagtacggtacggaacgtacgacggtaccgttggtaaggttagacggttacgg

SEQ ID NO: 239520 - DNA, 691 bp, Homo sapiens
  misc_feature: GYAE6OF02F97SR.4.18.B07.1.454.CMB.1.raw
  modified_base (244)..(244): a, c, t, g, unknown or other
  misc_feature (244)..(244): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtgggctggaggtgaagagccgtgggcctcgagtgagtctcctgcaaggcttcgngatacgaccttcaccggctactatatcccagtgggtgccgacacgggccccctagggacaacggggtccttggacggttgggagtacggggaccggtatccgtaaacccctaaccgacccggtggaccaacgaaaccgaacgtaccaacgagtaacgtttacgagggtacgacggggtacaacccgagtacggaacccgaacgggaccgtaccggtacccgttcctaaggaccaccgtacgtacccgttagttacgggacgggttaggacgtccgtaggtccgtaaggagtacgttacgtacggaaccggtaccggaaccgggtcgttcggttaacctttacggtacggtaggaccggtaggaaggaaccgggtaaagtaccggttgggtaaacgtacggggaacttacggacgtacgggttgttaaggggttaagaggtttacggg

SEQ ID NO: 239521 - DNA, 620 bp, Homo sapiens
  misc_feature: GYAE6OF02FPH1N.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttcgtggatacaccttcaccggctactatatccactggggtcgcgacaggccccctggaccaagggccttggagtggatgggacggatcaaccctaacaccggtggcacaaacaacgcacagaagtttcgaggcagggtcaccgatcgaccagggacacgtccttcacgcacgacgccttacgtggaggttgacgcgaggcgtggagacttcgtggaaccgacgaccgggtccgttaggttaacttacggtgttacgacccggtagggaacgggtaacgggtaaacggtaaccggtttacgggaacgggtttaccggggaagttaaccggaggtaccggtttagggttacggggtttaaaggtacgggtttaaaccggg

SEQ ID NO: 239522 - DNA, 664 bp, Homo sapiens
  misc_feature: GYAE6OF02I59UM.4.18.B07.1.454.CMB.1.raw
  modified_base (256)..(256): a, c, t, g, unknown or other
  misc_feature (256)..(256): n is a, c, g, or t
  modified_base (467)..(467): a, c, t, g, unknown or other
  misc_feature (467)..(467): n is a, c, g, or t
  modified_base (507)..(507): a, c, t, g, unknown or other
  misc_feature (507)..(507): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgctagtcgtggggctggaggtagaagaacgccgtgggcctcgagtggaacggtcctcctgcgaaggcttcgnggataccaccttcgacccggctacctatactcctacgtgggtgcgacgacggcccgtggaccgtaagggtctagacggtggagtacgggacgactccaaaccccgtaaccgaccggtcggacaaccaaacaacgaccaacgtagtaacgtttcgaaggggcgtaacgggtaccaccgagtacgaacgtacgggaacctacgtccttacganccgaacgacgtacctacgtgggaggtagacgacgacggtntacggagtcgtacgtacggaccgtacggccggtacgttacgttaggttacgtacggtagtacgaggtaacggacgggtaaacgtacggtttagaaccgggttacggtaagtaccggtagtaccggttagggttaccggttaagtagggttaacccgg

SEQ ID NO: 239523 - DNA, 783 bp, Homo sapiens
  misc_feature: GYAE6OF02J0LIW.4.18.B07.1.454.CMB.1.raw
  modified_base (772)..(772): a, c, t, g, unknown or other
  misc_feature (772)..(772): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggagatcctcttcttggtggcagcagcctcaggagccccactcccaggtacaggttggtgcagtcgtgggctagaggtagaagagccgtgggcctacgagtagacggtctccgtagcgaaggtcttgtacggatacctaccttcgaccggtacttacgtatactacccgtagtgggtcgacgtacgaccggtccccgtaggaccgaaggggtcctttagggaggtacggtacggtaccgggaagaccttaccgaaaccccggtaacggccggttaggacccaacgaaacccgaccgggctaaacggtaacgtaaggtttaccgacggggtacgtaaccggggtacctaaccgtagtaccgaaccgggtaacgggaaccctaccggttacccgttcgtaacggaccgacgttaacggtaccctttaacgggtcgggtaagggtcgaacgggttaccggtacgggtactacgggtaacgtacgttaccgtacggtaaccggtaaacgggcccgggttaacgtttaacgttacccgttaacgggtagttaccgggacggtaacggtaagggacgggttaaacgttcggttaacgggtaagtaccggggtaaacttacggacggtcggtttaaccggtaggtttaaacggnggttaacccgg

SEQ ID NO: 239524 - DNA, 703 bp, Homo sapiens
  misc_feature: GYAE6OF02GC0ST.4.18.B07.1.454.CMB.1.raw
  modified_base (252)..(252): a, c, t, g, unknown or other
  misc_feature (252)..(252): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagtttggtgcagtctggggctggaggtgaagaagccgtggggcctcgagtgaacggtctcctgacgaaggcttcgnggatacaccttcaccggctacgtatatccactggtcgcgacgacggcccctggacgaagggcttggaggtggagtggggacggagtaccaaccgtaacgaccgggtcggacaacgaaacaacgacacgagtaacgtttacgagggacgagggtaccaccgactacgaacgacgggaaccacgttcccttacgacgacctacgaacgtcccttaacggtacgggacggttacgggaacggtcggaacgggtcgttaacgggaagtcgttaaccggtacggaaccggaaccgtaccggggtacccggtttggttaaaccgtttaacggttcggttacggacgggtaacgggaacggtaacggggtaacggaaccggtttaagggaacgggttacggtaaccgttaacgcggttaaccggttgggtaacggggtttaacgtaggttaacccggg

SEQ ID NO: 239525 - DNA, 577 bp, Homo sapiens
  misc_feature: GYAE6OF02FSA96.4.18.B07.1.454.CMB.1.raw
  modified_base (507)..(507): a, c, t, g, unknown or other
  misc_feature (507)..(507): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctgggctgaggtgaagagccgtgggcctcagtgaaggtctcctgcaaggcttcgtggatacaccttcgaccggctactatactccactggggtgcgacgacggcccctggacgagggcttgagtggagtgggacggatcaacccgtacgaccggtacggaccaacaaacgaacgacagagtaagtttacgagggcgaggtcaccgagtacgaccgagggactacgttcctacgagccacacgtacctacgttggaggtagagcgaggtctggagacgtcgtaggaccgacgtaccgggcgttagtacttacgtgtacgngaggagtaaggaaggtacgtaggtacgtacgagtacgacgtacggttaggtaggttaaggaggttaacgg

SEQ ID NO: 239526 - DNA, 613 bp, Homo sapiens
  misc_feature: GYAE6OF02IJ8RI.4.18.B07.1.454.CMB.1.raw
  modified_base (539)..(539): a, c, t, g, unknown or other
  misc_feature (539)..(539): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagaagcgtggggcctcgagtgaaggtctcctgcaggcttctggatacaccttcaccggctactatactcctacgtgggtgcgacgacggccccgtggacgaagggcttaggaggtggagtggggacggtactaccaacccgtaacgaccgggtacggacaacaaacaacgacaacgagtaacgtttacgacgggacgagggtaccaccgagtacgaccgacgggaacctaccgtactacgacgaccacgacgtaccgtaccgttgggaggtgaacgcgacggcgtaggacgtgtacgtacggaccgaccgtacggtccggtagttacttacgtgnggacgaggaaggacggtaagtacgtaggacggtacggtactacgagtacgttaggtaggttaaggaggtaacgg

SEQ ID NO: 239527 - DNA, 716 bp, Homo sapiens
  misc_feature: GYAE6OF02IU974.4.18.B07.1.454.CMB.1.raw
  modified_base (611)..(611): a, c, t, g, unknown or other
  misc_feature (611)..(611): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacaggtttggtgcagtcgtgggctgaggtgaagaagccgtggggcctcgagtgaggttctcctgcgaaggcttctggatacaccttcgaccggtctaactatactccacgtggtgcgacgacggcccctggacgacgggtcttggaggtggagtacgggacggtactaccgaaacccgtaaccgaccggtaggaccaaaccgaaaacaaccggaccaacgaacggtaaacgtttccggaagggtaccacgggtaccaacgacggtacgaccggtaacgggaaccctaccgttaccgttacgacgtaccgaactacgtaccgttacggttgggaacggttacgacgggtacgacgggttcgtacgtaaaccggtacgttccggtacggaaccgacggtaacccgggtaccgttacgtttaacgttccggttaacggnggtaccggaggtaacgggtaacggggaacgtttaacggttacgggaacggtcgggtaaactacgggtaggtcggttaggttaagggtttaacgagggtttaacgg

SEQ ID NO: 239528 - DNA, 617 bp, Homo sapiens
  misc_feature: GYAE6OF02JC84W.4.18.B07.1.454.CMB.1.raw
  modified_base (306)..(306): a, c, t, g, unknown or other
  misc_feature (306)..(306): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagccgtggggcctcagtgaaggtctcctgcaaggcttctggatacaccttcaccggctactatactccacgtggtgcgacacggcccctggacaggcttgngtggagtgggacgataccaaccctaacgaccggtgaccaacaaaccgaacgcacaggtaacgttcgacgggcgaggtcaccgagtacgaccgaggactacgtcctacgacgccacacgtacctagtcggaggttgagtcgacggtctaggacgtatacgtacgaccggacgaccgggtccgttagttaacgttacgtgtacggaccggtagaacgggtaaggtaacggttaacggttacggtaacggttacggtaacgttaccggtacggtacgtttaggggttaacgggtttaacggtaggttaacccgg

SEQ ID NO: 239529 - DNA, 731 bp, Homo sapiens
  misc_feature: GYAE6OF02GFE0R.4.18.B07.1.454.CMB.1.raw
  modified_base (251)..(251): a, c, t, g, unknown or other
  misc_feature (251)..(251): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagccccactccccaggtacagttggtgcagtctggggctgaggtgaagagccgtgggccctgagtagaacggtctccgtgcaaggtcttcgnggataccaccttcgaccggactactagtactccctacgtgggtcgccgaccgaccggccccgtaggacgaagggtccttggaggttcgggagtacgggacggactaccgaaaccccgtaacggtaccgggtaggaccaaacgaaaccgaaccgacgaacgtaaggtaaacgtttacggaacgggaccgtaggggtaaccacccgtaagtaaccgaccgggaacggtacctaacgttcccgttacgacgaccacgaccgtaccgttaccggtaggaacggttggacgacgtacgggtcctaggacgtactaccggtagaacccggtaggaacccgggtccgtttaaggttacttaacgttgggtacgggaccggaggacgggaaagggtaacggtttaacggttacgggttacggtaacggtaataaccggtacgttaaccgggttaggttaacggggtttaacgggacggtttaacgggg

SEQ ID NO: 239530 - DNA, 564 bp, Homo sapiens
  misc_feature: GYAE6OF02H1UTY.4.18.B07.1.454.CMB.1.raw
  modified_base (471)..(471): a, c, t, g, unknown or other
  misc_feature (471)..(471): n is a, c, g, or t
  modified_base (501)..(501): a, c, t, g, unknown or other
  misc_feature (501)..(501): n is a, c, g, or t
  modified_base (535)..(535): a, c, t, g, unknown or other
  misc_feature (535)..(535): n is a, c, g, or t
  modified_base (542)..(542): a, c, t, g, unknown or other
  misc_feature (542)..(542): n is a, c, g, or t
tcagagcactgtagcacgaccggtgctcgatttagtcgctgcgtaaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagaagccgtgggcctcgagtggaaggtcctcctgacaaggtcttcgtggataccacttcaccggctactatatccacgtggtcgcgacacggcccctggacgaaggcttgagtggagtgggacggataccaacccctaacgaccggtgacctaacaaaccaacgacacaagaacgtttcgaaggggtcagggtacaccagtcgaccgaggactacgtccttacgagtcaacacgaccttaacgtggaggtagagcacggtcgagantctagacgacgacggtcgtagtacgttagngtagacgagaggacgaagtacgtggtagtacganacgtagngtaggtaaggttagagttacgg

SEQ ID NO: 239531 - DNA, 561 bp, Homo sapiens
  misc_feature: GYAE6OF02H4217.4.18.B07.1.454.CMB.1.raw
  modified_base (182)..(182): a, c, t, g, unknown or other
  misc_feature (182)..(182): n is a, c, g, or t
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (357)..(357): a, c, t, g, unknown or other
  misc_feature (357)..(357): n is a, c, g, or t
  modified_base (378)..(378): a, c, t, g, unknown or other
  misc_feature (378)..(378): n is a, c, g, or t
  modified_base (454)..(454): a, c, t, g, unknown or other
  misc_feature (454)..(454): n is a, c, g, or t
  modified_base (488)..(488): a, c, t, g, unknown or other
  misc_feature (488)..(488): n is a, c, g, or t
tcagagcactgtagcacgaccggtgctcgatttagtcgctgcgtaagggggagcatcacccagcaaccacatctgtcctctagagaatcccctgagagctccgttctcaccatggactggacctggaggatcctcttcttggtggcagcagcctcaggagcccactcccaggtacagttggngcagtctggggctgaggtgaagaagctgggcctnagtgaaggtcnctgcaaggcttcngatacacttcaccggntactatatcacgtggtgacgtacgcggaccccgtggaccgaagggacttgagtggagtgggacggaatccgaaaccctaagaccggtgacacaaacacganaacgagaagtttacgacgggnacgggtcaacatacggaacagggactacggtccttcacgcaacgagaccctagtggaacggttgacgcgagctganagtcgagacgacgacggtacttacgtagttacgngtagacgaggagaacggagaacgttaggacgtacgaagtacgaggacgttaggtaggttacgaggttaaccgg

SEQ ID NO: 239532 - DNA, 579 bp, Homo sapiens
  misc_feature: GYAE6OF02ITQ9M.4.18.B07.1.454.CMB.1.raw
  modified_base (554)..(554): a, c, t, g, unknown or other
  misc_feature (554)..(554): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagccccactcccaggtacagttggtgcagtcgtggggctggaggtgaagaagccgtggggcctcgagtgaaggtcctccgtgcgaaggtcttcgtggactaccaccttcgaccgctaactatactccacgtggtcgcgacacggccccgtggaccgagggcttgaggtggagtgggacgataccgaacctaacgccggtgaccaacgaaacacgcaagagtaacgttcgaggacagggtcaacgatcgaccgacggacaccgttcctacgacgacacgacgtaccttagtggaggtcgtagacgaggtctgacgatcgacgacgaccgacgggtccgtagtacgttagcggtagcggagaggaacggtaaggtacgtagacggttacgagtacgngtactagggtagttaaggagtacgg

SEQ ID NO: 239533 - DNA, 664 bp, Homo sapiens
  misc_feature: GYAE6OF02I64L0.4.18.B07.1.454.CMB.1.raw
  modified_base (425)..(425): a, c, t, g, unknown or other
  misc_feature (425)..(425): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttctggtggcagcagcctcaggagcccactcccaggtaccagttggtgcgagtctgggggcttgaggtagaagaagccgtggggcctcagtgaaggttctccgtgcaacgggcttcgtaggataacctaccctttcgacccggtactactaatacttcccacgtgggtacgcgacgcggtccccgtggaccgaggtctgaggtggagtgggacgatccaaccctaacgaccgggtacgacaacaaaccaaccgacacgaagtaacgtttacaacgggcgaggtccaacntacggaccgagggaactaccgttcctacgacacaacgtacgaccttacggttggaacggttcaggtccgacgggtcgtagaagactcggtacgaccggtaaccgtaccggtaccgttacggttaattaccggttgtacgggtcgaagggaacggtacggtaacggtaaccgttagggaacgttcgggaaacggtctaaacgggtcgtttacggtaagggtttacggacggttaaccggg

SEQ ID NO: 239534 - DNA, 724 bp, Homo sapiens
  misc_feature: GYAE6OF02FK9JX.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgccccactcccaggtacagttggtgcagtcgtggggctggaggtgaagaagccgtgggggcctcgagtggaaggtcctcctgcaaggtcttctggatacaccttcaccggtactactatactccctacgtgggtcgcgacgacgggtcccctaggacgtaagggcttaggagtggacgtggggaccgtacgtaccaacccctaacggaccgggtacggacaaacgaaaccgaacgacctaacgaacgttaacggtttcgacgggtacgtaacggggtccaaccgtaactacggaaccgaacgggaaccgtaccgttacctacccgacgaccaaccgacgtaccctaacgttgggtaacggttcgacggtacgacggtcgtacgaacggtacgtaccgtacgggaccggaccgtaccgggtaccgtttcgggttaaacttaccggttggtaaccgggtacggacgggtaacgggtaagggtaacggttaacggtacgggtaggtaccgggtaacttaacggacggttaccggtaggttaacgggttaacggtagggttaaccgg

SEQ ID NO: 239535 - DNA, 577 bp, Homo sapiens
  misc_feature: GYAE6OF02IGWLH.4.18.B07.1.454.CMB.1.raw
  modified_base (244)..(244): a, c, t, g, unknown or other
  misc_feature (244)..(244): n is a, c, g, or t
  modified_base (405)..(405): a, c, t, g, unknown or other
  misc_feature (405)..(405): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagccgtggggcctcagtgaaggtctcctgcaaggcttcngatacaccttcaccggctactatatccactgggtgcgacacggccccgtaggacgaagggtcttgacgtggatgggacggatcaaccctacaccggtgacacaaacacgcacagattcgagggcagggcaccatgaccgagggacaccgtccttcagccanacgcctacgtggagtgagcgaggcctggacgtatcgtcgaccgaccgacgggtccgttaggttaacttacggttgtacggacggaggaacggagggaaaggtacttagggacggttacgggtaacgttaacgaggtaccgtagggtttacgggttaaggaggttaaccgggg

SEQ ID NO: 239536 - DNA, 723 bp, Homo sapiens
  misc_feature: GYAE6OF02HP7HZ.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttgggtggcagcagcctcaggagcccactccccaggtacagttggtgcagtctggggctggaggtgaagaagccgtggggcctcaggtgaaggtctcctgcaaggtcttctggattaccgaccttcgaccggtctaactatactcacgtgggtcacgacgcgccccaggacgagggtcttaggagtgggagtcgggacggtactacccgaaaaccccgtaacggtacccgggtacggaacaaccgtaaaccgaaccgacgaaccaaggttaacggtttacggacgggtaccgtaacgggtacaacccgtagtaccgggaaacccgaagggtaccctaccggttaccgttacgaaccgtacctaaccggaacgttacccgttaacggtttcggggaaggttacggacggtacgggtaaggaccgttaggaacgtacgttaccgttacggaacccgacgtaacccgggtcgttaacgttacgttacgtggttaccggaggtaggaacggtaaggaacggttacgttaaggtaccggtaggacgttaagcggtacggttaggttaacggtaagggtacgttaacggg

SEQ ID NO: 239537 - DNA, 593 bp, Homo sapiens
  misc_feature: GYAE6OF02GTFH6.4.18.B07.1.454.CMB.1.raw
  modified_base (252)..(252): a, c, t, g, unknown or other
  misc_feature (252)..(252): n is a, c, g, or t
  modified_base (482)..(482): a, c, t, g, unknown or other
  misc_feature (482)..(482): n is a, c, g, or t
  modified_base (567)..(567): a, c, t, g, unknown or other
  misc_feature (567)..(567): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccaggtacagttggtgcagtcgtggggctggaggtgaagagccgtgggcctcgagtgaacggtctccgtgacaaggcttcgnggactaccaccttcaccggtctactactactcccacgtgggtcgcgaccgacggtccccgtggacgaacgggtcttaggacggtgggagtgggacggtactacgaaccccgtacgaccggtcggacaacgaaacacgacaacgtacgaagtttacgagggtacacgggtacaccgagtacgacgacggacacgtcctacacgacacacgacctacgtggacgtgagacgngacgtgagctgacgacgacgccggtacgtacgttgtacgtgtagcgtaggaggtaacggagtacgttaggacgtacggatacggngtacgtaggtaggttagaggttacgg

SEQ ID NO: 239538 - DNA, 682 bp, Homo sapiens
  misc_feature: GYAE6OF02GMGFW.4.18.B07.1.454.CMB.1.raw
  modified_base (143)..(143): a, c, t, g, unknown or other
  misc_feature (143)..(143): n is a, c, g, or t
  modified_base (262)..(262): a, c, t, g, unknown or other
  misc_feature (262)..(262): n is a, c, g, or t
  modified_base (300)..(300): a, c, t, g, unknown or other
  misc_feature (300)..(300): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (674)..(674): a, c, t, g, unknown or other
  misc_feature (674)..(674): n is a, c, g, or t
tcagagcactgtagcacgaccggtgctcgatttagtcgctgcgtaagggggagcatcacccagcaaccacatctgtcctctagagaatcccctgagagctccgttcctcacatggactggacctgggagatcctcttcttggnggcagcagcctcgaggacgccctactcccaggtactagttggtgctaggtctgggggctaggaggtacgaaggagtccgtgggcctcgagtggaacgtctccgtgacgaacggtcttgnggtacacctaccttcaccggtctaacttaatcgtaccncgtggtcgacgtacaccggcccgnggacgaaggtctagnggtagcgtaggggacggtactaccaaacccgtacgaaccgggtcggaccaaagaacctaaccggacaagtacggtaaacggtttcgaacggggcgtaacgggaccttacgaggtcgacccgtaagggactaccgttaccgttcgagccgtaaccgacgtaccttaccggtagggtaaggtcgagaccgttagggactacggacgtaaggttccaacgggactacccggggaacggttccgttacgtttaaatcgttagaccggagttagaacggtaggtaacgaccgttacggaagggtacctagtaccgagttcggttacggtaggtttaacgnggtaacgg

SEQ ID NO: 239539 - DNA, 958 bp, Homo sapiens
  misc_feature: GYAE6OF02JCS1A.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtctggggctgaggtgaagagccgtgggcctcagtgaaggtcctccgtgacgaaggtcttcgtggatacctaccgttacgaccggtcttactactactaccctagttcgggtcgaccggacgacggtccccgtaggaacgaacgggtcttaggaggtacgggtaacgtacggggaccggtaacgtacccgtaaaccccgtaaaccggtacccgggtacggtaccctaaaaccgaaaaccgtaaccggaccgaaaccgtaacggttaaaacggttttaccggaaacggggggtacccgtaaaccggggggttaccccaaaacccggtaaccgtaaccggtaacccgggtaacgggggtaaacccccgttaacccgggttttacccccgtttaaaccggaacccggtaacccggtaaacccggtaaacccggggttaaccccgtttaaaccggggttttaccgggggtaaccgggttaacgggtaaccgggaacccggttacggggttacccgtagggtaaacccgttaacggtttacccggtaaacgggtaacccggtaaacccggtaccggggttaacccgtttcgtttaaacggtttaccgttaccgggttaacgggttaccgggtaacgggtacgggtaaaggggttaaacccggttaacggttaacggggttaaccggttaaccgggtaaaccgttaacccggggttaacggttaccgggtttaaggggttaaccggggtttaaaccgggttacggtttaacccgggg

SEQ ID NO: 239540 - DNA, 556 bp, Homo sapiens
  misc_feature: GYAE6OF02FMWY5.4.18.B07.1.454.CMB.1.raw
  modified_base (288)..(288): a, c, t, g, unknown or other
  misc_feature (288)..(288): n is a, c, g, or t
  modified_base (313)..(313): a, c, t, g, unknown or other
  misc_feature (313)..(313): n is a, c, g, or t
  modified_base (443)..(443): a, c, t, g, unknown or other
  misc_feature (443)..(443): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtctggggctgaggtgaagagccgtggggcctcgagtgaaggtctcctgcaaggcttctggatacaccttcaccggtctactatatccactgggtgcgacnggcccctggaccagggctgagtggntgggacgatcaaccctacgaccggtggcaacaaacacgcacagaagtttcgaggctagggacaccatcgaccgacgggaacaccggtaccttacgacggcctaacgcgaccttacgtggaaggttgacgngacggtctgacgactcgtagacgtacgacggtccgttagtacttgtcgtgacgagtaggaggtaacgtatggacgtggactacgacgtcgacggtggttaacgaggttaacgg

SEQ ID NO: 239541 - DNA, 695 bp, Homo sapiens
  misc_feature: GYAE6OF02HBMSZ.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtgggctgaggtgaagaagccgtggggcctcgagtgaaggtcctcctgcgaaggtcttcgtggataccaccttccgacccggtctaactactactccctacgttgggtcgcgacgaccggcccccgtggaaccgaagggtccttaggaggtggaggtagggaacggactaccgaaaccccgtaaccgaccggtggaccaaacgaaaacgacgaccaacgagtaacgtttcgaaggggaccgtagggtaccaacgacgtacgaaccgacgggacctaccggtcccttacgacgaccaacgaccgtaccgtaacgttacggacgggtcgaacggcgtacggtactaggacggtacgttcgtacgaaccggaaccgtaaccgggtccgttacgtttaacgttaccggtaggtccgaggacggtaggaacgggtaacggtacgttagggtaaggtaccggtaagtacggtacgtaccggttagggttacggttaaggtaggttaaccggg

SEQ ID NO: 239542 - DNA, 756 bp, Homo sapiens
  misc_feature: GYAE6OF02HMGPO.4.18.B07.1.454.CMB.1.raw
tcagagcactgtagcacgaccggtgctcgatttagtcgctgcgtaagggggagcatcacccagcaaccacatctgtcctctagagaatccctgagagctccgttctcaccatggactggaccaggaggatcctcttcttggtggcagcagcctcgaggacgccacctcccgaggtacgtaggttgtacgcagtcggtcgggtcgtggaggtaggaagaacgccggtcggggtcctacgtagtaggtaacgggtcctccgtagacgtacgggggtcttcgtaggtactacctaccgttacgtaccggtacttaacgtacttactaccgtacgtgggtacgtacgacgacgcccgtaggacggtaggtacgttagaggtaggtacggtcgggacgtacgtaaccaaccgtacggaccggtacgacgtaaaccaaaccgaacgacgaacgtaacgtacgttacggacggtaacgtaacgggtaccaccgtaagtaccgtaacggtacggtaacctaccggttactccgaacgtaccgttacaccggttacgtaacggttaggaacgggtacgtaggactagggtacctaaggccgttaagttaccggaccggtaacggaccgtccggtaacgtttagttaacgtacgttcgacggtaccgagggaacggtacgggaaacgttaccggtaggtacggtaacggtaaccctacggtaacggttccgggttaaggttaggggttaacgacggtttaacccgg

SEQ ID NO: 239543 - DNA, 678 bp, Homo sapiens
  misc_feature: GYAE6OF02HCKXB.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctggaggtgaagaagccgtggggcctcgagtggaaggtcctctgcaaggcttcgtagatacaccttcgaccggctactatactccacgtggcgcgacgacggcccctggacgaacgggcttaggagtggacgttagggacggtactaccgaaaccccgtaacgaccgggtacgaccgaaaccaaaacgacgacctaagaagtaacgtttacgacgggtacgacggggtacaaccgacgtacgaaccgacgggaacctaccgttaccgttaccgaacgacctaacgacgtaccgttaacggtgggtaacggtacggacggcgaggtcctaggacgattcggacggaccgaaccggtaccggtaccgttagttacgttacgtagtacgaccggagaacggtaaggtaaacgtaccggttaggtaaccggtacggtaacgtacgtacgtaccggttaggttaacgggttaaggtacgttaccggg

SEQ ID NO: 239544 - DNA, 714 bp, Homo sapiens
  misc_feature: GYAE6OF02IBVL5.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcaggacgcccacctcccaggtacagtttggtgcagtcgtggggctggaggtagaagaacgccgtggggcctcgaggtgaacggtcctccgtgacgaaggtcttcgtaggactaccaccttcgaccggtctactatactccgacgtgggtcgcgacgaccggccctaggacgaagggcttagacggtggagtgggacgactaccaacccgtacgaccggtgacaacaaacgacacgacgaagtaacgttcgacgggcgacggtacacgtacgtacggaaccgtaacgggacctaccgttccttacgacggacaacgtacgtaccgttacggttagggacggttaggacggacgacgggtctaggaacgtacgttaccggtaacggacccgaaccgggtaaccgggttcccgtttaagttaaccgtttacgggttcggtaacgggacggtaagggaagggtaacggtaacgggttacggttaaggggtaacccgggtaggtaacgtaccggtaaggtccggttttaaggggttaacgggttaacggagggttaaccccgg

SEQ ID NO: 239545 - DNA, 574 bp, Homo sapiens
  misc_feature: GYAE6OF02JCMYZ.4.18.B07.1.454.CMB.1.raw
  modified_base (215)..(215): a, c, t, g, unknown or other
  misc_feature (215)..(215): n is a, c, g, or t
  modified_base (240)..(240): a, c, t, g, unknown or other
  misc_feature (240)..(240): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctgggctgaggtgaagagctgggcctnagtgaaggtctcctgcaaggcttcnggatactaccttcaccggctaactatatccatgggtgcgacaggcccctggaccaagggcttgagtggatgggacggatcaaaccctaacaccggtggacaacaaacaacgacacgaagtaagtttcgagggacagggtccaacgatacgaccgaggacacgtcctcagcacgacgcctagttggaggttagagtacgaggctagagtactcgacgtaccgacgaccgggtcgttagtaacgttacgtcggtagacggagacggtaagggtaacgtaacgttagtaacggtcggtaatacgagtaccgttaggtacggttaaggtaggtaacgg

SEQ ID NO: 239546 - DNA, 683 bp, Homo sapiens
  misc_feature: GYAE6OF02J0YW3.4.18.B07.1.454.CMB.1.raw
  modified_base (292)..(292): a, c, t, g, unknown or other
  misc_feature (292)..(292): n is a, c, g, or t
  modified_base (387)..(387): a, c, t, g, unknown or other
  misc_feature (387)..(387): n is a, c, g, or t
tcagagcactgtagcacgaccggtgctcgatttagtcgctgcgtaaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtagaagtaaggcctcgggggcctacgaggttggaaacggttctccgtgacaagggtccttcgtggactacaccttcgaccgtctactanactccgacgtgggtcgcaacgcggcccaggacgtaagggcgtaggaggtggacgtagggacgataccaaccgtacgaccggtcgacaacgaaacncgacagacgtacgttcgacggtcgagggtaccaccgtagtacgaaccggacggtaactccgtaccgttacgacgtacgtacgtaccgtacgtagggacggtacggacgcgtaacggtcgtaggactaggactaggtaacccggaggtaacccgggttacggttaacgttaacgtttaacgtcgggaacgtacgggaagggtacgggacggtaaacggtcggtacggtacgggtaacgtacgtaaggtacggttcggttaagggttaacggtaaggttacggtaacggttaacccgg

SEQ ID NO: 239547 - DNA, 752 bp, Homo sapiens
  misc_feature: GYAE6OF02FJPUS.4.18.B07.1.454.CMB.1.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (323)..(323): a, c, t, g, unknown or other
  misc_feature (323)..(323): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtctgggctgaggtgaagagccgtgggcctnagtgagtctctgcaggcttcgngatacaccttcaccggctactatatcccacgtgggtcgtcgacgcggcccccgtgaccagggtcttgacgtggatgggacgancctaaaccgtacaccgggtagccaacaaacgaaccgcgaacacgtaagtttccgacggggtcgacgggtaccaccgaattcgaaccgtacgggaaccaccgttaccgtttacacgtaccgaacctacgtaccctaccggtttagggaaacggttcgggaacggtccggtaaacggggtccctacggggtaaccggtaacgtttacccgttaaggggaacccggtaaacccggaccggggttaaaccccccgggttttaggttaaaccgttttaacccgggttcgttttaacggggaccgtaacgggggttaacggaaacggggttaaaccggtaaccggtttaccggggtaaggttaccggaaacggttaacccgaccggttggtaaccgggttttacgggttaaaggttaacggggtttaaccccggg

SEQ ID NO: 239548 - DNA, 667 bp, Homo sapiens
  misc_feature: GYAE6OF02I00YJ.4.18.B07.1.454.CMB.1.raw
  modified_base (186)..(186): a, c, t, g, unknown or other
  misc_feature (186)..(186): n is a, c, g, or t
  modified_base (261)..(261): a, c, t, g, unknown or other
  misc_feature (261)..(261): n is a, c, g, or t
  modified_base (520)..(520): a, c, t, g, unknown or other
  misc_feature (520)..(520): n is a, c, g, or t
  modified_base (535)..(535): a, c, t, g, unknown or other
  misc_feature (535)..(535): n is a, c, g, or t
  modified_base (631)..(631): a, c, t, g, unknown or other
  misc_feature (631)..(631): n is a, c, g, or t
  modified_base (659)..(659): a, c, t, g, unknown or other
  misc_feature (659)..(659): n is a, c, g, or t
tcagagcactgtagcacgaccggtgctcgatttagtcgctgcgtaagggggagcatcacccagcaaccacatctgtcctactagagaatcccctgagagcctccgttcctcaccatggactggacctgggagatcctcttctggtgcagcagcctcgagacgcccactcccaggtacaggttggtncaggtcgtggggctggaggtagaaggacgcgtagggcctgagtaggtaacggtctaccgtaggcgaaggtctcgnggtactaccaccgtcgtaccggctaactactattccctagtcgggtcgtaacgacgtacgacccccgtggaccgtaacggtcgttaggaggtacgggtacgtacgggtacgggacctaaccgtaaccgtaaccggccggtagtaaccaaacgtaaacgacggactaacgtacgtacggttacgacggacggtaacgtcctaacgacgtacgtaccggacggaactcggtactagacgacacgtacgacgtcgtaacggnggtgacgtgaacggntacgacgaacgttcgacggacctcggaaccggtagttcgttaacgtcgttagggacgtacggacggaacgaacggtcgtaacgacgtcggtaacgngtacgtggtactcgggtaagtaaccggngttaacgg

SEQ ID NO: 239549 - DNA, 662 bp, Homo sapiens
  misc_feature: GYAE6OF02G8GAS.4.18.B07.1.454.CMB.1.raw
  modified_base (286)..(286): a, c, t, g, unknown or other
  misc_feature (286)..(286): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttgtgcagtctggggctgaggtgaagaagccgtgggcctcgagtgaacggtctcctgacaaggtcttcgtgataccaccttcaccggctactatactccacgtggtncgacacggcccctggacaaggcttggacgtggagtgggacgactcaaacccgtacgacggtggaccaacgaaaacgacgacaacgaagtaacgtttacgacggtgacggtacacctagtacgaccgaggacctaccggtctttacgacgtaccacgtaacggtaccttaacgtaggtacggtacgacgtacggaggtctaggacgacgttcgtaacgtaccgaacggacggtaccgttacggttaagttaccgtaggttcggaccggtagaacgggtaacgggaaacgttaaccggttagggtaaccggttacggaacgttaacggtacggtacccggtttaagggtaacgggtttaaggtaggtttaacccgggg

SEQ ID NO: 239550 - DNA, 584 bp, Homo sapiens
  misc_feature: GYAE6OF02G4MIM.4.18.B07.1.454.CMB.1.raw
  modified_base (290)..(290): a, c, t, g, unknown or other
  misc_feature (290)..(290): n is a, c, g, or t
tcagagcactgtagcacgaccggtgctcgatttagtcgctgcgtaagggggagcatcaccccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcgaaggcttctggatacaccttcaccggctactatactcccactgggtgcgacnggcccctggacagggctgagtggatgggacggataccaaccctaaccgaccggtaggacacaaaccaacgccaacgagaacgttttacgagggtcgaagggtccaccgattacgaccgagggaccaccgtccttacgagccaccgacgacctacgttcgggtaggtgacggactacgggcgtggagtacgtctacgaccggtacgaccggtcggtacgttacttacgtgtgcgagaggaggaagtacgtcggacgtccggaagtacgtagacgtggtaggttaggagtaaccgg

SEQ ID NO: 239551 - DNA, 625 bp, Homo sapiens
  misc_feature: GYAE6OF02IVFBT.4.18.B07.1.454.CMB.1.raw
  modified_base (290)..(290): a, c, t, g, unknown or other
  misc_feature (290)..(290): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctgggaggatcctcttcttggtggcagcagcctcaggagcccactcccaggtacagttggtgcagtcgtggggctgaggtgaagaagccgtggggcctcgagtgaaggtctccgtgcaaggcttcgtggataccaccttcaccggctaactatactccactgggtcncgaacgcggccctggacgaagggcttgagtggagtgggacgagtacaaccctaacgaccgggtgacaacgaaacgaccgacaacgagtaagtttcgaagggcaacgggtcaccgatcgacgacggactacgtcgttacacgcacacgtaccgtacgttaggaacggtggagaccggaggcgtaggacgtacgtcgtaggaaccgacgtaccgggtccgttacgtacgttacgtgtacggtaggacggtaaggtacgggtaaacggtcggtttaaggacgggttaacggattaacgaaggtacgttagggttaacggtttaagcgggtttaaccgg

SEQ ID NO: 239552 - DNA, 803 bp, Homo sapiens
  misc_feature: GYAE6OF02H7YS5.4.18.B07.1.454.CMB.1.raw
  modified_base (175)..(175): a, c, t, g, unknown or other
  misc_feature (175)..(175): n is a, c, g, or t
  modified_base (719)..(719): a, c, t, g, unknown or other
  misc_feature (719)..(719): n is a, c, g, or t
  modified_base (758)..(758): a, c, t, g, unknown or other
  misc_feature (758)..(758): n is a, c, g, or t
tcagagcactgtagcacgaccggtgctcgatttagtcgctgcgtaagggggagcatcacccagcaaccacatctgtcctctagagaatccctgagagctccgttcctcaccatggactggacctggagatcctcttcttggtggcagcagcctgaggagcccactcccaggtacngttgtgcagtcgtggggctggaggtagaagaacggccggtacgggggtcctacgaggtaggtaacgggttctcccgtagaccggtaaggtccgttagtagggtacctaccttaacccgtttccggacccggtacttaacgtaactttacgtcccgtaacggttcggggttacggaccgaaccggtccgtcccccggttaaggaaccgggtacggtccttttggaaggttcggaggttacgggacgaactaccgtaaacccctaggccgggtaccgaacaaacctaaaacgaccgacgtaacttaaacggttacgttaaccgggacgggaaccgtaacggggtccctaaagtcgtaaccgggtaacccggaacggtaaccggggacttaacccgtttacccgacgtaaccgcctaaacgacccgtttacgtacggttagggacgggtacgaggtaaccggtacggtacgtaaggtacggtaaccttaggggaaccaccgggtaaaccgacggggtttaccttacggttaagttacgttaccgggngacgggaacggacggtaaacggttacgagttaaccgggngtaacggtacgtacggtaagtccggtaaggtaggttaggtaccgg

SEQ ID NO: 239553 - DNA, 752 bp, Homo sapiens
  misc_feature: GYAE6OF02HKT8Q.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagaagccgtggggcctcgagtggaagggtcctccgtgcaaggtcttcgtggatactaccttcaccggctactatatcccacgtgggtgcgacgacggccccgtggacgaagggcttaggaggtggagtcggggacggacgtaccgaaaccccgtaacgaccgggtacgaccgaaccgaaaaccgaaccgaccaacgtacggtaaacggttttacgaacggggtacgacggggtaccaccgtacgtacggaaccggtaacgggaccgtacccggttacccgttaccgacggacccgaaccgacggtacccttacggttacggggtacggttacggacggaccggtaagggtccgtagggtaaggtagtccggtacggaaccggtaaccggtaccgggttacgttacggttaacgtttaaccgttaggtacgggacggtagggtaaggtaacgggtaacggttaacgggtttaggtaagggttaccgggaagttaccggtacggtaccggtttagggtttaacgggtttaacggtaaggttaacccggg

SEQ ID NO: 239554 - DNA, 617 bp, Homo sapiens
  misc_feature: GYAE6OF02JVS3W.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggagcccactcccaggtacagttggtgcagtcgtggggctggaggtagaagaagtcgtcgggcctcgagtggaaggtcctccgtcggacaaggccttacgtggtactacctaacccgttcaaccggtcctaatactactccacgtgggtcgccgacgaccggcccgtggaacgaggtcttggaggtggagtgggacgataccaaccgtacgaccggtgacaacgaaacacgacacgagtacgttcgaggccgaggtaccacgatcgaacggacggacctacggtcttaccgagaccacgtacgtacccttagtgggtaggtacgtaggacgaggactagtaagcttacggtccgaaccgtacgtaccgggtcgttacttagtacgtgtcgacggagaggacggtaacgtgtacgaggttacggatacggtcggacgttggtaacggtaggagttaccgg

SEQ ID NO: 239555 - DNA, 666 bp, Homo sapiens
  misc_feature: GYAE6OF02GKSMB.4.18.B07.1.454.CMB.1.raw
  modified_base (225)..(225): a, c, t, g, unknown or other
  misc_feature (225)..(225): n is a, c, g, or t
  modified_base (252)..(252): a, c, t, g, unknown or other
  misc_feature (252)..(252): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagtcctcgaggacgcccactcccgaggtacaggttggtgcagtcgtggggctggaggtgaagagccgtgggcctnagtgaggtctccgtgcaaggtcttcgngacactaccttcaccggctactagtactcacgtgggtcncgacncggccctggacaaggctgacgtggacgtgggacgatacctaaccgtaacgaccggtaggaccaacgaaacgaacgacaacgaagtaacgtttacgacgggacgtaacgggttaccaccgtagtacgaaccgggacggtaaccgtacccgttaccgttaccgaggacctaacgtaccgtaacccgttacgtacgggtaaggttagaacggccgaaggtcgtaagtaggacgttacgacgaccggaaactaccgggaccgttagttaacttacgaggttcgaccggaggtaggaaccgggtaaggtaccgttaggtaacggtacggtagttaaccgaggttaccgtggttaacgggttaagaggttaaccgg

SEQ ID NO: 239556 - DNA, 713 bp, Homo sapiens
  misc_feature: GYAE6OF02HMC0B.4.18.B07.1.454.CMB.1.raw
  modified_base (149)..(149): a, c, t, g, unknown or other
  misc_feature (149)..(149): n is a, c, g, or t
  modified_base (151)..(151): a, c, t, g, unknown or other
  misc_feature (151)..(151): n is a, c, g, or t
  modified_base (153)..(153): a, c, t, g, unknown or other
  misc_feature (153)..(153): n is a, c, g, or t
  modified_base (165)..(165): a, c, t, g, unknown or other
  misc_feature (165)..(165): n is a, c, g, or t
  modified_base (168)..(168): a, c, t, g, unknown or other
  misc_feature (168)..(168): n is a, c, g, or t
  modified_base (171)..(171): a, c, t, g, unknown or other
  misc_feature (171)..(171): n is a, c, g, or t
  modified_base (366)..(366): a, c, t, g, unknown or other
  misc_feature (366)..(366): n is a, c, g, or t
  modified_base (531)..(531): a, c, t, g, unknown or other
  misc_feature (531)..(531): n is a, c, g, or t
tcagagcactgtagcacgaccggtgctcgatttagtcgctgcgtaagggggagcatcacccagcaaccacatctgtcctctagagaatcccctgagagctccgtctctcacagcgacgcgcgtaggagtactcttcttcgtggtcgacncncncgtctcgagccnccnccncgtacgtacgtggtgtcgagtcgtggcggtgaggaggtagaacgacgtcggtcggtcctacgtaggtaaggtacgtcctcgagaccgtagttcttggatacctactccgtaccgaccgtactactactaccgacgtcggtggacgacgacgcccggtcgacgacggtacgtgacggtaggtcggaggacggaacnccgtaacccgaaacccgtacgggtacgacgaacgaaaccgaacgcgaaccgtaagtaacggttacgtacggacggtacggtaccgaaccacgtaacgaccggtaaccggtacggaacccgttccggttacctacggaccaccgaacgtaccgttaccgtacgggngggttacgacggacgtaggacgtcgagtacgacgttaccgaacggacccgtaacgggtaccggtttacgttaacgtttacggtaggtaccgacgggacggtaaggtagggaaacggtaacgttcggtaaggtaccggtagtacgttacggacggtttcggaaggttacgggtagttaacggg

SEQ ID NO: 239557 - DNA, 646 bp, Homo sapiens
  misc_feature: GYAE6OF02IBBW4.4.18.B07.1.454.CMB.1.raw
tcagagcactgtagcacgaccggtgctcgatttagtcgctgcgtaagggggagcatcacccagcaaccacatctgtcctctagagaatcccctgagagctccgtttcctcaccatggactggacctggaggatcctcttcttggtggcagcagcctcaggacgccccactcccaggtaccagttggtgcagtcgtggggctggaggtgaagaacgccgtggggcctacgagtggaacggttcctaccgtgaccgaaggtcctttcgtacggtactaacctacccgtttccgacccggtactaactatactcctacgtcgggtagaccgacacggcccctaggacgacgggtcttggaggtggagtacgggacgataccgaacctacgaccggtgaccacaaacaacgcaacgagtaacgttacgcggacaggtacaccatcgaaccgaggaccacgttacctacgacgactacgacgtaccttacgtagggaggtacgagacgtaggctaggacgtcgtacgtacgaccgacggccggtccgttattacgttacgtggtacgacgaggtaaggaggtaacgtacgtagaccgggttacgtaagtacggtagtccgtttagggtaacggttaacggaggttaaccgg

SEQ ID NO: 239558 - DNA, 777 bp, Homo sapiens
  misc_feature: GYAE6OF02FR628.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagaagccgtggggcctcagtgaaggtctctgcaaggcttctggatacaccttcaccggctaactatactccacgtgggtgcgacgaggcccctggacaagggcttggagtggagtggggacggtacgtaccgaaacccgtaaacgacccgggtacggaccaaacgaaaaccgtaaaccgaccgaaccgtaaggtaaaacggttttcgaacggggtaccgaacgggggtaccaacccgtagtacggaacccgaacggggtaaccctaaccggttaccccgtttacgaaccgtaccgaaaccgtaacggtaccccgttaaccgtttacggggtaacgggtacgtacgggtaccgaagggtaccgttaggaaccggtagttcccggtaacgggaaccggtaccgtaacccggggtcccgtttaagggttaacgtttaaccggttgggttacgtaaccgggtaggtaacggggaacggtaaacgggtaacgtttaacgggtaacgggttacgggtaacttaacgggacggttcggtttaacgggtttacgggtttaaacggtagggtttaaccggg

SEQ ID NO: 239559 - DNA, 712 bp, Homo sapiens
  misc_feature: GYAE6OF02FH4V0.4.18.B07.1.454.CMB.1.raw
  modified_base (160)..(160): a, c, t, g, unknown or other
  misc_feature (160)..(160): n is a, c, g, or t
  modified_base (184)..(184): a, c, t, g, unknown or other
  misc_feature (184)..(184): n is a, c, g, or t
  modified_base (190)..(190): a, c, t, g, unknown or other
  misc_feature (190)..(190): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtgcagcagcctcaggngcccactcccaggtacagttggtncagtcnggggtctggaggtgaacgagcccgttggggaccctcgaggtcggaacggtcctccgtgacgaacgggtcttccgtggataccacccttcacccggtctaccgtactactccgacgtgggtacgcgacgacggccccctaggaccgaaggtccgttgaggtcggagtacgggacggtactaccaaaccccgtaacgaccggtacggccaacgaaacgaacacgaaccgaggtaaacgtttccgaaggtaccgtacgggtaccaaccctagacgtaacccggacgggtaaccaccgttccttacgacgtcaaccgacgtaccgtacgttcgggacggttcgaacggtcgaacgggtcctaggagtaacgttccgtaggaacccgtaacggaacccgggttacgtttaccgtaacgttaacgttcgggacgtaccggaggaaggtaaacggtaacggttacgttaggtaaccgtacggtaacgacgtacggtacgttagggttaacggttaggacggttaacggg

SEQ ID NO: 239560 - DNA, 749 bp, Homo sapiens
  misc_feature: GYAE6OF02G1UDE.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctgggaggatcctcttcttggtggcagcagcctcaggacgcccactcccaggtacaggttggtgcagtcgtggggctggaggtagaagaacgccgtggggtcctcgaggtgaaggtctccgtgacgaaggtcttcgtcggtactacctacccttcgaaccggtcttaactactactccctacgtgggtgaccgaccacggtccccgtgggaacgtaagggtcttaggaggttggacgtgggacgtactaccgaacctacgccggtgacaacaaacgacgacaacgtagtaacgttcggagggacacggcaacgtacgtacggaaccgacgggtacctaccggttaccgtacgacgtaccgaaccgacgtaccgttaacggtacgggtaacggttacggaacgtacggtagggccgtagggaacgtaccgtacggtaacggaacccgggtaccgtaacccgggtacccggttacgtttaaccggtttaacgtacgggttacggaaccgggtaagggaacggtaaggggtaacggttaacggtttaggggtaaccgggttaacggtacgtaacggtcggttaaccgggtttagggtttaaacgggttaacgggtaggttaacccgggg

SEQ ID NO: 239561 - DNA, 598 bp, Homo sapiens
  misc_feature: GYAE6OF02F54BO.4.18.B07.1.454.CMB.1.raw
  modified_base (249)..(249): a, c, t, g, unknown or other
  misc_feature (249)..(249): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
  modified_base (448)..(448): a, c, t, g, unknown or other
  misc_feature (448)..(448): n is a, c, g, or t
tcagagcactgtagcacgaccggtgctcgatttagtcgctgcgtaagggggagcatcacccagcaaccacatctgtcctctagagaatcccctgagacgctccgttcctcaccatggactggacctggaggatcctcttcttgggtggcagcagcctcaggagcccatcccaggtacaggttggtgcagtcgtggggctgaggtgaagaagccgtggggcctcagtgaaggtctcctgcaaggcttcgnggataccaccttcaccggctactatactaccacgtgggtcgcgacgacggcccctggacaagggtcttggagtggagtgggacgatacaaccctaacgaccggtggacaacgaaacaacgcacagtaagtttcgagggcagggtcacgatcgacgaggacacgtcctanagcacacnctacgtggaggtagagcacggntagagtacgtcgtacggacgaccgacggtcccgttagttattaaccgtggtacgtacggtagaagggaaggtaaacggaccgtttagggtacggtaacggtagttaccggaggttccgttagggttacggttaaagggtcgttaaccggg

SEQ ID NO: 239562 - DNA, 655 bp, Homo sapiens
  misc_feature: GYAE6OF02J2LOG.4.18.B07.1.454.CMB.1.raw
  modified_base (225)..(225): a, c, t, g, unknown or other
  misc_feature (225)..(225): n is a, c, g, or t
  modified_base (253)..(253): a, c, t, g, unknown or other
  misc_feature (253)..(253): n is a, c, g, or t
  modified_base (325)..(325): a, c, t, g, unknown or other
  misc_feature (325)..(325): n is a, c, g, or t
  modified_base (472)..(472): a, c, t, g, unknown or other
  misc_feature (472)..(472): n is a, c, g, or t
  modified_base (617)..(617): a, c, t, g, unknown or other
  misc_feature (617)..(617): n is a, c, g, or t
  modified_base (645)..(645): a, c, t, g, unknown or other
  misc_feature (645)..(645): n is a, c, g, or t
tcagagcactgtagcacgaccggtgctcgatttagtcgctgcgtaaggggaagcatcacccagcaaccacatctgtcctctagagaatcccctgagagctccgttctcaccatggactggacctggaggatcctcttcttggtggcagctagcctcaggagcccactcccgaggtacaggtttggtcgcagtcgtggggctggaggtgaaagacgcgtgggcctnagtgaacggtctccgtgcacggcttcgnggactacgccttcgaccggtctaactgtatccgacgtgggtcgcgaacgacggcccgtggaacaggtcttgngtcggagtcgggacggatacccgtaaacccgtacgaaccggtcggaccaacgaaacgaaccgtacacgaagtaacgtttccgaaggtccgtacggtaccaacccgtgtaaccgaaccggaacggccgtaaccgttaccgtaccgacncgtaaacccgtcggtaccttacggtacgggtaggttacgaacgcggagtccggacgaagttctctacggccgaaagggtccggacgtttacgcgtttaacgcgtcggacgtaggacgtaagggaactgtacgtaggtccggtaanaccgtcggaacttcggggtacgttaggngttaaccggg

SEQ ID NO: 239563 - DNA, 650 bp, Homo sapiens
  misc_feature: GYAE6OF02FF96L.4.18.B07.1.454.CMB.1.raw
  modified_base (476)..(476): a, c, t, g, unknown or other
  misc_feature (476)..(476): n is a, c, g, or t
tcagagcactgtagcacgaccggtgctcgatttagtcgctgcgtaagggggagcatcacccagcaaccacatctgtcctctagagaatcccctgagagctccgttcctcaccatgactggacctggaggatcctcttcttggtggcagcagcctcgaggacgccccactcccgaggtacagttggtgcgtagtcgtgggctggaggtgaagagccgtcgggcctcgagtcggaacgtctccgtagcgtaacggtcttacgtggaacctaccgaccttaccgacccggtctaaccttacgtactacctaacgtgggtcgacaccgaccggtccctaggaacgtaaggtctggaggtcggagacggtacgactaccgaaccccgtacgaccggtacgacctaacaacgaaccacgaacgacgtaacgttcgacggcgtacggtacacgtacgtcgacgacggcaccggttctacgacncgaacgtccgtaccgttagtaggaggtacacggacgtagcgtagacgtacgtcgaacgacgaccgtacggtcgttaatacgttacggtgacggacgtagaacggtacggtaagttcgtaggaaccgtagtacgtaacgtacggtaccgttagggtaagtacggtacgtaaccgg

SEQ ID NO: 239564 - DNA, 678 bp, Homo sapiens
  misc_feature: GYAE6OF02GP0FV.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagtcctcaggacgccccactcccgaggtacagttggtgcagtcgtggggctgaggtagaagacgccgtgggcctcgaggtgaagtctctgcgaaggcttcgtggatacaccttcgaccggctacgtatataccagtggtgcgacgacggtccccgtaggaccgaacgggcttaggacgtgggagtgggacggagtaccaaacccgtaacgaccggtcggactaacgaaacaacgtcaacgagaacgtttcgacggacgtagggtccacgacgtacgaaccgacgggaacctacgtccttacgaggacaacacgtaccgtacgtacggacgggttagacgtaccgaggtaccgttaggacgtacgtacggtacgaccgtaacggacccggttccgtaaggttacttacgtcgggttacggcggaagtacggtaacgggtaaacggttaaccgtttaggtaaaccggtacggtaagtaaccgtcggtaaacgttcgggttaaggtttaaacgggtagtttaaacccggg

SEQ ID NO: 239565 - DNA, 707 bp, Homo sapiens
  misc_feature: GYAE6OF02H66XC.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgccccaccgtcccaggtacaggttggtgcagtcgtggggctggaggtgaagaacgccgtggggcctcgaggtgaaggtctccgtgcgaaggtcttcgtggatacctaccttcgaccggtactaactactactccgacgtgggtcgcgacgaccggcccctggacgaagggcgttgaggtggagtagggacgactacgaaccgacgaccggtagacaaaccgaacgacgacaacgtaagtaacgttacgcggggtacacgggtccaacgtagtaccggacacgggactacccgtacgttacgacgactagaaccgtccgttagttagggaacggttcggacgtacggacggtacaggtacgtacgtccggtacggaacaccgggtaccgggtaccgttagtttacgttaacgtacggtacgggtaccgaagggtaaccggtaagggtaccgggttaaccgttagggaaaccgggttacgggtaacgtaacgggtaggtaccggtttaacgggtttaaggggtttaaccgggaagggtttaacccggg

SEQ ID NO: 239566 - DNA, 528 bp, Homo sapiens
  misc_feature: GYAE6OF02G5AKX.4.18.B07.1.454.CMB.1.raw
  modified_base (246)..(246): a, c, t, g, unknown or other
  misc_feature (246)..(246): n is a, c, g, or t
  modified_base (457)..(457): a, c, t, g, unknown or other
  misc_feature (457)..(457): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctggaggtgaagaagccgtggggcctcagtgaaggtctcctgcaaggcttcnggatacaccttcaccggctactatatccacgtgggtgcgacacggcccctggacaagggcttggagtggatgggacgatcaacctacacggtgacacaacaacgcacagagttcgagggcaggtcacgatgaccgaggacacgtccttcagcacagcctagtcggaggtcgagcaggctggagatcgagacgacgacggcgtgtacttcgngtgcgagagagggtaacgtacgttaggacggtaggaatacgaggtccgttggtaacggttagaggttacgg

SEQ ID NO: 239567 - DNA, 716 bp, Homo sapiens
  misc_feature: GYAE6OF02F0VDE.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctgggaggatcctcttcttggtggcagcagcctcaggacgcccacctcccaggtacaggttggtgcaggtcgtggggctggaggtagaagaacgccgtcggggcctcgaggtggaacggtcctccgtgacgaacgggtcttacgtaggtaactacctaccctttccggacccggtctaactaatctaccgacggttgggtcgcgaccgacggccccgtaggacgtaacggggtcttaggaggtggacggtgggaacgatacccgaaacctacgaccggtgaccaacgaaacgaacgtaccaagtaaggtaacgttacggacgggtacgacgggtacccaaacgtacgtacggaacccggaacgggtaactacccggtttcctacgaacgccaaaccgtacgtacccgttaacgggtacggtacgggtagacggtaccggaggtacgtacggaacggtcgtccgtaacggaccgtaaccgggaccggttccggttattacgttacggtggaccggtagacggaaggaagggtacctaggttaggacggtagtaacgacggcgttaccggtggtaaggttaccggaggttaaccg

SEQ ID NO: 239568 - DNA, 626 bp, Homo sapiens
  misc_feature: GYAE6OF02IUMOR.4.18.B07.1.454.CMB.1.raw
  modified_base (324)..(324): a, c, t, g, unknown or other
  misc_feature (324)..(324): n is a, c, g, or t
  modified_base (327)..(327): a, c, t, g, unknown or other
  misc_feature (327)..(327): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactccccaggtacagttggtgcagtctggggctggaggtgaagaagccgtggggcctcgagtggaaggtctcctgcaaggcttcgtggataccaccttcgaccggtctactatatccgactgggtcgcgtacacggcccgtggaacgagggcttgaggnggngtgggacgatacaacctacgacggtgacaacaaacacgcacagtaagttcgagggcagggtacacgtagtcgacgacgggactaccgtaccgtacacgtcaacgtacgtaccctagttacggaggttacggacgtccgaaggtcgtcgaaggttacgtacgtacggacccggtaccgccgggtaccgttagttacgttacggtgttacggacgtagggaagtcgggtaaagtcggttaggtaccggacgggtaattacggtacggtactttagggtacgggtttaaggaggttaacggg

SEQ ID NO: 239569 - DNA, 719 bp, Homo sapiens
  misc_feature: GYAE6OF02HCWL1.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctctttcttgggtggcagcagcctcaggacgcccacctcccaggtacagttggtgcaggtcgtggggctggagggtagaaggaacgccggtcgggggcctacgaggtaggaacggtcctcctgacgaacggtccttcgtggtactacctacccgttccgacccggtactaacgtaactactaccgacgttggggtacgaccggaccgacccgggtccccgtagggaacgaacggggtcgttaggaggtagggacggttaggggaccggtactaacccgtaaaaccccgtaaccggtaccgggtcgaaccaacaaaccgaccgacaacgtaagtaacgttacggacggtacgacggtaccaacacggtacgacccggaggacctaccgtccgtacgacgactaacgcgtaccttcggtagggtacgtggacgtcggacggtcgtagaacgtcgtacgtacggaccggtaaccgtaccggtacggttattacggttacggcgtacggacggtagtacgggaaggtcggtacggtaggtacgtaacggtactacgtaggccgttagggttaacgtacggtaggtaccgg

SEQ ID NO: 239570 - DNA, 703 bp, Homo sapiens
  misc_feature: GYAE6OF02I02EB.4.18.B07.1.454.CMB.1.raw
  modified_base (246)..(246): a, c, t, g, unknown or other
  misc_feature (246)..(246): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtgggcctcagtgaaggtctcctgcgaaggcttcgngataccacttcgaccggctactagtactccacgtgggtgcgacacggcccctggacgaagggcttgagtggagtgggacgataccaaccctaacgaccggtacgacaacaaacaacgaccaacgtaagaagtttcgaagggtcgaacgggtaccaaccgtataccggaccgaacggggaccctaaccggttcccttacgaacggtacctaacgaacgtacccttaagttcgggaggttaacgacgtccgaaggtaccgtagaacggtactaccggtagacccgaacgaccgggtaccgtttacggttaacttacggttacgtacggtaacgggacggtaacggtaacggggtaaaggttaaccgtttaacggggtacggttaacgggtaacgtaaccggttaagggttacccggtttaggggtaaacgggttttaaggtaacgggtttaaacccggg

SEQ ID NO: 239571 - DNA, 687 bp, Homo sapiens
  misc_feature: GYAE6OF02JYQFD.4.18.B07.1.454.CMB.1.raw
  modified_base (501)..(501): a, c, t, g, unknown or other
  misc_feature (501)..(501): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccaggtacaggttggtgacagtcgtgggactggaggtgaaaggagccgtggggcctcgaggtaggaacggtcctccttggcgaagggtcttcgtaggattacctaccttccgaccggtctaactagtactccacgtggtgcgacgcgcccgtggacgaggtcgtggaggtggaggtgggacgtacgtaccaaacccgtaccgaccggtacggaccgaaccaaacgaccgacacgaacgtaggtttacgacgggacgacggtcacgagtgaccgaggacctacgtccgtcacgacaccgacgaccgtagtacggtaggacgtaacggaccgnggacgtagggaacgtacgttaccgtacggaacggccggtaaccggtcggtttaacgttacgttaaccggtggttacggtacggtaacgggaaggtaacgggtaacgttacggttaagggtacgggtaaccggtagtaacgtaacgggtaggttcgggttaaaggttagggtaggtttaacccgggg

SEQ ID NO: 239572 - DNA, 581 bp, Homo sapiens
  misc_feature: GYAE6OF02F9RLT.4.18.B07.1.454.CMB.1.raw
  modified_base (484)..(484): a, c, t, g, unknown or other
  misc_feature (484)..(484): n is a, c, g, or t
  modified_base (515)..(515): a, c, t, g, unknown or other
  misc_feature (515)..(515): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgccccactcccgaggtactaggttggtgctagtcgtggggctggaggtgaagacgccgtgggcctgagtgaacggtctctgacaggtcttcgtgactccaccttcgaccggtctactatactccagtgggtcgcgacgacggccccgtaggacgaggtcgtgaggtggagtgggacgactaccgaaccgtacgaccggtcgacaaccaaacgacgacaacgtagtaacggttcgacggacgagggtccacgacgtcgacgacggactaccgttctcgagcaccgacgtccttacgtagggtaggtagacgcgtaggctgagntacgcgacgacgtaccggtcgtagtattcgngtacgacgtagaggaagacgtagtaggaggtcgtagtacgcggtgttaggtaggttaggagtacgg

SEQ ID NO: 239573 - DNA, 939 bp, Homo sapiens
  misc_feature: GYAE6OF02IY74U.4.18.B07.1.454.CMB.1.raw
  modified_base (157)..(157): a, c, t, g, unknown or other
  misc_feature (157)..(157): n is a, c, g, or t
tcagagcactgtagcacgaccggtgctcgatttagtcgctgcgtaaggggagcatcacccagcaaccacatctgtcctctagagaatcccctgagacgctccgtttcctcaccatggactggacctggaggatcctctttcttggtgcagcagcctnaggagccccactcccgaggtacgtagttcggtgcagtcgtggggctggaggtgaagaagcgtcggggcctgacgtagaacggttctaccgtgacgtaaggtcttacgtggaactacctaccgttaccgaccggtaccttacttatactacccgtacgttaggggtccgtacgaccgtacccggacccccgttagggaaccggtaaacgggtccgtttgggtaaggtacggggtaggtacgggggaaccggtacgttaaccctaaacccccggtaaaccggtacccgggtacggaaccgaaaaccgtaaaacccgaaaccggaccgtaaaccgtaaacgggtaaacgttttaacccgggaaggggtaacccgtacggggtacccgtaaaaccgtaccgggtaacgaacccggggtaacgggtaaacccggtaccccgttaacccggtttaccaacccggtaacctaaccgtaaaccgggttaaccccgtttaacggggttacggggtaaacggttacgggtaccggtacccgggtaacgggttaaccgggtagtaaacggtaccgtttaccgtaaccgggtaccgaacccggtacccgggtaccggtttaccgtttaaacccgtttcggtttagggtaaccgggttaccgtaacgggggtacgaaacgggggtaacggttaacccggttagtaaccggggttaaccgggtaaaccgttaccggaacgggttttacggttaccgggggtttaacggttaaacggttaaggggttaaaccccggg

SEQ ID NO: 239574 - DNA, 869 bp, Homo sapiens
  misc_feature: GYAE6OF02HIGX2.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcgagcctgaggacgcccacctacccgaggtactagttggtgcgagtcggtggggctaggagggtagaacgaacggccggtcggggccttagaggtacggaacggttcctccgtaggacgtaaggtccttacgtacggtactaaccgttaccgttaccgaacccggtacttaacgttacgtaccttaccgacggttacggggttacgacccggacgtaccgggtccccgtaggaaccggtaagggtccgttacgggtaggttacgggacgggtacggggtaaccggtaacgtaacccctaaacccgtaacggacccgggtacggaaaccaaacgaaacccgtaaccggaaccgtaaacgtaacgggttaacggtttacggaacgggtaccggtaacggttacccgaaaccgtagtaaccgggaaccgggtacgggaacccgtaccgtttacccggtaacgaccggtaccgtaaccgtaccgtaccggtttacgggacgggttagggtacggtacgacggtacggtactaggacgtactacgggtaacgaaccggtaccgtaccggttgttaaccggtttaagttacccggttgggtaaccgggtacggtaacgggtaacgggtaacggttaacgggtacggttaacgggttaccggtaaggtaccggttaacggaccgggtttacgtagggtttaacgggtaacggttaggggttaacccg

SEQ ID NO: 239575 - DNA, 653 bp, Homo sapiens
  misc_feature: GYAE6OF02GXG2V.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtggaaggtctcctgcaaggcttctggatacaccttcaccggctactatatccactgggtgcgacacggcccctggacaagggcttgagtggagtgggacgatccaacccgtaacaccggtggacacgaaacaacgcaactaggtaacgtttcgacgggctagggtaccaaccgagtacggaccgacgggacctaccggttcccttacgacggtaccaccacggtacccttaacgttgggacggttggaacggacgaacgggcgtaggaagtacgtacgtacggaaccgtaccgaacccggtccggttacgttaacgtttacgtacggtacggacggtacggaacggaagggtaaacggtaccgtttagggaacggttaccggtaagttaccgacgtacggttaggttaacgggttaaggtaggttaaccggg

SEQ ID NO: 239576 - DNA, 517 bp, Homo sapiens
  misc_feature: GYAE6OF02GTTK1.4.18.B07.1.454.CMB.1.raw
  modified_base (442)..(442): a, c, t, g, unknown or other
  misc_feature (442)..(442): n is a, c, g, or t
  modified_base (508)..(508): a, c, t, g, unknown or other
  misc_feature (508)..(508): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcaggggtcaccatgaccagggacacgtccttcagcacagcctactggaggtgagcaggctgagatcgtagacgacncggccgtgtacttctgtgcgagagaggaagtacgttgagtcggatacgagtcgtaggtaggttagngttaacggg

SEQ ID NO: 239577 - DNA, 824 bp, Homo sapiens
  misc_feature: GYAE6OF02FZ50Q.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctgggaggatcctcttcttggtggcagcagcctcgaggagccccactcccaacggttacaggttcggtgcgagtcgtggggctggaggtagaagaagccgtggggcctcgagtagaacggtctccgtgacgaacggtcttcgtggaactacacccgttcgccggtactactatactccagttcggggtcgaccggacgaccggtccccgtagggacggtaacgggtcgttaggaggtgggtaacggtacggggaacggtaacgtaaccctaaaaccccgtaaacggtacccggggtacgaaccgaaaaccgaaaacgaaacccgacgtaaaccgtaaaggttaacggtttaacggaacggggtaccgaacgggttaccaaacgtacgtaaccggaacccggaacgggtaacctacccgtttacctaccggtaacgaccgaaaccgtcggtacccgtaacggttacggggaacgggttcgaacggtcggtaacgggtccgtaagggaacgttaaccgtccgtaaacgggaccgtaaccgggaccgggttacggttaccgtttacgttaacggttacgggacgaaccgggttagggaaccgggtaaagggttaaacggtacggtttaacgggaacggtttaacgggaaccttacgggtacttagggttaacggggtttaacggtaaggtaccggtttaacggg

SEQ ID NO: 239578 - DNA, 552 bp, Homo sapiens
  misc_feature: GYAE6OF02G64C4.4.18.B07.1.454.CMB.1.raw
  modified_base (245)..(245): a, c, t, g, unknown or other
  misc_feature (245)..(245): n is a, c, g, or t
  modified_base (455)..(455): a, c, t, g, unknown or other
  misc_feature (455)..(455): n is a, c, g, or t
  modified_base (463)..(464): a, c, t, g, unknown or other
  misc_feature (463)..(464): n is a, c, g, or t
  modified_base (469)..(469): a, c, t, g, unknown or other
  misc_feature (469)..(469): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtgaagaagccgtgggcctcgagtgaaggtctccgtgcagtctngatacaccttcaccggctactatactccacgtgggtgcgacgacggccccgtggaccgaaggtcgtaggaggtggagtgggacggactacgtaacccgtaacgacggtgacaacgaaacacgacacagtaacgttcgaggcgaggtaccacgtagtacgaacgacgggactaccgtcctacgagaccacgacgtcctacgtggacggtgngacgcggnngagtntcgtacgacgacgcgtcgtagttatacgtgcgagagagaggagtacgtaggagtcgatacgagcgttaggtaggtagagtacg

SEQ ID NO: 239579 - DNA, 681 bp, Homo sapiens
  misc_feature: GYAE6OF02G4V97.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctgggaggatcctcttcttggtggcagcacgcctacaggacgcccacctcccgaggtacgagttggtgcagtcgtggggctggaggtagaagagccgtggggcctgagtggaaggtctcgtgcgaagcttcaggatccactcgtaccgctactatactcacgtgggtgcgaccgacgccctggactaagggcttggaggtcggaagtcgggacggactacccaaccgtaaccgaccggtggaaccaacgtaaaccaacggcaacgtaaggtaacgtttacggaacggcggtacgggtacctaccgacgtacggaccggacggaacctaccggtaccgtcgacgtacaaccgtagacccgttaacgtgggtaggtacggagtacgacgggacgtagacgggactacgtacggaacgaccgtacggtaccggttgttaacgttacgtaggtccgagggtaacggaacggtaaggggtaaccgacggtttacggtaaccggacgggtaagttaccgaacggttccggttaagggttaacgggttaaggtagggtaaccggg

SEQ ID NO: 239580 - DNA, 691 bp, Homo sapiens
  misc_feature: GYAE6OF02F5A5E.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctgggctgagtgagagctgggcctcagtgaaggtctcctgcaaggctctggatacaccttcaccggctactatactccactgggtcgcgacacggcccctaggactaacgggcttgacgtggaagtgggacgtatccaacccgttaacgaccggtacgggaccaacgtaaaccgaacggaccaaccgacggtaagttttccgaaggggtcctaacggggttcaacccgtaatacggtaacccgaagggggaaccctaaccgggttacccctttacgaaccgggacaacccaacgggaccctttaacgttacgggtaacggttacggaacgttaccgaagggtccttacggaagggtacgttaacgtccgggaccggtaaccgaaccgggtacccgtttacgggtaactttacggacgttcgacgtaggagtacgggaagtaccttagggcggtaaccgtagtaacctggtacccgttaggtaggtttacggtagttaaccggg

SEQ ID NO: 239581 - DNA, 723 bp, Homo sapiens
  misc_feature: GYAE6OF02I6NS8.4.18.B07.1.454.CMB.1.raw
  modified_base (649)..(649): a, c, t, g, unknown or other
  misc_feature (649)..(649): n is a, c, g, or t
tcagagcactgtagcacgaccggtgctcgatttagtcgctgcgtaagggggagcatcacccagcaaccacatctgtcctctagagaactcccctgagagctccgttcctcaccatggactggacctggaggatcctcttcgttggtggcagcagcctacgaggacgcccacctcccaggtacaggttggtgcagtcgtcggggctggaggtagaagaacgccggtcggggcctagaggtgaacggttcctccgtcgacgaaggtccttgtggactaccgtaccttacgaccggtacttaacgtactactacccgaggttcgggtgaccggtaaccgccgggtcccccgtagggaacggtaaccgggtcgtttaggacggttaggacggttacggggaacgtaacgtacccgtaaacccggaaacggtaccgggtaccgaacctaaaccgaaaccgaaccggcctaaaacggtaacggtaatttaccggggacggtaccgacgtaaccgaacccaggtacgaacccggaggtaccgtacccggttcttaacgacggtaccaacgtacgtaccgttagtagggtacgtacgcgacgtcggtacgtcgtaagcgttacgacgtaccgacgtacggtcgttagttacgttacnggtacacggtagacggtagaaacgtgtacggtagtacgaagtactcggtacgttaggtacggttaggcgtaacg

SEQ ID NO: 239582 - DNA, 699 bp, Homo sapiens
  misc_feature: GYAE6OF02JWJIJ.4.18.B07.1.454.CMB.1.raw
  modified_base (582)..(582): a, c, t, g, unknown or other
  misc_feature (582)..(582): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccgaggtactagttggtcgcaggtcgtcggggcgtggaggtagaaaggaacgccggtacggggcccttcgaggtacggaacgggttccgtccgttggaccgtaacgggtctttaccgtggtaaccttaccgtacccgttccgacccggtacttaacgtacttacgtccgtacgtgggtcgccgaccgaccggcccgtaggaacgaacgggtcgttcggacggtggacggtacgggaacggtacgtaccgaacccgtaacggtaccggtacgaaccaacgaaaccgaacgacgaacgtacgtaacgttacgacgggtacgacggtaccacgacgtacgacggacggacctaccggtcctagacgacgaaccgacgtccgtacgtaggagtcgagacgacgacgtacgagtacncgtacgacgtacggacgtcgttattacgttacgtgtagacggaggtacggtaacggtagtacggtggtaacggtgtacgacgtacggtacgttgggtacggttacggtcgtaacggg

SEQ ID NO: 239583 - DNA, 664 bp, Homo sapiens
  misc_feature: GYAE6OF02HI3B9.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcgagtggcctcaggacgcccacgtcccaggtacagttggtgcagtcgtgggctggaggtgaagaagccgtggggacctcgaggtagaacggttcctccgtggaaccgaacggtcctttacgtaggaactacctacccgttaccgacccggtacttacgtataccgtcccgtagtgggtcgccgtaccgaaccggtccccgaggtacgacgggtctaggagtggtaggtgggacggtactacccgaaaccgtaacggccgggtcgaaccaaaccgaaaccgacgacacgtaagtacgttcggaacgggtacaaggtccaacgtcgtaccggaacgaggtaaccctccgttaccgtacgagaccgaactccggtacctacggtgggacgtcgtagcggtagacgtgactacgtcgacggacgacggtccgtcgttattacgttagcggtagagacgaggagtaacgtcggtaaggtcgtaaggagtacaggtacgttaggtagttaaggagtcgtaccgg

SEQ ID NO: 239584 - DNA, 638 bp, Homo sapiens
  misc_feature: GYAE6OF02FSTZ3.4.18.B07.1.454.CMB.1.raw
  modified_base (242)..(242): a, c, t, g, unknown or other
  misc_feature (242)..(242): n is a, c, g, or t
  modified_base (383)..(383): a, c, t, g, unknown or other
  misc_feature (383)..(383): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagagccgtgggcctcagtgaaggtctctgcaggcttcnggatacaccttcaccggctactatatccactgggtgcgacacggcccctggacaagggcttgaggtggagtagggacggactaccaaccctaacgaccgggtggacaacaaacgacgacacgaagtaacgtttcgacgggngacgggtacgacctagtacgaccgaacgggaccaaccgttccttacgacgaccgacgacggtaccctacggttacggacgggttagacgacgacgggtcgtacgaggtacgttccgtaggtaccggaccggacccggtccgggttacttacgttacgtggtacggcgagggtacggaagggtaacgtacggtttaggaacggttaccggaacgttacgacggtacggtttggtacggttaaggtaggttaacggg

SEQ ID NO: 239585 - DNA, 667 bp, Homo sapiens
  misc_feature: GYAE6OF02H7NCD.4.18.B07.1.454.CMB.1.raw
  modified_base (473)..(473): a, c, t, g, unknown or other
  misc_feature (473)..(473): n is a, c, g, or t
  modified_base (590)..(590): a, c, t, g, unknown or other
  misc_feature (590)..(590): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccaggtacagttggtgcagtcgtggggctggaggtagaagacgcgtcgggctcgagtgaaggtcctccgtgactaggtcttcgtaggtactacctaccttcgaccgtcttaactatactccgagtcgggtacgacgacgaccgggcccgtaggaacgtaagggtcgttaggtaggtagggtacggtacggggaaccgtacgtaaccctaaacccgtacgtaccgggtaggaaccaaaccgaaacacgacaacgtagtaacgttcgagggcaggtcaccagtacgacgacggactaccgtctanacgtcacgtacgtccgttagtgggagtcgtaacgcgaggtacaggtacacgttcgacggtaccgaccgtcggtccgtttaagtcgttacgagttcgaacggtagtaacgggtaaggnttacgggtaacggtacggttaacggactacggtaaggtccgtttaacggggtaacgttaacggacgggtttaaccgg

SEQ ID NO: 239586 - DNA, 814 bp, Homo sapiens
  misc_feature: GYAE6OF02HNCF9.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccgaggtacaggttggtgcgagtcgtggggctggaggtagaagacggcgtggggcctcgaggtagtaaggtctccgtgacgaaggtcttacgacggtactaccgtaccgttaccgaccggtacttaactagttactaccctacggtggggtacgtaccggaacgacccgggtacccccgtagggtaaccggtaaggggttccgtttaggaacggttagggtacgggtaggggacgtacgtaacccgaaacccgtaacggaccgggtacggaacctaaaccgaaacgtaaccggacctaacggtaacgttaaacggtttacggaacggggtaccgtaaacgggtaccgtaacgtacgggtaccgaaaccggtaacgggtacccgttaaaccggtccccgtttaacgacgggtacccaacgggtaccggttaacccgttacggtaggggtaacggttacggaaccgggtacgtacggggacgttaggaacgttaacgtaccgtagggaacccgtaccgggtacgggtaccggttagtttaacgttaacggcggtacgaccggttaggaacggtaacggaacggttcggttaggaacggtcgtaagcggtaggttaccttaggggttaacgttagggtaccggtacg

SEQ ID NO: 239587 - DNA, 685 bp, Homo sapiens
  misc_feature: GYAE6OF02JW79M.4.18.B07.1.454.CMB.1.raw
  modified_base (551)..(551): a, c, t, g, unknown or other
  misc_feature (551)..(551): n is a, c, g, or t
  modified_base (655)..(655): a, c, t, g, unknown or other
  misc_feature (655)..(655): n is a, c, g, or t
  modified_base (676)..(676): a, c, t, g, unknown or other
  misc_feature (676)..(676): n is a, c, g, or t
tcagagcactgtagcacgaccggtgctcgatttagtcgctgcgtaagggggaggcatcacccagcaaccacatctgtcctctagagaactcccctgagagctcccgttcctccaccatggctggacctggaggatcctcttcttggtggcagcagccctcaaggcgccctacctcccgaggtaactgttggtgctaggtcgtggggctggaggtagaagacggccgtggggccctagtagtaggaacggtctccgtgcgaaggtccttgtggtaactacctacccttaccgaccggtctaactatactcctacggtgggtgaccgacgtaccggcccctagggaacctaagggtcgttgacgtagggacgtcggggaactacgtaacccaacccgtacggaaccggtcgaaccaaaccgaaaacgacgtacaacggtaagttaacggtcgaacgggggtctaacgggaccaccgagtaacggaccgtaacggaacctccttaccgtacgacgtacaccgacgtacccgttgtacgggtaagcgtagaccgngtacgaggtactaacgtaccgacgtaccggtaccgtaacgggtcgttacgttaactacggttgacgtaggagtaacggacggtaaggtcctagggacgtgaacngacgtcgaggttacgttaggngttaaccgg

SEQ ID NO: 239588 - DNA, 912 bp, Homo sapiens
  misc_feature: GYAE6OF02HZ014.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtcgtggggctggaggtaggaagaagccgtggggcctcgaggtggaacggttccgtccgtggcgaaggtccttacgtaggtaacttaccgtacccgtttaccgaacccgggtacttaaccgtaacttactccccgtacgttggggtcgaccggaaccgaccgggtccccccgtaggggaaccggaaacgggggtccgtttagggaacgggttaggggtaacggttacgggggaaccggtaaccgttaccgtaaaaccccccggtaaacggtaccccggggttacggggaaccctaaaacccgaaaacccggaaaccgtaccgtaaaccggaaacggtttaaaccggtttaaccggaacgggggtaaccggtaaaccggggtacccgaaaacccgtacggtaacgggaaaccccggtaacgggggtaaccctacccggtttaccccggttaacgaaccggtacccgtaaaccggtaaccggtacccggttaaccgggtttagggggtaaacggtcggtaacggaccgggtaacgggtacgtaagggaacgttaccgttaaccgtacgggaacccggtaaccgtacccggggttaccgtagtttaaccgttaacggtcggttaccgggacgtaggtaacggaagggtaaagttaccggttagggtaacggttacgggtactacggtacgtccggttaagggtttaaggttacggacggtttaacggg

SEQ ID NO: 239589 - DNA, 727 bp, Homo sapiens
  misc_feature: GYAE6OF02J1PW4.4.18.B07.1.454.CMB.1.raw
  modified_base (242)..(242): a, c, t, g, unknown or other
  misc_feature (242)..(242): n is a, c, g, or t
  modified_base (647)..(647): a, c, t, g, unknown or other
  misc_feature (647)..(647): n is a, c, g, or t
  modified_base (660)..(660): a, c, t, g, unknown or other
  misc_feature (660)..(660): n is a, c, g, or t
tcagagcactgtagcacgaccggtgctcgatttagtcgctgcgtaagggggagcgatcacccagcaaccacatctgtccctctagagaatcccctgagagctccgttcctcaccatggactggacctggaggatcctcttctggtggcagcagccctcgaggacgcccactcccgaggtacaggttggtcgacagtcgtggggctgaggtgaagagccgtgggcctcagtgaacggtcctcngacgaaggtcttcgtggactaccgtaccttaccgaccggtctaacctaactacctcccaacgttcggggtgccggtaaccgtacggtacccccggtaggaaccgtaacgggtcgttaggacggtacggtagtaccggggtacgaccgtaccccgtaaaccccgtaccgaccgggtaccggtaccaaaccgaaaccgaccgaacgaacgtaacggtaacggtttacggacgggtccggaacgggttaccaacgaacgtacggtaccggaacgggtaccacggtttcccttacgaacgacctacgtaccgtaccgttaacggtacgggtaggtacgtacgacggacgctacggacgttacgtacgtaccggaacgaccggtccggttaacgttcggtacttaacggngtcggacgtaggngtaaggaacgtcgtaggaaccggttacggaacttacggcgacggtttggtagggtagacggttaacg

SEQ ID NO: 239590 - DNA, 788 bp, Homo sapiens
  misc_feature: GYAE6OF02HCTUO.4.18.B07.1.454.CMB.1.raw
  modified_base (462)..(462): a, c, t, g, unknown or other
  misc_feature (462)..(462): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatccttcttcttgggtggcagcagtcctacgaggacgcccgacctcccgaaggtacgtaggttggtcgactacggtcggtggggcttggagggtagaaaggacgtaccggtggggcctagaggtaggtaacggttccgtcgtaggaccgaacggtcttacgtacggtacttacccaccgtttccgaaccggtacttaacgtactacgtacccgtacggttggggacgaccggaaaccgacccgggtaccccgtaggtaaccggtagggtccttagggaacggtggaacggtggggaccgtaacctaccgtaaacctaaccgggtacgggtanaaccaaacccgaaaacgtaccgactaaacgtaaggttaaacggttcgaacggggtaccgaacggtaccgaaccgtagaacccggtaccggacggtaaccgtaccttaccggttaacaccggtaccaacgtaccgtaccgttacggttagggacgtggtaacgtacgacggtaagtggagtacgacgttacggaccgacggtaccggtacgttagttacgttaccggtggagtaccgaggtacggtaaggtaacggttacgggtaagtcggttaaccgaaggttacggacttaggggttaagttacgggttacgaggtttaacccgg

SEQ ID NO: 239591 - DNA, 569 bp, Homo sapiens
  misc_feature: GYAE6OF02GGM0D.4.18.B07.1.454.CMB.1.raw
  modified_base (281)..(281): a, c, t, g, unknown or other
  misc_feature (281)..(281): n is a, c, g, or t
  modified_base (488)..(488): a, c, t, g, unknown or other
  misc_feature (488)..(488): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttctggatacaccttcaccggctactatatccactgggtncgacacggcccctggacaagggccttggagtggatgggacgagtccaaaccctaacgaccgggtggccaacaaaacaacggacacaagaagtttcgagggcaggtcaccagtgacaagggcaacgtccttcagcacacgacctacgttggaggtcagcaaggtctagacgatctcggacgaccgacgggtcccgtagttacttacgnggtacgcgggtagaggagggaacgtagttggaacggttacggaatacggagtacgttaggtagggttaagaggttaaccgg

SEQ ID NO: 239592 - DNA, 682 bp, Homo sapiens
  misc_feature: GYAE6OF02GX4G6.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagccgtggggcctcagtgaaggtctcctgcaaggcttctggatacaccttcaccggctactatactccactgggtgcgacacggcccctggacaagggtcttgagtggagtgggacggataccaaccctaacgaccgggtgaccaacaaacaacgacacagtaacgttcgagggacagggtcaccgatacgaccgagggacctaccggtccttacgacgaccgaactacgtacccgttacggttcgggacgggttacggacggacgtacgggtccgtaggaacgtacgttaccgttaccggaaccggaaccgtacccggggacccgtttaggttaacgtttaccggtagggttacggtaccgggaaggtaacgggaagggtaaacggttaaccggtttagggaaccgggttacgggaacttaacggtacgggtaccgttagggtttaacgggtttaacggtagggtttaacccggg

SEQ ID NO: 239593 - DNA, 729 bp, Homo sapiens
  misc_feature: GYAE6OF02GENNX.4.18.B07.1.454.CMB.1.raw
  modified_base (311)..(311): a, c, t, g, unknown or other
  misc_feature (311)..(311): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctgggaggatcctcttcttggtggcagcagcctcgaggacgcccacctcccgaggtacaggttggtgcacgtcgtgggctggaggtagaagagccgtgggcctcgagtggaacggtcctccgtgacgaacggcttcgtaggtactaccacccttcgacccggtctaactactactccacgtggggtcncgaccgacggccccgtaggaccgaacgggtcttaggaggtcgggacgtaggggacggtacgtaccaaacccgtaaccgaccggtcggaccaacgaaaccgacgaccgaacgtaacggtaacgtttacgaacggggtaccgtaacgggtaccaaccgacttacggaaccgaacgggacccgtaccgttaccgtacgacggacgtaaccgacgtacccgttacggtcggaacgggtcgaggccgaggtacgtaggacggtactaccgtagtaccggaccgtaccgggtccgttacgttacgttacgtgttacggacggtagagggtaacggtaacgttacggttacgggtacggtacgggtaacttaacggacggttacggttagggtttaacgggttaacggttacgggttaacccggg

SEQ ID NO: 239594 - DNA, 769 bp, Homo sapiens
  misc_feature: GYAE6OF02H91J0.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctctttcttggtggcagcgacgcctcgaggacgcccactcccgaggtacagttggtgcagtcgtgggctggaggtgaagaacgccgtgggcctgagtggaacggtcctccgtgcgaacgtcttcgtaggactacctaccttccgaccggtctactatactaccgacgtgggtcgacgagaccggtcccctacggaacgtacgggtcttaggaggtacgggaggtacgggaacccggtaactacccgtaaaccccgtaacggtacccgggtacggaaccgaaacccgtaaaaccgaaccgaccgaaacgtaaggttaaacgtttaccgggacgggtacgtacggggtaacccaaccggtagttaaccggaccggaacgggtacccgtaccggttaccccgttacggaacgaccgtaaccgaccgtaccggttacggtagggtacggacgtacggacgacggtcgtaggagttacgtcgtacgggaccgaaccgtacggtacggttacgttacgtacgttacggtcggaacggaacgggtaggtaaggtaacggttaccggtagggtaacggttaccgggtagaaccggtacggttacggttacgggtttaaggttaaaccgggtaggtttaaccggg

SEQ ID NO: 239595 - DNA, 571 bp, Homo sapiens
  misc_feature: GYAE6OF02HJ1DV.4.18.B07.1.454.CMB.1.raw
  modified_base (465)..(465): a, c, t, g, unknown or other
  misc_feature (465)..(465): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagagcgtggggcctcgagtgaaggtcctccgtgcaaggcttcgtggatacaccttcaccggctactatatccactgggtgcgacacggcccctggacgaagggcttggagtgggatggggacggatccgaaaccctaacgtaccggtggaccaacaaaccaacgaccaacgaagtaagtttcgagggacacggggtccacgatacgacgaggactacggtccttcacgcacacgtacctacgttaggaggttgagcgacggntgacgagtcgagacgacgacggcccgtgttacttacgtgtgcgagaggaggaagtacgttaggagtacggtagtacgtagcgttaggtaggttaggagttaaccgg

SEQ ID NO: 239596 - DNA, 648 bp, Homo sapiens
  misc_feature: GYAE6OF02FPJ9H.4.18.B07.1.454.CMB.1.raw
  modified_base (249)..(249): a, c, t, g, unknown or other
  misc_feature (249)..(249): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtaccagttggtgcagtctggggctgaggtgaagagccgtggggcctcgagtgaaggtcctactgacaaggcttcgnggactacctacctcgaccggctactatactccacgtgggtcgcgacgacggccccgtggacgaacggtctaggaggtggagtgggacgtataccgaacccgtaacgaccggtggaccaacgaacacgacaacgtaggtaacgtttacgacgggacgtacgggtaccaccgactacggaccgtacgggtaccgtaccgttaccttacgacgtacccaacgtaccgtaccgttaccggttacgggaacggttacggacgaccgtaaggtccttaggaactcgtacgtacggtaaccgccgtacggtccgtacgttacttaacgtcgtagccggaggtacggaggtaacggtacgttggaagtacggtacacgtcgtcgttaggtacggtagtacgtaccgg

SEQ ID NO: 239597 - DNA, 588 bp, Homo sapiens
  misc_feature: GYAE6OF02FR1AL.4.18.B07.1.454.CMB.1.raw
  modified_base (424)..(424): a, c, t, g, unknown or other
  misc_feature (424)..(424): n is a, c, g, or t
tcagagcactgtagcacgaccggtgctcgatttagtcgctgcgtaagggggagcatcacccagcaaccacatctgtcctctagagaatccccctgagagctccgttcctcaccatggactggacctggaggatcctcttcttggtggcagcagccctcaggagccccactccccaggtacagttggtgcagtctggggctggaggtgaagaagcctggggcctcagtgaaggtctcctgcaaggcttctggatacaccttcaccggctactatatccactgggtgcgacaggcccctggacaagggcttgagtggagtggggacggatacaaccctaacgaccgggtaggccaacgaaacaacgcaacagaacgtttcgagggcagggtcaccgatacgaccgagggacacgtccttcagccanacgcctacgtggaggtgagcaggtctgagactcgtagacgaccacgggccgttagtaacgttacgttggtcggacggtaggaggagggtaaacggtaacgttagggaacggttacggtaagtaacgtacgggtacgttggtagggtttaaggtaggttaacggg

SEQ ID NO: 239598 - DNA, 683 bp, Homo sapiens
  misc_feature: GYAE6OF02JSPHG.4.18.B07.1.454.CMB.1.raw
  modified_base (154)..(154): a, c, t, g, unknown or other
  misc_feature (154)..(154): n is a, c, g, or t
  modified_base (160)..(160): a, c, t, g, unknown or other
  misc_feature (160)..(160): n is a, c, g, or t
  modified_base (182)..(182): a, c, t, g, unknown or other
  misc_feature (182)..(182): n is a, c, g, or t
  modified_base (190)..(190): a, c, t, g, unknown or other
  misc_feature (190)..(190): n is a, c, g, or t
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (248)..(248): a, c, t, g, unknown or other
  misc_feature (248)..(248): n is a, c, g, or t
  modified_base (365)..(365): a, c, t, g, unknown or other
  misc_feature (365)..(365): n is a, c, g, or t
  modified_base (418)..(418): a, c, t, g, unknown or other
  misc_feature (418)..(418): n is a, c, g, or t
tcagagcactgtagcacgaccggtgctcgatttagtcgctgcgtaaggggagcatcacccagcaaccacatctgtcctctagagaatcccctgagagctccgttcctcaccatggactggacctggagatcctcttcttggtgcagtcagcctnaaggcncccactcccaggtatagttggnactgtcgngggtcngagnagagcctgggctcgagtgaacggtctccgtggataacggtcctttagnggatacccggtaacttccgaacggcttaaacttcaacggtccctacgtgggttgaactcgaccggttccccaggaccgaggtcttggagttggcgtggacgtactaccaaccgtacncgtaggcaaactaacgcggtaccaagaacgtcgttcgaccgggagttcggacncgttagcgaacggtggaacctcgttaccttaccgaaggccacgtaacgtcccgtacgttggtacggaccgtagtaacccgggtggtacgtacggacgttactacggtacgtaccgtacggtaccggttaacgttacgttacggtaacggttcggtacgtaacgacgggaaggttaccggtaacgttaccggtacggtaaccggttaccggaactaccggttacggttaccggttaagggtttacgttaccggttacggttaccgg

SEQ ID NO: 239599 - DNA, 535 bp, Homo sapiens
  misc_feature: GYAE6OF02F33KY.4.18.B07.1.454.CMB.1.raw
  modified_base (258)..(258): a, c, t, g, unknown or other
  misc_feature (258)..(258): n is a, c, g, or t
  modified_base (439)..(439): a, c, t, g, unknown or other
  misc_feature (439)..(439): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctgggggcctcagtgaaggtctcctgcaaggcttcgtggatacaccttnacccggctactatatccactgggtgcgacaggccccctggacaagggccttgagtggatgggacggatcaaccctaacaccggtggcacaaacaacgcacagaagtttcagggcagggtcaccgatacgaccgaggacacgtcctcagcacagcctacgtggaggtgacgcaggctagganatcgtgaacgacacggcgtgtaactacgtgtgccgagacgaggtaagacgttggacgtcggtagtacgagtcgtggtacggttaagaggttaacgg

SEQ ID NO: 239600 - DNA, 729 bp, Homo sapiens
  misc_feature: GYAE6OF02F8CZ8.4.18.B07.1.454.CMB.1.raw
  modified_base (255)..(255): a, c, t, g, unknown or other
  misc_feature (255)..(255): n is a, c, g, or t
  modified_base (314)..(314): a, c, t, g, unknown or other
  misc_feature (314)..(314): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccgaggtactaggttggtgctagtcgtgggctgaggtagaagacgtccgtgggcctcgagtagacgtctccgtgactaggtcttgnggatacctaccttacacccggtctaacgtaactactaccgaccgttgggagtaccgacncgggtacccccgtagggaccgtaagggtcttaggaaggtcgggaagtaggggaaccgtacaccaaaccccggtaacgtaccgggtgaaccgaaccaaaacgtaaccgaccgacgtaacggttaacggttacggacgggtacgtacggtaccaccgtacgtacggaaacccggacggtaacgtaccgttccttaccgtacgaccgaaccgttcgtaccgtaacggttaggggtacgtagggtacgagacgggttactggtaacggtatccgacggtacggaacgtccgggtacgtttgttagtaaccgtggtaaccgacgggagaacgggacggttaacgtaggttacgggtaacggtacggtaaccttcggtaacggtaccgtttggtaacggggttagaacccgggttaacggg

SEQ ID NO: 239601 - DNA, 809 bp, Homo sapiens
  misc_feature: GYAE6OF02G40FF.4.18.B07.1.454.CMB.1.raw
  modified_base (627)..(627): a, c, t, g, unknown or other
  misc_feature (627)..(627): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggagatcctcttcgttggtggcagcacgcctcgaggacgccccacctacccgaggtaactaggttggtcgacgagtcgtggggctggaggtagaaaggaacgccgtcggggcctgaggtaggtaacggtcctaccgtcggacgtaacggtcttcgtaggtactaccgtacccttaccgaaccggtcttaacttacgttacctacccgtacgttcggggtacgaccggacgtacccggtccccgtagggaaccgtagggtccggttaggaggtacgggacggtacggggaccggtaacttacccgtaaaccccgtaaccggtaccgggtacggaccaaaaccgtaaaccgacggtaccaacggtaacggttaaacgtttaccgggaacgggaccgtacggggtaccctaacgacgtacgaacccgggagggtaaccccgacgtttacccgtacgacgaccgaacgtactacccgttaaggtcgggtaggtacggacgaccggnggtaccgtagaacgtacgtaccgacggaccgtaccgggtaccggtccgtttacgttaacgttaccggtaggtaccgacgggtaacgggaggtaacgggttacgttaaccggtaggtaacggtaacgggttactaacgggtacgttcggttaaaggtttacgggttaacggtacggttaaccg

SEQ ID NO: 239602 - DNA, 822 bp, Homo sapiens
  misc_feature: GYAE6OF02GX7TQ.4.18.B07.1.454.CMB.1.raw
  modified_base (198)..(198): a, c, t, g, unknown or other
  misc_feature (198)..(198): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccacctcccgaggtacagttggtgcagtcgtgggntggaggtgaagagccgtgggcctcgagtgaaggtctccgtgacaggcttcgtggactactacccttccgaccggactactatactcccacgtgggtcgcgacgaccgggccccgtaggacgtacgggcttaggaggtaggtagtggggacggactacccgaaacccgtacgaccggtacggaccaaaccgaaaccgaaaccgcgaaacgtaaacggttaacggtttaccggaacggggtaccgtacggggtacccaaccggtaacgtaccggaacccggtaacggggtacccgtaacccggtttaccccgtttacgaaacccgaccgtaaccgtaacccggttaccccgttacgggttacggggaagggttaccggaccggtaccggtacgggtaccgtacggtaacgggtaacgttccggtaaccgggtacccgtaaacccgggtacccggggtacccggtttagtttaaccgtttaccggtacgggttacgacggggtaaggaaggggttaacgggtaaaccggttaacggtttaacgggtaacgggtttacggggaaactttacgggacggtttacgggtttaagggtttacggggtttaaagggtcgggtttaaccgggg

SEQ ID NO: 239603 - DNA, 873 bp, Homo sapiens
  misc_feature: GYAE6OF02JKAFT.4.18.B07.1.454.CMB.1.raw
tcagagcactgtagcacgaccggtgctcgatttagtcgctgcgtaagggggagcatcacccagcaaccacatctgtcctctagagaatccctgagagctccgttcctcaccatggactggacctggagtactcctcttcttgggtggcagcagtcctcaggacgcccactcccgaggtacagttggtgacagtcgtggggctgaggtagaagaagccgtgggcctacgagtagaacgggttctccgtcgacgtaaggtcgttcgtcggtaactacctaccgtttaccgaacccggtccttaacgttaattacgttacccgtaaccgtgggggttacgccgtaaccggacggtccccccgttagggaaccggtaaacggggtccttagggtaaggttacggggtaacggtacgggggaaccggtaacgttaaaccccgaaaccccggttaaccggtaacccggggttcgggaaccctaaacgaaaacccgtaaaccggtccgttaaccgtaacggttaaaacggtttccggtaacggggtaccgtaacgggggtacccaaccgtacggtaacggtacccgaacggggtaccgtaacccgttccgtttaccgaacgtaccaacggtaaccgtacgttaccgggtaacggtcgggtaacgacgggttaccgagggtcgtttaaggagtaacgttacggtaccggggtaccgaacccggttacccgggttcccggttacgttaaacgttacggttgggaccgaaccggggtgaaaggtaacgggtaaacgtttaccgggttacggttaagggttaccgggtaacttagacgggttaaccggttaggttaacggggttaacggttagggttaacccgg

SEQ ID NO: 239604 - DNA, 711 bp, Homo sapiens
  misc_feature: GYAE6OF02IR59N.4.18.B07.1.454.CMB.1.raw
  modified_base (591)..(591): a, c, t, g, unknown or other
  misc_feature (591)..(591): n is a, c, g, or t
tcagagcactgtagcacgaccggtgctcgatttagtcgctgcgtaagggggagcatcacccagcaaccacatctgtcctctagagaatcccctgagagctccgttcctcacatggactggacctggaggatcctcttcttggtggcagcagcctcaggacgccccaacctcccaggtacctaggttcggtgcgtagtcgtggggactggacggtagaagaacgccgtggggcctcgagtagaaggtcctccgtgacgacggtcttcgaggactaccgtaccttcgaccggcttaactactactcctacgtgggcgcgaacgccggcccctaggaacgacggtcttaggaggtggagtgggaacgtcaccgaaccgtacgccggtacgacaacgaaacaccgacacgagtaacgtcgacggcgtaggtaccacgtacgtacgacgacggactaccgttacgtacgacggtacctaacgaccgtcccggtaacgttaggggaacgttcggacgtacggtacgtacgaggtacgtagttaccggaccggtaacgacccggtaccgggttaaccgtttaagttaacggtttacgngggttacgaccgggtaggaacgggtaacgggtaacggttaaccgttaggggtaaccggtacgttacggtaacggacggttacggtttagggttaacgggttaacggtaagggttacccgg

SEQ ID NO: 239605 - DNA, 747 bp, Homo sapiens
  misc_feature: GYAE6OF02GN89W.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctggaggtagaagaagccgtggggcctcgagtggaacggtcctccgtgacgaacgggtccttcgtaggaacttaccgtacccgtttccgacccgggtaccttaaccttaacttacttccccgtaacgttgggggttacgaccggaaccgtaaccgggtcccccgtagggaccgtaaacggggtccttagggaaggtcgggagtacggggaacgtagtacccgtaaacccgtaacgccgggtacgaactaaccgaaacgaacgcgaacacggtaacgtttcgacgggtacgacgggtaccaacgtacgtaacggaccgtaacgggacctaccggttaccttacggaacgtacccaacggtaccgtacccgttaacgtgggaacggttacggagtaccggaggtccaggaacgacgttcgacggaccgacgtaccgggacgtttacgtaacgttaccgtgtacggaggaaggaggtaacgggaactacggttggaacggtacgtaacgttacggacggttaccgttagggtttaacgggtaagtacggtaacgg

SEQ ID NO: 239606 - DNA, 689 bp, Homo sapiens
  misc_feature: GYAE6OF02HN5DT.4.18.B07.1.454.CMB.1.raw
  modified_base (198)..(198): a, c, t, g, unknown or other
  misc_feature (198)..(198): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtgggctgnggtagagaagcctgggcctcagtgagtctcctgcaaggcttacgtgatacacttcacggctactatactccaactggtgcgtacacggcccctggacgaacgggcttagcgtaggactggggacgataccgaaccgtaacgaccggtaggacctaacgaaaccgaaacgaccaacggaagtaacggtttacgaacggggtacgaacgggttaccaacccgtagttaccggaacccgtaaggggaccctaccggttacccttacgtaacgtaccgaaccgtaaccgaccttaacggttacgggaacggttagtacggacgacgggtacgttagacggtaacgttccgtaacgacccggaccgtacgggacccgttagttaaaccgtttcgtagttcggtacggaggtacggtaagtaacgggtaccgttagggtaacggttaccggtaagacggtacggtacggttacggtaaggttaggagtttaaccggg

SEQ ID NO: 239607 - DNA, 717 bp, Homo sapiens
  misc_feature: GYAE6OF02H4J3Z.4.18.B07.1.454.CMB.1.raw
  modified_base (584)..(584): a, c, t, g, unknown or other
  misc_feature (584)..(584): n is a, c, g, or t
tcagagcactgtagcacgaccggtgctcgatttagtcgctgcgtaagggggagcgatcacccagcaaccacatctgtcctctagagaatcccctgagacgctccgttcctcaccatggactggacctggaggatcctcttcgttggtggcagcagcctcaggacgtcccacctcccgaggtacaggttggtgcagtcgtggggctaggaggtgaagaacgccgtgggcctacgaggtgaacggtcctccgtggactaaggtctttacgaggtacttaacccgtacgtttaccgaccggtacttaacgttactaaccgtccgaacggttcgggtacgaccggaaccgccgggtacccccgttaagggaaccggtacgggtacgtttacggaggttagggacgggttaggggaaccggtactaaccccgtaaaccccgtaacggtacccgggtagaaccgaaccgtaaaacaccgtacaaaccggtaaggttaacggttacggaacggggactaggggtaccacgagtaccgacgaacggtactaccgttactacgactcgaaccgtacgtacctggtacggaggngacgcgagtcgagacgtagaccgtaggacgacgtcggtacgtttgtaactcggtcgagacgtaggaagtacgggtaatacggtcggaaggttcaaggtctagggtacgttaggtagggtaactgggtaacccg

SEQ ID NO: 239608 - DNA, 675 bp, Homo sapiens
  misc_feature: GYAE6OF02JGK3J.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggagatcctcttcttggtggcagcagcctcaggagcccactcccaggtacagttggtgcagtctggggctgaggtgaagagcctgggcctcagtgaaggtctcctgcaaggcttcgtggatacaccttcaccggctactatatcctacgtggtcgacgacgacggccctggtacgaacgggcttcggagtggagtgggacgataccgaaccctaacgaccggtgaccaaaccgaaacaaccggcaacgaggtaaacgtttacgaacgggtacgtaacgggtaccaaccgtaacgtacgaaccggtaacgggtaaccgtacccggttaccttaccgaacgaccgaacgaacgtccgttaacgttgggaaggttaggacgacgtacgggcttaacggagtacgttacgacggtaaccgaccgacccgggtcgttaacgttacgttaacgtcgtacggagacgaaggtaacggaacgttaacgttaggtacggtaaccggtaacctaacgtaggtacccgttagggttaaggttaacgtaacggttaaccggg

SEQ ID NO: 239609 - DNA, 720 bp, Homo sapiens
  misc_feature: GYAE6OF02GLMCW.4.18.B07.1.454.CMB.1.raw
  modified_base (391)..(391): a, c, t, g, unknown or other
  misc_feature (391)..(391): n is a, c, g, or t
  modified_base (577)..(577): a, c, t, g, unknown or other
  misc_feature (577)..(577): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctgggaggatcctcttcttggtggcagcacgcctcgaagggacgcccctacctccccaacgggttaacagtttgggtcgtacgtacggttcgtgggggtcctagggtagggtaggaaaggaacgcccggtcgggggcccttacgaggtcgggaaggttcctccgtaggacgaacggtcttcgtagtactacctcctccgaccgtctactatactcccaggtgggtcgacgaccgaccggccccgtaggaacggtagggtcgttagggnggtagggtacggaggggtaacgactacccgaaacccgttaaccgaccgggtacggaaccaaaccgaaacacggacaacgtaacggttaagttacggacggtagacggtaccacgactacggacgacgtacgtcctacgtacacgacacgcgtacctacggtaggagcgagcgacgtcgtagcgtanaccgtgaccgtaccggacggtaccggttagttacgttcgtaggtacgacgggacggtagtaacgggtaaagttcggtaacggagggttacggtacgtacggtacggttggtttaagggtacggttaaggtaccgggttaacgg

SEQ ID NO: 239610 - DNA, 938 bp, Homo sapiens
  misc_feature: GYAE6OF02GOTAB.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccaactcccaggtacagttggtgcagtcgtggggctgaggtgaagaacgccgtgggccctacgaggtcgtaacgggttcctacccttaggaccgtaaagggtcctttaccgtagggtaaccttacctacccgtttaccgaacccgggtaccttaaccttaacgttaaccgttacccgtaacgttcggggttacgaccggtaaccgaaccgggtcccccgtaggaaccggaacggggtcgtttaggaacggttagggtacggtacggggaaccggttactaaccccgtaaaccccgttaaaccgtaccgggtacgaacccgaaaccgaaaaccgaaaccggtaccgaaacgtaaacggtaaacggttttaccggaacggggtaccgtaacgggggtaccctaacccggtaagttaccggtaaccgggaacggggtaaccctaccccgggtttacccgtaaccgtaccggtaaccgaaacccgtacggttaccccggtttaaggttacggggtaacgggtttacggaaccggcggtaaccgggtccgttaaggacgggttaccttccgggtaacggtaacccgaaccgggtaacccgggtaccgtttacgggttaacctttaccggttagggttaccgacgggtaacgggtacgggtaaacggggtaactttaaccgggtttacggtaaacgggtttaaccgggaaccgtttaacgggaccggtttaccgggttaacgggtttttaaacgggttacggggtaaggtttaacccgggg

SEQ ID NO: 239611 - DNA, 663 bp, Homo sapiens
  misc_feature: GYAE6OF02FTM1Y.4.18.B07.1.454.CMB.1.raw
  modified_base (144)..(144): a, c, t, g, unknown or other
  misc_feature (144)..(144): n is a, c, g, or t
  modified_base (200)..(200): a, c, t, g, unknown or other
  misc_feature (200)..(200): n is a, c, g, or t
  modified_base (219)..(219): a, c, t, g, unknown or other
  misc_feature (219)..(219): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggnggcagcagcctcaggagcccactcccaggtacagttgtgcagtctgggctgaggtnaagaagcctgggcctcagngagtctccgtgccgaaggtcttcgtggataccgactttcgaaccggtctaactactacgtaccctaagtgggttacgcgtaacgacggtacccccgttaggactaacggggtctttaggacggttggaacggttgggaccggtatacccgaaaccccttaacgaccggtacgaccgaacgaaaacgaccgacctaacgaagtaacgtttcgaaggcgacgggtaccaacgtacgtaccgacgtacggaactaccgttcttaccaagccgacgtgacccgttaaccggtggttaggacggtagacgtaaggccttacggagacgttgacgacgacccagggtcccgttagtaaccgtttacgtgtacgtcgacgtaaggtacgggaactacggtacggtacggtacgaagtacgaacgtccggtagttacggttaagaggttacg

SEQ ID NO: 239612 - DNA, 797 bp, Homo sapiens
  misc_feature: GYAE6OF02JRXPK.4.18.B07.1.454.CMB.1.raw
  modified_base (153)..(153): a, c, t, g, unknown or other
  misc_feature (153)..(153): n is a, c, g, or t
  modified_base (160)..(160): a, c, t, g, unknown or other
  misc_feature (160)..(160): n is a, c, g, or t
tcagagcactgtagcacgaccggtgctcgatttagtcgctgcgtaagggggagcatcacccagcaaccacatctgtcctctagagaatcccctgagacgctccgttcctcaccatggactggacctggaggatcctcttcttggtaggcagcngcctcgnggacgccactcccaggtacagttggtgcgagtcgtggggctggaggtgaacgagccgtgggcctcgtagtggaacggttcctaccgtgacgtaaggtctttacgaggtacgtacctaccttccgacccgtacgtaacttactacttacccgaggttcgggtacgacgtaaccggaccggtccccgtacggaccggtaacgggtcggttaggtacggttacgggaggtaggggtaaccgggtacctaaccctaaacccggttaacccggtaaccgggtccggaaacccggaaaccgaaaccgtaaccgtaaccgaaccggtaacgtaaaacggtttaccggaacggggtacggaacggggtaccctaaccggacggttaaccggaacccgtaaggtaaacccggtaccgtttccgtaaccgtaacggtaccgaacgtacccgtaccggttacgttaccggtaggtacggtacgtacggcgtcgtacgcgtaactccgacggtaccgtaccggtccggtacggtagttcgtaacgttcgtacggtcgaaggacgtaacggtaacggttaacgttacggaacggtaaccgtaggtaccgtagttaccgggttaaggtacgggttacgaagggtttacccg

SEQ ID NO: 239613 - DNA, 671 bp, Homo sapiens
  misc_feature: GYAE6OF02HOIKC.4.18.B07.1.454.CMB.1.raw
  modified_base (552)..(552): a, c, t, g, unknown or other
  misc_feature (552)..(552): n is a, c, g, or t
  modified_base (599)..(599): a, c, t, g, unknown or other
  misc_feature (599)..(599): n is a, c, g, or t
  modified_base (639)..(639): a, c, t, g, unknown or other
  misc_feature (639)..(639): n is a, c, g, or t
tcagagcactgtagcacgaccggtgctcgatttagtcgctgcgtaagggggagcatcacccagcaaccacatctgtcctctagagaactcccctgagagctccgttcctcaccatggactggacctggaggatcctctttcttgggtggcagcacgcctcgagggacgccccactcccgaggtactaggtttgggtgctaggttcgtggggtctggagggtaggaaggtaacggccggtcgggggcctacgtaggtacggtaacggttcctccgtacggacgtaacggtcttcgagtactacctaccttaccgaccgctaactattactaccgtaggtgggtcgacgaccgaccggccccgtaggaaccggagggtcttaggacggtgggaagtacggggaccgtactaacccaacccgtaccgtacggtacggaccaaacgaacgaacgcaacgtagtaacggttacgacgggcgacgcacgtcgacgaccgacgactccgtctacagccaacgtcgtacgtacggtacgggtggtacgcgcggacgtagnggtacgtacgtacgtcggtaccgacgtccggcgtttagtacttacgngtacggagacgagggtaacgacgtgttacggacgttgaancgtaggtacgttaggtaggttacgagtaccgg

SEQ ID NO: 239614 - DNA, 615 bp, Homo sapiens
  misc_feature: GYAE6OF02F1KLL.4.18.B07.1.454.CMB.1.raw
  modified_base (246)..(246): a, c, t, g, unknown or other
  misc_feature (246)..(246): n is a, c, g, or t
tcagagcactgtagcacgaccggtgctcgatttagtcgctgcgtaagggggagcatcaccccagcaaccacatctgtcctctagagaatccccttagagctccgttcctcaccatggactggacctggaggatcctcttcttggtggcagcagcctcaggagcccactcccaggtacagttggtgcagtcgtggggctgaggtgaagagccgtggggcctcgagtgaaggtctcctgcaggcttcnggataccaccttccaccggctactattactccacgtgggtgccgacacggcccctgggacaagggtcttgaggtggagtgggacggataccgaacccgtaacgaccgggtagcaacaaacaccgacacaagtaacgtttcgagggacgacgggtaccaccgagtacgaaccgagggacctaccggtaccttcgagcaccgtacgtccgttacgtgggagttaggacgcgacggcgtagagtaactgtaccggacgaccgaccgggtccgttaggttaattacgttgtacggacgaggaggaagggtaacggtgttacggacggtacggtaagacgtagacgttaggttaggtaggtaggtaggttaccg

SEQ ID NO: 239615 - DNA, 632 bp, Homo sapiens
  misc_feature: GYAE6OF02I97R7.4.18.B07.1.454.CMB.1.raw
  modified_base (247)..(247): a, c, t, g, unknown or other
  misc_feature (247)..(247): n is a, c, g, or t
  modified_base (501)..(501): a, c, t, g, unknown or other
  misc_feature (501)..(501): n is a, c, g, or t
  modified_base (511)..(511): a, c, t, g, unknown or other
  misc_feature (511)..(511): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgctagtcgtgggctgaggtagaagagccgtggggcctcgagtgaaggtctcctgcaggcttcgnggatactaccttcaccggtctactatactccacgtgggtcgcgacgacggcccccgtggaccgaagggtcttaggaggtggagtagggacgactaccaaccccgtaccgaccgggtcggacaaccaaaacgaccgaccgaacgtaacggttaacgtttacgaacggggtaccgtaacggggtaccaaccgagtaccggaccgaacgggaacctacccgttccttacgacggtccaacgacgtcctacggtaggngttacgacgngtacgcgtagcagtcgacgacgcgtacggtcgttagtacttacgtgtagcggagaggtagaacgttacggtaggtacggtagacgtacgtacgtgtaggttaacgggtagtacggttacgg

SEQ ID NO: 239616 - DNA, 647 bp, Homo sapiens
  misc_feature: GYAE6OF02GZ49Z.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcaggacgcccactcccaggtacagttggtgcagtcgtggggctgaggtgaagagccgtggggcctcgagtgaggtcctccgtgacgaaggtcttacgtggtactaccacccttcgacccggtacttaaccgtattactacccgacgttggggtacgccgaacgaccggtcccccgtgggaacgtaagggtcgttaggaggtcgggagtcggggacgacgtaccgaaccccgtaaccgaccgggtcgaccaaacgaaaccgaacgacaacaagtaagtttcgagggcgtacggtaccacagtacgaccgaacgggactaccggtccttaccgagccacgacgtaccgtacgttgggacggttgacggtcgaggtctaggacgtagtcgacggacgaccgaccggtcgttgttagtacgtgtagcgagtaggaacggtagtacgttggaacggtacgtatacgacggtgttagggtaggttacggtagtacgg

SEQ ID NO: 239617 - DNA, 747 bp, Homo sapiens
  misc_feature: GYAE6OF02IODYF.4.18.B07.1.454.CMB.1.raw
  modified_base (75)..(75): a, c, t, g, unknown or other
  misc_feature (75)..(75): n is a, c, g, or t
tcagagcactgtagcacgaccggtgctcgatttagtcgctgcgtaagggggagcatcacccagcaaccacatctntcctctagagaatcccctgagagctccgttcctcaccatggctggacctggaggactccttcttcttggtggcagcagccctcgaggacgcccacctcccgagtacagttggtgcagtcgtggggctggaggtggaagacgccggtcgggcctcgagtggtaacggtctccgtggaccgaggtccgttcgtggactaaccaccttccgacgccttaactatacctaccgagttgggtcgaccgtaccgaccggtaccccgtaggaaccgtaggtcttacggtagggtcggtaaggtacggggtacgtaccgtaaacccgtaacccgtaaccggccggtaggaaccaaacaaaccgacggaccaagtaagttaacgttacggaggtaccgaagggttacccacgtacgtaccggaacgaaccgggtacctaaccgtccgttacgacgaccgacgaccgttacgtacgggtggaaccgtaggtacgacgtacggtaagagtaaccggtcgtcgtaccgaacggaccgtaccggtacgttaaccgttaggttacggtcggttaacgcgggtaagtacggggtaagaacggttaacggttcggtaacgggtaaccggtttacgaacggttgttaaaccgggttgggttaaacggttaggttaccggttaaaccggg

SEQ ID NO: 239618 - DNA, 836 bp, Homo sapiens
  misc_feature: GYAE6OF02FULGU.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccactcccgaggtactaggttggtgctacggtcgtggggcgtaggagggtagaaacggacgcccgtaggggcctcgtaggtagaacggtcttccgtagtacgaacggtcttacgtaggtactaccacccgttaccgaaccgggtaccttaaccgtaattactccgtaacgttggggtaccggaccgaccggtaccggcccccgaaggaacggtacggtcgttagggtacggtaggtacggtacggggaacggtacgtaccgtaaaaccccgtaaccggtaccgggtacggacaaaccgaaaaaccgtaacggaccgtaaaccggaacggttaaacggtttccggaaagggggtaccgtaacgggttacccgaaccgtaacggtacgaacccggtaacgggtaaccttacccgttaccgtttaaccgacgaaccgtaaccgaccggtaacccgtttacggtcgggtaacgggttacgaacgtaccgggtacggacgtaggaacgtacgtaccgttaccgaacccggacgtaccggtaccgttagttaacgtttacgcgttaccggaaggtacggaggtaaacgggtaaccggttaggtacgggaaacggttacggtaaccggtaacgtcgggtaacgtttaaggggtaacccgttaagggagttaaccccggg

SEQ ID NO: 239619 - DNA, 696 bp, Homo sapiens
  misc_feature: GYAE6OF02HIVLH.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttggtggcagcagcctcaggacgccactcccagtacagttgtgcagtctgggctggaggtgaagagcgtgggcctacagtagaaggtctcctgacgaagcttcaggatacacttcacggctactatactacctacgtggtcgacgacgtaccggccccgtaggaacgtaacgggtcttaggacggttgggacgtacggggaacggtactaaccgtaaaccccgtaacggtaccgggtacggaacctaaacaaaacgaaccgaaccgtaaactaagggtaaaacctttacgggacggggtaaccgtacggggtaaccaccgtaagtacggaaccggaacgggtaaccgtaccgtaccgttacgacgaacctacgaacgttaccgtaacgttagggaacgttagacgacgtagtacgtagaacgacgtacgacgaacgaccgtacggtaccgttaagttaacgttacgtacgtacgtacggaggaaggtacggaaagtcgtaggtaaccggtgaacgttacgtaggtccgttaacggttaggttaggtaacgtaacgg

SEQ ID NO: 239620 - DNA, 591 bp, Homo sapiens
  misc_feature: GYAE6OF02HSI2G.4.18.B07.1.454.CMB.1.raw
  modified_base (358)..(358): a, c, t, g, unknown or other
  misc_feature (358)..(358): n is a, c, g, or t
  modified_base (412)..(412): a, c, t, g, unknown or other
  misc_feature (412)..(412): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagctggggcctacagtgaagggtcctcctgacaaggcttctggatacaccttacaccggctactatactcactgggtgcgacacggcccctggacgaagggcttgagtggatgggacggatcaaccctaagaccggtggcacaaacaagcanagaacgtttacgaggcagggtacaccatcgaacaggacaccgtccttacagcanagacctacgtggaggtgagcagggactggaacgtatccgtaggacgtaacgacggtaccgtacgttaagttaacgtcgttcgacggtacggaaggaaggaaagtaaccggttaggtaaccggtacgggtaattaccggaacggtacgttagggttaacggttaaggtacggttaacggg

SEQ ID NO: 239621 - DNA, 678 bp, Homo sapiens
  misc_feature: GYAE6OF02JMAUA.4.18.B07.1.454.CMB.1.raw
  modified_base (180)..(180): a, c, t, g, unknown or other
  misc_feature (180)..(180): n is a, c, g, or t
  modified_base (189)..(189): a, c, t, g, unknown or other
  misc_feature (189)..(189): n is a, c, g, or t
  modified_base (630)..(630): a, c, t, g, unknown or other
  misc_feature (630)..(630): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctctttcttggtggcagcagcctcgaggacgcccactcccaggtacngttggtgcngtcgtggggctgaggtagaagaacgtcgtcgggggcctgaggtacgaacgggtcctccgtcgcgaacgggtcgttcgtcggtataccacccgtttccgacccgggtacttaacctataactcccgacgttcggggtagtccgacgacccggccccttagggaacggtaacgggtcttggaggttgggtaggtcggggaacccggtagtcccgaaacccgttaccggacggttacggaaccaacgtaaaccacggcaaccgaggttaaccttcggacggacgtacggaactaccgacgtaccggacacgggacctcgtacgtcacggtcaaagccgtagtacgggttgggacgtcgacgtcggcaggacgtagttaccgcggtacgcggaacggtcgttaagtcgttcgtacggtcggagtagagtacggaagttcgggtanacggtacgagacggtcgtagtccggttaggtaacggtgtacgtaccgg

SEQ ID NO: 239622 - DNA, 812 bp, Homo sapiens
  misc_feature: GYAE6OF02INTTN.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctgggagatcctcttcgttggtggcagcagcctcgaggacgcccactcccgaggtactaggtttggtgcaggttcgtggggctggtagggtaggaagaacgtccggtcggggcctcgtaggtaggaaggttcctccgtagacgaaggtccttcgtaggacttaccgtaccttaccgacccggtattacctatactccgtacggttcgggcacgaaccgaccggtcccccggttaagggaaccgtaagggttcgttaggacggttaggaggttacggggacggtactaacccgaacccggtaacgtccgggtacgacaaaccgaaaaccaccgacgtaactaaggtaacttcgggacggtagtacggtaccaccgttagaccggaaccggtacggtaccgtaccgttaccgtacgaacgacctacgtacgtacgttacggttacgggaggttacggacgacgtaggtacgtacggtagtacgtaccgtacggaaccggtaccggtaaccggttaaccggttactttaaacggtttacgttaccgggaacggtaccggaacggggtaaaggtaacggggtaaccggttaaggtttaccgggtaacgggtttaacgggtaaaccggttaaccggtacgggtttacgggttaacgggtttaacggggttaacgggttaagggttaaccccggg

SEQ ID NO: 239623 - DNA, 624 bp, Homo sapiens
  misc_feature: GYAE6OF02GN3VK.4.18.B07.1.454.CMB.1.raw
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
  modified_base (300)..(300): a, c, t, g, unknown or other
  misc_feature (300)..(300): n is a, c, g, or t
  modified_base (339)..(339): a, c, t, g, unknown or other
  misc_feature (339)..(339): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtncngtcgtgggtctggaggtagagaacggccgtggggcctcgagtggaacgtctcctgacaggtcttcgtggataccaccttcgaccggtactactagtactccctagtggggtcncgacgcggcccgtggacagggtctggagtgagtgggacntaccgaacctacgacggtgaccaacaacgacacgacgtaagtacgttacggaggaccgtggaccaacgagtacggaaccgaacggaccgtaaccgttccttacgagtacgaccgtacgtaccgtacgtacgggaggttcgacgtcgacgtcgtagtacgtacgtcgtacgtaccggacgacggttaccgtagttactacgtggtacgaggtagaggacggtaacgtacgtaggacgttacggactacggaggttaccgtagggtttacgtaaggtcggttaccgg

SEQ ID NO: 239624 - DNA, 811 bp, Homo sapiens
  misc_feature: GYAE6OF02GRZUV.4.18.B07.1.454.CMB.1.raw
  modified_base (246)..(246): a, c, t, g, unknown or other
  misc_feature (246)..(246): n is a, c, g, or t
  modified_base (293)..(293): a, c, t, g, unknown or other
  misc_feature (293)..(293): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccacctcccaggtacagttggtgcagtcgtgggctggaggtgaagaagccgtgggcctcagtgaaggtctctgcaggcttcgnggactacaccttcgaccggacttacgtatactaccgtacgtcgggtnacggaccgaccggtccccgtaggaccgaagggtcttggacggtaggaggttacgggaacgtacgtacctaaaccccgtaacggaccgggtacgtaccaaaccgaaaccgaacgaccgaaacgtaacggtaacggtttacgaagggtaccgaacggggttacccaaccgtacgttaaccggaaccggtaacgggtacccttacccgggtttccttacccggacgaaccttaaccggaccgttaacccgttaacggtacggggtaacggttcggaaggtacccgaggggtacgtcggtaacgtacgtaccggtaacggaccgtaaccggtaccggtaccgggttagtttaaccgttaggtaccggttacgggaccgtacgggtaaggaaaccggggttaacgtttaaaccgggttaggtaaaccgggggtttaaccggtaaaccgggtttaacgtaccgggtttaacggtttacggggttttaaaacgggtttaccggggttaaggtttaaacccggggg

SEQ ID NO: 239625 - DNA, 747 bp, Homo sapiens
  misc_feature: GYAE6OF02GYP5K.4.18.B07.1.454.CMB.1.raw
  modified_base (700)..(700): a, c, t, g, unknown or other
  misc_feature (700)..(700): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcgaggacgcccacctccccaggtactagttgggtgcaggtcgtggggctggaggtaggaagaagccgtggggcctcgaggtggaacggttctcctggactaaggcttacgtaggtactacctaccgttaccgaccgtctaactatactaccgtacgtgggtcgaccgacgaccgggtccccgtaggaaccggtaacgggtgttagggagggttcgggaggttacgggggaacggactaaccccgtaaacccgtaaaccggtaccgggacggtaccaaaccgaaaacaccgacgaacgagtaacggtttccggacggggacgtaacggggaccaccggtacgtacggaccggaacgggtacctaccgttaccgtaccgacgcaaccgacgtaccgttacggtgggtacggtacgacggacggtacgcgtaggacgtacgttacggacgtacccggaacgtcgggtaccggttaacttcggttacgtagggccggtaaggacgggtaggaacggttaacggtcgtaacggggtacggtacggttaanaccgggttagtacgggttggtttaacggggttaaggtaaggttacgg

SEQ ID NO: 239626 - DNA, 722 bp, Homo sapiens
  misc_feature: GYAE6OF02H87HX.4.18.B07.1.454.CMB.1.raw
  modified_base (714)..(714): a, c, t, g, unknown or other
  misc_feature (714)..(714): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcacgcctcgaggacgcccacctcccgaggtacctaggttggtgcagtcgtggggctaggaggtgaagacgcgtcgggcctcgagtgagtctcgtgacgaaggtccttgtacggtactacctaccgttccgaccggtactaacgtatacgtccgtacgtgggtacgaccgacgtcccggacccgtaggaaccgagggtaccttaggacggtaggtacgggtagggtacgacttaaccgtaacccgtaaccggtaccgggtagaacccaaacgtaaaccaccggacaacgtaacggttaacggttacggacgggtacgtacgggtaccaccgaggtaccggaaccggacgggtaacccgtccgttacccttacgacgtaccgtaccgaccgtaccgttacggtagggacggttccgaaggtccgtaaggtcgtagacgttagtaccggtacgaaccgtaccggtacggttccgtttaagttacgttacggacggttacggacggtacggaagggtacgtaaggtaccgttgggaccgttacgatacgagtcgttaggtaggttacgngttaacgg

SEQ ID NO: 239627 - DNA, 715 bp, Homo sapiens
  misc_feature: GYAE6OF02FG2NF.4.18.B07.1.454.CMB.1.raw
  modified_base (259)..(259): a, c, t, g, unknown or other
  misc_feature (259)..(259): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctgaggatcctctcttggtggcagcagcctcaggagcccactcccaggtacagttggtcgctagtcgtggggctgaggtagaaggaagcccgtggggccctcgaggtgaacggtcctacctggctaacggcttcgnggtactaccaccttcacccggtctaacctatactaccaacgttcgggtcgccgacgtaccggcccccgtaggaaccgaagggtctttggacggttggacgtggggaacggactaccgaacccctaacgtaccgggtcgaccgtaacgaaaccgaaccgtccgaaccgtaacggtaaacgttttccggaacggggtaccgtaacgggggttacccaaccgtaacgttaccgggaacccgtaacggggtaacctacccgggttacccttacgaaccgtaccaaccggtaccgtacccgttaacgtccgggtaaggtcgacgaccgtaaggcgtaggtacgacgttcgacggtaccgacgaccggtcgttagtacctggtcgtcggacgtaggaggaggtaacgacttacgggtagtacggatacggctaccggttaggtaggttaacggagttaccgg

SEQ ID NO: 239628 - DNA, 830 bp, Homo sapiens
  misc_feature: GYAE6OF02FOD62.4.18.B07.1.454.CMB.1.raw
  modified_base (136)..(136): a, c, t, g, unknown or other
  misc_feature (136)..(136): n is a, c, g, or t
  modified_base (188)..(188): a, c, t, g, unknown or other
  misc_feature (188)..(188): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctntcttgtggcagcagcctcaggagcccactcccaggtacagttggtgcagtcnggggctgagtgaagaagccgtggggcctcagtgaacggtcttccgtgcaagggtctttccgtggatacaacctttcaccggctacgtaactatccctaacgtcgggtgccgaccgtacggcccccgttacggaaccgtaaacgggtcgttacgtaacggttgggtaacgttcgggggaacggtaacgtaccgaaaaccccccgttaaacgaacccggggttacgggacccgaactaaaaccccgtaaaccgacccgtaaacgaacggtaaaacggtttttacgacgggggtaccgtaaacggggggttaccaaccccgtaagtaaccggaaccccggtaacggggggaaccctaaacccgggttaccccgttttaccgaaaccggtcccgtaaaaccgtaaccgttaaccccgttaaccgtttacggggtagggtttaaccggaaggtacccggtaacgggccgttaccggtaggtaaaccgttccgtaccggaaccggtaacccgaaccgggtacccggtttacggtaactttaccgtaggttaccggacggttacgaaggtacggggaaaggtaccgttagggtacggtacggtaagaccggtagtaccgttggtacgggttaacgtacgggttaacggg

SEQ ID NO: 239629 - DNA, 720 bp, Homo sapiens
  misc_feature: GYAE6OF02G6VDV.4.18.B07.1.454.CMB.1.raw
  modified_base (304)..(304): a, c, t, g, unknown or other
  misc_feature (304)..(304): n is a, c, g, or t
  modified_base (579)..(579): a, c, t, g, unknown or other
  misc_feature (579)..(579): n is a, c, g, or t
tcagagcactgtagcacgaccggtgctcgatttagtcgctgcgtaagggggagcatcacccagcaaccacatctgtcctctacgagaatcccctgagagctccgttcctcaccatggactggacctggaggatcctcttcgttggtggcagcaagccgtcgaggagcccactcccaggtacagttggtgcagtccgtggggctggtaggtgaagaacgccgttggggcctacgaggtaggaaggtcctcctggacgtaaggtcttcgtggactaccgaccttcgaccggtcctaacgtattacnccgtacgtgggtcgcgaacgcggccccgttaggacgtacgggtccttaggaccgtgggtacgtagggaccggtaccgtacctaaacccgtaaccgtaccgggtacaaccgaacctaaaacgaccgtacgaaccgtaacgtaaacggtttacccggagggtacccggtaacgggttaccaccgtaacggttcggaaacccggtacggggaccttaaccggtttccccgaacgtaccgcgaaccgtacggaccgttaccgtagggtcgtaggaccgngtacgccgtagacggtcacggtcgaaccgtcgacggttccgttagttactacgtggtacgcgttaaggccgaaggtacgtcggtaaggtcgggtacaacgttacgcggttaggttacgtaggtttaccggagttaaccggg

SEQ ID NO: 239630 - DNA, 756 bp, Homo sapiens
  misc_feature: GYAE6OF02FFJAH.4.18.B07.1.454.CMB.1.raw
tcagagcactgtagcacgaccggtgctcgatttagtcgctgcgtaagggggagcatcacccagcaaccacatctgtcctctagagaatcccctgagagctccgttctcaccagtggactggacctggacgatcctacttcgttggtcgcagacacgcctcgaggacacccactcccgaaggtaccaggttcggtgcctacggtcgtcggggtcgttaggaggtaggaacgaacgtcccggtacgggccctaggaacggtacggaacggtccgttactacggtacgtaacggttcttacgaggtaacctaccgtaccgttcgaccggttactaacgttactaccgtaccgtacggtcggtacgaccgtaccggtacccggtaccgtaggtaacggtacggttcgtaggacggtacggtacggtacgggaaccgtaccgtaacccgtaacccggtaaccggtaccggtacgaaccgaaacgaaccgaacgacgtaaacggtacggttacgtacggacggtacgtacggtaccacgtacgacggaccgaacgtaccgtaccgttacgtaccgactaccgacgtaccgttaccgtacggttacgggacgttacgacggtacgtacggacgtagtacgtcgtacggacggaccgtaacggtaccgtacgttaacgtacgttcggagacgaacgtagacggtagtacgtacgacggtacgtacgtacgtacgcgtacggttaggtaggttacggtagtaccg

SEQ ID NO: 239631 - DNA, 653 bp, Homo sapiens
  misc_feature: GYAE6OF02JQRWR.4.18.B07.1.454.CMB.1.raw
  modified_base (364)..(364): a, c, t, g, unknown or other
  misc_feature (364)..(364): n is a, c, g, or t
  modified_base (539)..(539): a, c, t, g, unknown or other
  misc_feature (539)..(539): n is a, c, g, or t
  modified_base (545)..(545): a, c, t, g, unknown or other
  misc_feature (545)..(545): n is a, c, g, or t
  modified_base (588)..(588): a, c, t, g, unknown or other
  misc_feature (588)..(588): n is a, c, g, or t
tcagagcactgtagcacgaccggtgctcgatttagtcgctgcgtaaggggaggcatcacccagcaaccacatctgtcctctagagaatcccctgagagcgtccgttcctccaccagtggactggacctggaggatcctcttacttggtggcgacgcacgcctcacggacgcccacctcccgaggtacacggttggtcgcagtccgtggggctggaggtagaagacgtccgtgggcctcgaggtggaacgttcctctggacgtacggtcttcgagactaccgtccttaccggccgtacttacgtactacgtcctacggtgggtgaccgaccgtccggaccgtaggaccgtaggtctagtggaggngtcgggactacgacctaaacccgacgacggtggaacacgaaaccacgacagtacggtacgtacgcgggtactaacggtccaagtacgacgaacgacgggaacttttacggaccgttacgacgacctaacgaacctcgtacggttacggaggttaccggagttccggagttcgtanacggtntaacggtcgaccgacgaccgtcggttatcgtacgtgagcgganacgggagtaccggtagttcgggacgttacgacgtcgtaggccgttaggtacgtacggagtaccgg

SEQ ID NO: 239632 - DNA, 681 bp, Homo sapiens
  misc_feature: GYAE6OF02G8LVU.4.18.B07.1.454.CMB.1.raw
  modified_base (295)..(295): a, c, t, g, unknown or other
  misc_feature (295)..(295): n is a, c, g, or t
  modified_base (534)..(534): a, c, t, g, unknown or other
  misc_feature (534)..(534): n is a, c, g, or t
  modified_base (643)..(643): a, c, t, g, unknown or other
  misc_feature (643)..(643): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccacctcccaggtacagttggtgcagtcgtgggctgaggtgaagaagccgtggggcctcgagtgaacggtctccgtgcgaaggtcttcgtggataccaccttcgaccggcttaacatactcccagtgggtcnccgacgccggcccgtggaacgagggtctaggaggtgggtagtagggacgtatacccgaaacccgtaaccgtaccgggacaaccaaccgaaaacgacgaccaacgaagtaacgttacggagggaccgtacgggtaccacgtagtaccgaccggacggacctaccgttcctacgaacgtccgaacgaccggttaccgtacggttagggaggttacggagtaccggagcgttaagaacggtntaccggtaaccggacgtaacccggaccgggttccgttaagttacgttacggttacgtcgggacggtaagacggaagggtaacttacgggtaaggtacgtaccggttaanacgtaggtcgttaagggttaggttaacggtaggtaccg

SEQ ID NO: 239633 - DNA, 705 bp, Homo sapiens
  misc_feature: GYAE6OF02HS78C.4.18.B07.1.454.CMB.1.raw
  modified_base (161)..(161): a, c, t, g, unknown or other
  misc_feature (161)..(161): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
tcagagcactgtagcacgaccggtgctcgatttagtcgctgcgtaagggggagcatcacccagcaaccacatctgtcctctagagaactcccctgagagctccgttcctcaccatggactggacctggaggtatcctctttcgttggtggacagcagcctnaggacgcccactcccagtacagttggtgcagtcgtgggctgaggtagaagaacgccgtaggggcctagacgtagaagtctccgtgactaggcttgnggactaccncttcaccggnttacatactcaagtcgggtacnccgaactaccggaccccgtaggaacgtaacgggtccttaggacggtaggaacgtcggggaacgtacgttaccgaaaaccccgttaaggacccggttaggaaccctaaaccgtaaaaacgcggaacctaacggtaagttaacggtttacgaacggggtacgtaacggggtacctaccggaacgttcggaaaccgtagaccgtaccgttcgttacacggtacacgtaacggtccttaggtacggagtacgaacgcgtaggtcgaggaactcgtacgacgaaccggacgtacgggtaccgttagtaaccgtacgtggacgtacggacgtaggaacgggtacgtacggttaggtaccgtacggtaacgtacgtaggtaccggttacgggtagttaaccgggagttacccgg

SEQ ID NO: 239634 - DNA, 756 bp, Homo sapiens
  misc_feature: GYAE6OF02HFZHE.4.18.B07.1.454.CMB.1.raw
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatccctcttcttggtggcagcagcctcaggagcccacctcccgaggtacagttggtgcagtcgtggggctggaggtagaagagccgtgggcctcagtgaaggtctcgtgcgagcttgngatacnccttcaccgtctactatctcctagtgggtcgacggtacaccgggtccccctagggaaccgaagggtcttaggacggtggacggttaggggaccgtactacccgaaaccccgtaaccggaccgggtacgaaccaaccgaaacgaaccgaccaacgtaacggttaaacggtttcggaacggggtaccgtaacggggttacccaaaccggtaacgtaccgggaacccggaaacggggtaacccctaacccgggtttaccctaccgaacggtacccgaaaccgtaccggttacccgttaaggttacgggggaacggttcggaacgtaccgggaaggtcgtaggaacgtcgttacggtaccgaaccgggtaccgtaaccgggtccgtttaacgttacggttaccgtgggacgtacgggaacggtagggaacggtaaacgttccggtaggacggttacggtaagtacggtaggtccggttaagggttacgggtacggtagttaaccgg

SEQ ID NO: 239635 - DNA, 737 bp, Homo sapiens
  misc_feature: GYAE6OF02HAMZ6.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctgggctgaggtgaagaagccgtgggcctcgagtgaaggtctccgtgacgaaggtcttcgtaggatacaccttcaccggtctaactatactcccacgtgggtacgacgaaccacgggccccctaggaaccgtaaacggggcctttaggaacggttgggaacgttagggggaaccgggtaatacccgaaacccccgttaaacgacccgggttagggaccaaaccgaaaacgaaccggacaaacgtaaggtaaacgtttcgaaggggtaccgtaaggggttaccaaccgtaacgttacggaacccgaaggggtacccaaccgtttaccccgttaacacggaaccgaactaacgtacccgttaaccgtttgggaacgttggtacgacgtaggactaggacgtactccgtaacgaacgaccggtaacggtaccggttagtaaccgtttaaccggtgttacgacgaggaacggtaagggtaacgtacgttaaggacggttaacggtaacgtacgtacggtacgtttagggtaacggttaaggtacggttaacgg

SEQ ID NO: 239636 - DNA, 703 bp, Homo sapiens
  misc_feature: GYAE6OF02J1N6Q.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctgggctgaggtgaagagccgtgggcctcgagtgaaggtctcctgcaaggcttcgtggactacgaccttcgaccggctaactactacttcccgtacgtcgggtcggtcgaaccgtacgggcccctagggaccgaaggggtcttaggaggtaggagtaggggaacggaactaccgtaaaccctaaccgaccgggtcggaccaacgaaaacacgacacgaggtaacgtttcgagggacacgggtacaaccgtagtacgaaccggacgggaacctacggtaccttcgaacgtaccaccgtacgtaccgtacgttagggacgggtacggtacacggtacggaccgtaggacgtacgtacgtacggaccgtaacgccgggtacgttagttacttaacggtcttacgggacggtagacggtaagggaaccggtacggtttacgggtaacgggtacggtaacgttacggtacggttaacggttacggggtttaacgggttaacgggttaacgggttaaccgg

SEQ ID NO: 239637 - DNA, 743 bp, Homo sapiens
  misc_feature: GYAE6OF02H57XP.4.18.B07.1.454.CMB.1.raw
  modified_base (191)..(191): a, c, t, g, unknown or other
  misc_feature (191)..(191): n is a, c, g, or t
tcagagcactgtagcacgaccggtgctcgatttagtcgctgcgtaagggggagcatcacccagcaaccacatctgtcctctagagaactcccctgagagcctccgttcctcaccatggactggacctggaggactccttcttcgttggtggcagcacgcctcaggcgcccacctcccaggtactagttggngcgagtcggtggggctaggaggtagaaggaacgccggtcgggcctacgaggtcggtaacggtcctccgtagacgtaaggtccttcgtacggtacttaccgtaccgttaccgaccgtacttaacgtactactaccgtacggtacgggtcgaccgacgaccggtcccgtaggaccggtaggtcgttaggacggtaggacggtagggacggtaactaccgtaaacccgtacggaccggtagaaccaaccaacgaaccgactaacgaggttaacggtacgcgggtactaacgggtaccaccgagtaccgaacggtacggacccgtacgttacccgtacgaacgaccgacgtaccggtacccgttaaggtacgggtaacggtacgtcgaacggtacggtccgagaaccgtcgttaccggaacgtacccgaggtacggtacccgttagttacgttacgtcggagtaccgggaggacggtaacggtagttaacggtagtaacgggtaacgtacgacggtacgtacggtttaagggaacggtttacggacggtttaaccg

SEQ ID NO: 239638 - DNA, 765 bp, Homo sapiens
  misc_feature: GYAE6OF02JIKR1.4.18.B07.1.454.CMB.1.raw
  modified_base (92)..(92): a, c, t, g, unknown or other
  misc_feature (92)..(92): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
  modified_base (720)..(722): a, c, t, g, unknown or other
  misc_feature (720)..(722): n is a, c, g, or t
tcagagcactgtagcacgaccggtgctcgatttagtcgctgcgtaaggggagcatcacccagcaaccacatctgtcctctagagaatccctnagagctccgttcctccaccatggacgtacggtaccgtcggaggacgtcctcttcgttcggtggtcgacgcgacgccgtacgacggacgaccaccgtaccgtacggtacgtagttaggtgcntangtcggtcgggtacgtangggtaacggtgaaacggaaacggtaccggttacgggggtacccgtaccgtaacggttcagggtaaacggggttaccgttacccggttacggtaccggtaaacgggtaccgtttaccggttacgggtaacgtaaccgtaaccccgtttaccgtaacccgggtaccgttaaccgttaacgttaacgttacccgtaaccgttacgggggttacggtaccggtaaccggtaaccgggtacccccgttacgggtaaaccggtaaacggggtaccgtttacggtaacggttacgggtaacgtacggggtaaccgggtaacgtacccgtaaacccgtaaaccgtaacccggggtacgggtaccgtaaccgtaaaaccgaaaccgtaaccgaacgtaacgtaacggttacgtaacgggacggtaacggtaccgtaaccgtaacgtacgaaccgtaacggaaccgtaacgtaccgtacgtacgacgacgacgtacnnngtacgttacggtaggtacgacggacgacggacgtacgagtacg

SEQ ID NO: 239639 - DNA, 751 bp, Homo sapiens
  misc_feature: GYAE6OF02HQ2ZT.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtactagttggtgcagtcgtgggctgaggtgaagaacgccgtggggcctcgagtgaacggtctcctgacgaaggtcttacgtggaacttacctaccgttacgaccggtccttaactactagtccctacggttggggtcgaccgaaccgtaccggcccccgtagggaaaccgtacggggtaccgtttaggagggttacgggacggttacgggggaccggtaacgtacccgtaaaccccgttaaaccgggaccggtcggaaccaaccgaaaccgaacaccgaactaaaggtaacgtttacggaacgggtcgtaacggggtccaaccgagtacggaaccggagggaccctacggtaccttacgacgactacgacgtcccttaagtcgggacggttacgacgcggttaggccgttagacgtacttacggtagaaccgacggtaccggtacgtttacgtacttacgtacggtacgacggaggtacgggtaacggtaacgggttacgttacgggaacggttaccggaagttacccggaaggttaccggttaagggtttaacgggttaagggtacgttaaccgggg

SEQ ID NO: 239640 - DNA, 782 bp, Homo sapiens
  misc_feature: GYAE6OF02FNYHV.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctgggagatcctcttcttggtggcagcagcctcgaggacgccccactccccaggttacagttggtgcgagtcgtggggctggaaggtcgaaaggaagccgtggggacctcgaaggtggtaacggttcctccgtcggactaaccgtcttcgtgactacaccttcgacccggataactaatactaccgacttaggggtcgcgaaccgacggtccccgtacggacgtaacgggtcttaggagtaggatagggaacgacgtaccaaccctaacgaccggtacgacaacaaacgacgaccaagacgtaagttacggaacgggcgaacggtacgaaccgtacgtaccggaacgaaccgggtaacgaccgtcccgttacgaaccgaccgaaaccgaaccgttaccgttaccggtacgggtacggttaaccgagtaccggtacggtacgtacgagtagttaccggagtaacccggacgaacccggggtaccgttaagttaacgttacgttacgggtacggtacggtaaccggaagggtaagggtaaaccggttaccggttaaacgggtaacccggggttaaccgggaaacgttaaccgggtacggtttaacccggttaaagggggttttacggggtttaaaaccgggtaaggggttaaacccggggg

SEQ ID NO: 239641 - DNA, 683 bp, Homo sapiens
  misc_feature: GYAE6OF02FILY7.4.18.B07.1.454.CMB.1.raw
  modified_base (249)..(249): a, c, t, g, unknown or other
  misc_feature (249)..(249): n is a, c, g, or t
tcagagcactgtagcacgaccggtgctcgatttagtcgctgcgtaagggggagcatcacccagcaaccacatctgtcctctagagaatccccctgagagctccgttcctcaccatggactggacctggagatcctcttcttggtgcagcagctcaggacgcccactcccaggtactaggttggtcgcagtcgtggggctggaggtgaagaacgccgtggggcctcgagtgagtctctgcaggtcttcgnggatacacccttgaccggctaacgttatactccagttgggtcgaccgtaccgacgggtccccttagggaaccgaagggtcctaggaggttcgggagtcgggaccgtagtaccgaacccgtacgaccggtagaccaaactaacgacgcaacgaagtacgttcgaggctacggtccacgatcggacgagggacctacgtctacacgcacgacgtcctaggtacggtagtggacgtacgacggtcgtagtacgtacgtcggaagtaccgacgacgggttaccgttaggttaacttacccggtgggtaccgtaacggtacggaaagggtaaccggtaaacgggttacggttaccgggaacggtttacggtaacccggtacggtacggttacgggtttaacgggttaagggttttaacgggtaacggtttaaccccggg

SEQ ID NO: 239642 - DNA, 784 bp, Homo sapiens
  misc_feature: GYAE6OF02GLQHA.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggacgcccactcccaggtacagttggtgcagtctggggctggaggtgaagaagccgtgggcctcgagtgaaggtctctgcgaaggcttcgtggactacgtacccttcgaccggtctaacgtactactacccacgttggggtcgtaccgaccgtaccgggcccccgtagggaaccgtaacggggtcctttaggaagggttgggtaaggttcggggaaccggtaacgttacccgtaaaaccccgttaaccgtacccggggtacggacctaaacgaaaaccgaaaccggaccaaacgtaacggtaaaacgttttccggaaacggggtaccgtaacggggtacctaaacccgacggtaacgaaccggaacggggtaaccctaaccggttccccgtttacgacgacccaacgtaacggtcccgtttaacggttcgggaacgggttgacggacgacgggtcgtacggtagacttcgtaacggaccgtaccggacccgggtacgttacgttaacgtttacgtacggtacggacgaagggtaaggaacgggtaaacgtacggttaggaaccggttacggtaagttaacggtaggtaccgtttagggtaagggtttaacggtacggtttaaccggg

SEQ ID NO: 239643 - DNA, 616 bp, Homo sapiens
  misc_feature: GYAE6OF02HKRAC.4.18.B07.1.454.CMB.1.raw
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtcgtggggctgaggtgaagaagccgtgggcctcgagtgaaggtctctgcagcttcngatacacttcnccggctactatactcacgtgggtcgcgacgacggccccgtaggacgaacgggcgttggaggtggagtcggggaacggtactaccgaaccccgtaacgaccggtgaccaacaaaccaacgacacgagtaacgtttacgagggacgaggggtccaaccgtagtaccggaaccgacgggacctacggtcccttacgacgtacgacgtacgtaccgtacgttgggacggttgacgacgaggtctaggacgacgttcgacgaccgacgaccggtccgttagttaacgttacgtgtcgacgagaggtaggtaagtacgttggtacgtacggatacgacgtaggttacggtaggttaggaggttaacgg

SEQ ID NO: 239644 - DNA, 667 bp, Homo sapiens
  misc_feature: GYAE6OF02FLYL8.4.18.B07.1.454.CMB.1.raw
  modified_base (657)..(657): a, c, t, g, unknown or other
  misc_feature (657)..(657): n is a, c, g, or t
tcagagcactgtagcacgaccggtgctcgatttagtcgctgcgtaagggggagcatcacccagcaaccacatctgtcctctagagaatccccctgagagctccgttcctcaccatggactggacctggaggatcctcttcttggtggcagcagcctcaggagcccacctcccaggtacaggttggtgctagtcgtggggctggaggtagaagagcgtggggcctacgacgtggaacggtctccgtagacgtaggtcttcgtaggtactacgtacccttcacccggtactactatactacctacgtggtacgacgtacgacggccccgtaggaccgtacggtcgttggaggtggtacgtgggacgacgtacctaacccgtaacgtaccggtcgactaacaaacgacgacaacgtagtaagttacgagggtacgtaggtaccgaactagtacgtaaccggaggtaaccgtaccgttccttacgacgtacgacgtaccgtacgtacgtacgggaggttcgacgtcgacgcgtaggacgagtacgtagaccggaccgacggtacgttagttacgttactggtacgacgtacggaaggtacggtaacggtacgtggtaacggtacgtaacggtacgtagtaccgttagggttaggttaaggngttaacccgg

SEQ ID NO: 239645 - DNA, 717 bp, Homo sapiens
  misc_feature: GYAE6OF02I45CK.4.18.B07.1.454.CMB.1.raw
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (330)..(330): a, c, t, g, unknown or other
  misc_feature (330)..(330): n is a, c, g, or t
  modified_base (379)..(379): a, c, t, g, unknown or other
  misc_feature (379)..(379): n is a, c, g, or t
  modified_base (632)..(632): a, c, t, g, unknown or other
  misc_feature (632)..(632): n is a, c, g, or t
tcagagcactgtagcacgaccggtgctcgatttagtcgctgcgtaagggggagcatcacccagcaaccacatctgtcctctagagaactcccctgagagctccgttcctacaccatcggactgggacctagggagatcctcgttcttggtcggctagcacgcctcgaggacgcccactccgaggtacgagttgngctagtcgtggggctaggagggtgaaggacncggtacgggctacgtaggacgaacggtcctccgtaggacgaacgtccgttgtacgtaactaccaccgttccgaccggataactaactcgtaactccgtgggtacncgtacgacccggaccgtgaaaccgtaggtaccgttggaaacggtcgggngttaacggggacgttacgtaaaccccgtaaaccccggttaacaccgggggtacaccaaaaccgggtaaactaacccgggaaagtaacggtaaacgtacggttaaggaacgggccgtaacggggaaaccctaacgacgtaccggaaccgaacggtaccgtaccgtaccgtacgaacgtaccgtaacgacgttactacggttaggaacggagtacggacaggtaccgagtccaagctacggacgtacgacgtcgngttacgtattcggagtacgagtagggtaagaacggttactacggacgttacgacgtagtcgagtacgggtattaaggccgtaagg

SEQ ID NO: 239646 - DNA, 805 bp, Homo sapiens
  misc_feature: GYAE6OF02HNSVK.4.18.B07.1.454.CMB.1.raw
tcagagcactgtagcacgaccggtgctcgatttagtcgctgcgtaagggggagcatcaccagcaaccacatctgtcctctagagaatcccctgagagctccgttcctcaccatggactggacctggaggatcctcttcgttggtggcagcacgcctcgaggacgcccactccccgaggttaccagtttggtcgcgagtcgtgggggccttaggagggtaggaaacaacggtccggtcggggtcccctaggtaggttacggtaaacggtcctacgtcgaccgaagggtcctttaacgtggtaactaaccgtaccgttacgaaccggtactaactactactaccacggttggtacgacgacgaacggccccgtaggtaacgtagggtaccttagtaggtacggagttacggggaacgtaactaaccgaaaccccgtaagtacccgggtaggaccgtaaacaaaaccggaaccgtacctaacgaaacggttaacggttaccggaacgggacggtaacgggtactaccggaagttaaccggaaccggtaacgggacccgtaaccgttaccgtttaacaccgtaaccgtacgtaaacgtaccgttaaccggtcgggtaaaggttacgacggtacgtaacggcggtaagtacgaacctggtaacgtaccggaaaccgtccggtacgttaacgttacgttacgtaggtcgtagacggtacggaaacggtagtaacggttaacggtaacgggtacgttaaccggtacggttacgacgggtttagtaacggggtttaaactaggttaaccccgg

SEQ ID NO: 239647 - DNA, 769 bp, Homo sapiens
  misc_feature: GYAE6OF02IYSXQ.4.18.B07.1.454.CMB.1.raw
tcagagcactgtagcacgaccggtgctcgatttagtcgctgcgtaagggggagcatcacccagcaacccacatctgtcctctagagaatcccctgagagctccgttcctcaccatggactggactggaggatcctcttcttggtggcagcagcctcaggacgcccactcccaggtaccagttggtgcagtctggggctgaggtgaagacgccgtgggcctacgagtagaaggtcctccgtgacgaaggtccttcgtaggactacctaccttaccgaccgtcgttacttataactcccacgtgggtcgccgaacgtacggacccccgtggaaccggaagggtccttaggtacggtaggtaaggtacggggtaaccgggtaactaaccgtaaaccccgtaaaaccgtaaccgggtcggaccaaaccgaaaacctaaccggaactaacgaaggtaaggttaccggaacgggcgtacggggtacaaccgtacgtagaacccgaagggaccgtaccgtaccgtaccgtaaggaccctaacgacgtaccgttacggtacgggaacggttaggtacgacgtacggtacgttagacgttaacgcgtacggtaacccgaaccgtaccgggtaccgtacgttttaaacgaccgtttaggacggtaaccggaggtaagggtaaacggtaaacggttaccggttaggtaacggtaaccggttaacggttaacgtaggggttacccttaaggggttaacgggttaacggtaggtttaaccgg

SEQ ID NO: 239648 - DNA, 752 bp, Homo sapiens
  misc_feature: GYAE6OF02IMH7E.4.18.B07.1.454.CMB.1.raw
tcagagcactgtagcacgaccggtgctcgatttagtcgctgcgtaagggggagcatcacccagcaaccacatctgccctctagagaatcccctgagagctccgttcctcaccatggactggacctggagatcctcttcttggtggcagcagcctcgaggagccccactcccgaggtacaggttggtgcgagtctggggctggaggtagaagacgccgtggggcctacgagtaggaacggttcctccgtagacaacgggtcttacgtaggtacttacctacccgtttcgacccggtacttaactaatactaccgacgtgggtacgaccggtaccgaccgggccccgttagggaaccgtaacgggtcttaggaggttggagtgggacgaactaccgaaaccgtaccgaccggtcgaacctaaaccgaaaacgacgaccgaactaacggtaacgtttaccggaacgggtacgacgggtacctaacgacgtacggaaccgaagggtaccctaccgttccgtacgacgaccgtaccgtacggaccgtttaacggtgggaaggttcggactacggaggtcgtaggaagttcgtacgtaccggtaccgtaaccggaccggttacgttacgttaacgttacgttagggtccgtaagggtaggaacggtaaggtacgttaaccggttcggtaaacggtaccggttaaacgtcggtaacggttccggttaaggggttaaggtttaacgggtacggttaccgg

SEQ ID NO: 239649 - DNA, 646 bp, Homo sapiens
  misc_feature: GYAE6OF02F2PSA.4.18.B07.1.454.CMB.1.raw
  modified_base (252)..(252): a, c, t, g, unknown or other
  misc_feature (252)..(252): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtcgcagtctggggctggaggtgaagagccgtaggggcctcgacgtgaacggtctccgtgcaaggcttcgnggactacgccttcgaccggtctactatactccacgtggtcgcgacacggcccctaggccgaaggccgttgagtggagtcgggacgactaccgaacccgtaacgaccggtggaccaacgtaaacgaacgccaacgacgtaacgttcgaagggtcgaacgggtacaccaagtcgtaaccgacgggaactacccggtaccgttacgaggtacccaacgtaccggtaccttaacggtcgggtaacgggtagacgggtcacgggtctacggatacgttcgagacggaacaccggtacgttcttaagtcctggtacgacgtcggaagaaccgggaagttaacgtggtaacgtcgggtaaatcgtacgtaccggtagttagggttaacgtacggttaacgg

SEQ ID NO: 239650 - DNA, 901 bp, Homo sapiens
  misc_feature: GYAE6OF02JQGRF.4.18.B07.1.454.CMB.1.raw
  modified_base (739)..(739): a, c, t, g, unknown or other
  misc_feature (739)..(739): n is a, c, g, or t
  modified_base (846)..(846): a, c, t, g, unknown or other
  misc_feature (846)..(846): n is a, c, g, or t
tcagagcactgtagcacgaccggtgctcgatttagtcgctgcgtaaggggagcatcacccagcaaccacatctgtcctctagagaatcccctgagagctccgttcctcaccatggactggacctggaggatcctcttcgttggtcggcagcacgcctcgacggacgcccactcccgaaggtacctaggttacggtcgctaggtccgttggggtccgtaggtacgggtacgtaaacggaaccggtccggtcggggggtcccttacgtacggttacggtaaacgggttccttccgttagaccggtaaacgggtcctttacggtacggtaacttaacccgttaccttaccggtacccggttaccgttaaccttaacgttactacccgtacggttacgggtacggtaccgtacccgacgggtaccccgtgggtaaaccggacggggttacgttacggtacgggtacggtaacgttacggggaaccggtacgttaaccccgaaacccggtaaccggtaacccgggttacggaacccgaaacccgtaaaaccgaacccgggacttaaaccggtaagttaaaacccggttttacgggaaccggtacggtaacgggacccgttaacccgtaacggttaccgggaaccggtaacgggtaccggtacccggttacttaccgaagacccgttaacgacgttaccgtacgttagggacggttagacccgtagaaccggttcgactacggtntaccggtacgtaccgacgggtccggttaccgttaagttcccgttaaacgttcgggaacgttaacgggacggtaaccggtaggtaacggttacggtggttaacccggnggtaacgtaacccgtggttaccgtagggtttaacggttaaggtaccgttaacggg

SEQ ID NO: 239651 - DNA, 799 bp, Homo sapiens
  misc_feature: GYAE6OF02GZQ85.4.18.B07.1.454.CMB.1.raw
  modified_base (210)..(210): a, c, t, g, unknown or other
  misc_feature (210)..(210): n is a, c, g, or t
  modified_base (253)..(253): a, c, t, g, unknown or other
  misc_feature (253)..(253): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggagatcctcttctggtgcagcagcctcaggacgcccactcccgaggtacaggttggtgcagtctgggctgaggtgaagacgcgngggcctcagtgagtctccgtgcgaacggtcttcgtgactaccnccgttcgaccggtcttaactatactccacgtacgggtcgaccgacgaccgtcccggtaggaacgtaacgggcgttaggacggtaggacggtacggggtaaccggtactaaccccggaaaccccgtaaccggtacccgggtacgaacccgtaaaccgaaaacccgacgaaccgtacgtaaacggtaaccggtttacggaacgggacgacgggtacccaacggtacgtacggaaccgacgggtaacctacccgttaccgttaccgaagtaccgtaaccgtacgtaccggttaaccgtaggggtagggtaccggtaaacggccgggtaacggtcgtaagggtaaccgtcgttaacggaccgggtaacccgtaaccggtccgggttaacccgttaagtttaccgtttacggtacgggtacgtacgggaacgtcgggtaaaacgggtcggttaacccgttacgggaaccggtttaaggaacccggtttacgggttaacggtaccgggttttacggggttaaacggttaaggttacccggggttaaacccgg

SEQ ID NO: 239652 - DNA, 787 bp, Homo sapiens
  misc_feature: GYAE6OF02HSHYR.4.18.B07.1.454.CMB.1.raw
  modified_base (338)..(338): a, c, t, g, unknown or other
  misc_feature (338)..(338): n is a, c, g, or t
tcagagcactgtagcacgaccggtgctcgatttagtcgctgcgtaagggggagcatcacccagcaaccacatctgtcctctagagaatcccctgagagcttcccgttcctcaccatggactggacctggaggatcctcttcttggttggccagcagccctcgaaggacgtccccacctcccgaggtacagtttggtagcaggtcgtgggctgaggtagaagagcgtgggcctgagtgaagtcctccgtgcgacggtcttcgtgatacctaccttccgaccggtcttacgtatactccgacgtcgggtgacgacgaccgcccccgtggaacgacgggtntggtacggttaggacggtacgggacggactaccgtaaacccccgtacgtacccgggtagaccctaaacgaaaccgtaacgaccgacgaaacgttaaggttaccgacgggacgtaacggtacaccggacgtaaccggaacggacggaacgtacccgttaccttcgaaccgaccgacgtacccgtaccgtttacggtaggtacgggtacgtaacgccgtaagggactacgggaacttccgttacggtaacgaacccggtaccgtacccggttccggtttaacgttaccttaacgggttcgtaggggtaaccgttaaggggtaacccggtaagggggttaaaccttaacgggttttaacgggaaccgggttaacccggttaaacgtcccggtttaaggggtacccgtttaagggggttttaaacgggttaccggtttaaagggttaacccgg

SEQ ID NO: 239653 - DNA, 874 bp, Homo sapiens
  misc_feature: GYAE6OF02H3W0E.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggacagcacgcctcgaggagcccacctcccgaggtactaggttggtcgcacgttcgtaggggcttggaggtacggaagaacgccgtggggcctcgagtcggaaggtcctcctgaccgtaggtccttcgtagtactacctaccgttcaccggtctacctatactccgtacgtgggctccggacgtacccggtccccgtacgggacgtaacgggtcgttacggtagggtacgggtaacggtggggtaacccggtaacgttaaccccgtaaaccccggtttaaccgggaacccggggtttacgggaacccaaacccggtaaaaaccggacccgtacccggtaaacgtaacgggttaacgggttttaccggacgggggacccgttaaccgggggtacctaaacccgtacgtttaccgggaacggtacccggggtaacctaccggtttaccccttaccgaaacggtacccgtaaccgtaccggtaacccgttaccgggttacgggtaacgggttaccgggacgtaccgggtacggtaacgtgggtaacgtaccgtcggtaaccggtaccggtacccgttaaccgggtaccggttacgtttacgttacggtaggtaccggttacggaaggttacgggtacggttaaccggttacggttacgggttaacgggtacggtaacgttacgacgggttaccgttaaggggtttaacgtttacggtaacgggtttaaccggg

SEQ ID NO: 239654 - DNA, 667 bp, Homo sapiens
  misc_feature: GYAE6OF02JZWJU.4.18.B07.1.454.CMB.1.raw
  modified_base (644)..(644): a, c, t, g, unknown or other
  misc_feature (644)..(644): n is a, c, g, or t
tcagagcactgtagcacgaccggtgctcgatttagtcgctgcgtaagggggagcatcacccagcaaccacatctgtcctctagagaatcccctgagagctccgttcctcaccatggactcggacctggaggatcctcttcttggtggcagcacgcctccgaggagcccaacctcccgaggtacctagttggtgcgagtccgtggggactggaggtgaagacgccgtggggcctcgagtggaacggttctccgtgacgtaggtccttgtgactacacccttcgaccggtcttaacatactaccgtgtcgggacgtccgacgaccggcccgtacggacgtaggtcgtggtagtggacgtgggacgatacccaactacggaccggtagaccgtaacaaaccgacgactacgtaagacgttacggaagggtcgaacggtaccgaaacgccgtaacggaccggtacggacccgtaacgttccctaccgacgtacaccgtaacgtcctaggttacgggaggtagtacggcacgggtacgtaacgtcggtaaccttggaacccggttagaaccgtccggggttactaggttaccgtacgtggtacggcgtagtacggaggtaggtaccgtgtacgacggtatacgacggtnttacgggaagttaggacgtacgg

SEQ ID NO: 239655 - DNA, 728 bp, Homo sapiens
  misc_feature: GYAE6OF02FRJBJ.4.18.B07.1.454.CMB.1.raw
  modified_base (641)..(641): a, c, t, g, unknown or other
  misc_feature (641)..(641): n is a, c, g, or t
tcagagcactgtagcacgaccggtgctcgatttagtcgctgcgtaagggggagcatcacccagcaaccacagtctgtcctctagagaatcccctgagagctccgttcctcaccatgactggacctggagatcctctcttggtgcagcagcctcaggacgcccactcccaggtacagttcggtgcagtccgtggggactgaggtgaagaacgccgtgggcctcgagttgaacgtctcctgctaacggcttcgtaggactaccaccgtttaccgaccggtctaacgtacttactacccgacgtttgggcgactacgaccggtccccctaggaaccgaagggtcctttagggaggtttcggaaagttcggggaacgtactacccgtaaaccccgttaacggaccgggtacgacctaaaccgaaacgacgacctaacggagtaacgttcgacgggtacgacggttaccaaccgacgttaacgaacccgtacggtaaccacccggttcccttacgaacgttccaacgtccggtaccttacggttacgggacggttaacgacgtacgtacggtgtacgtacgtacgtcgtacggaaccggtaccgcggtaccggttattacgttaaccgtggtccgacggttaacgngtaacggtaacggttaacttcgggtaaggtaccggtaacgtaccgaggttaccgtacgggttagttaaagggtcgtttaaacccggg

SEQ ID NO: 239656 - DNA, 730 bp, Homo sapiens
  misc_feature: GYAE6OF02G6THN.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagtctcagggagcccactcccgaggtacaggttggtgcagtcgtggggctggaggtgaagacgccgtgggcctcgagtgaacggtctccgtgcgaaggcttgtggataccaccttcaccggctactatactaccacgtgggtgcgacgacgggtccccgtaggaacgaagggcttaggaggtgggagtacgggacggacgtacccgaaacccgtaaccgacggtacggacccaaaccgtaaaaccgaaccgaccaacgtaacgtaaacggttttacggacggggtacgaacggggtacccaacgacgtacggaaccggaacgggacccgtaaccgttccttacgacggccaacacggtccgttaacggttggacgggttacgacgggacgacgggtacgtcggtaacggaacttcggtaacggaccgtaaccggtacccgggtaccggttacgttaacgtttacggtggttacgggacggtaacgggaaggtacggtaaacggttaacgttacggtaacggtacggtaacgtaacgtacggtacgttacggggttaggttaacgggtaaggttaaccggg

SEQ ID NO: 239657 - DNA, 902 bp, Homo sapiens
  misc_feature: GYAE6OF02JN4HS.4.18.B07.1.454.CMB.1.raw
tcagagcactgtagcacgaccggtgctcgatttagtcgctgcgtaagggggagcatcacccagcaaccacatctgtcctctagagaatcccctgagagctccgttcctcaccatgactggacctggagatcctcttcgtggtggcagcagcctcgacggacgccccacctcccgaggtactaggttggtcgcgtacggtcgtgggctaggaggtagaagacgccggtcgggcctcgtagtagaacggtcctccgtgacgaacgtcttcgtacggactaccgtaccttcgaccggtacttaacgtacgtactacccgtacggttcgggtacgaccgtaaccgacccgggtccccggttagggaaccggtaaccggggttcgttagggtaacgggtagggtaacgggtaccggggtaaccggtaacctaccccggtaaaaccccggtacccggaaccgggttcgaaaccgaaaaccgtaaacccggaacgacccgtaaacggtacggttaaaacggttacggaaccgggtaccggtaaaccggtacccgtaaccgtaaccggttaacggacccgggtaagggaaaccccgttaccggttaaccggttacccaaacggaccaaaccgtaccgtaccgtttaacgggtaacgggtcgggtaaagaccggtacgggacgttacggtaaacggtcgttaaaggtccctaacggggaacccgtaccggttaaacccgggtgtttaacccgttaagttccgtaagggttcccgggaaagggtaggaacgggttaacgggttaacgtaaccgggtttaacggtaaacccggggttcgaaaaggtttacccgggtaggttaggtttttaaccggggtaaacggggttaaagtttccgggttaaaaccccggg

SEQ ID NO: 239658 - DNA, 548 bp, Homo sapiens
  misc_feature: GYAE6OF02IVTK9.4.18.B07.1.454.CMB.1.raw
  modified_base (243)..(243): a, c, t, g, unknown or other
  misc_feature (243)..(243): n is a, c, g, or t
  modified_base (316)..(316): a, c, t, g, unknown or other
  misc_feature (316)..(316): n is a, c, g, or t
  modified_base (539)..(539): a, c, t, g, unknown or other
  misc_feature (539)..(539): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatccctcttcttggtggcagcagcctcaggagcccactcccaggtacagttggtgcagtctgggctgaggtgaagaagcctgggcctcagtgaaggtctcctgcaaggcttcngatacaccttcaccggctactatatccactgggtgcgacaggcccctggacaagggcttgagtgatgggacgntcaacctaacaccggtgcacaaacaacgcaacagaacgtttcagggcagggtcaccagtagaccgagggaaccacggtccttacacggcacgacgacctaacttgggaacgttgagtcaggctgacgatctgacgacgaccggtccgtagtattactggtgcgagaggtaggaagtacgttggaacgtcgggaacttacgaggtcgtacggtagggttaacgnggttaacgg

SEQ ID NO: 239659 - DNA, 643 bp, Homo sapiens
  misc_feature: GYAE6OF02INR23.4.18.B07.1.454.CMB.1.raw
  modified_base (383)..(383): a, c, t, g, unknown or other
  misc_feature (383)..(383): n is a, c, g, or t
  modified_base (497)..(497): a, c, t, g, unknown or other
  misc_feature (497)..(497): n is a, c, g, or t
  modified_base (582)..(582): a, c, t, g, unknown or other
  misc_feature (582)..(582): n is a, c, g, or t
  modified_base (601)..(601): a, c, t, g, unknown or other
  misc_feature (601)..(601): n is a, c, g, or t
tcagagcactgtagcacgaccggtgctcgatttagtcgctgcgtaagggggagcatcacccagcaaccacatctgtcctctagagaactcccctgagagctcccgttcctacaccatggactggacctgggaggatcctcttcgttggtggcagcacgcctcgaggcgcccacctcccgaggtactaggttggtagcacgtcggtggggacgttggaggttaggaaggaacggccggtggggccgttacgaggttaggtaacggtccgtccgtcggacgtaacggtccttacgtaggactaccgtacccttccgaccggtccttaactagtactacgtacgtgggtcgaccgtaccggcggacccgtcggagacggtcttagngggtggagtacgggacgtacgtaccaacccgtacggtccggtacggacaacaaaccacgactacgtaagtacgtagacggcgtaggtacacagcgacgaggactaccgtctacncgtacaccgtacgtactggtaggacgcgtaggcgacggtagcacggtactcgtacgacgacgtacggcgttagtaactgcggtanacgggagaggaggtaacgngtggtacgtaggagcgacgtcggtggtaacgtggtagtaccg

SEQ ID NO: 239660 - DNA, 752 bp, Homo sapiens
  misc_feature: GYAE6OF02H73ZB.4.18.B07.1.454.CMB.1.raw
  modified_base (159)..(159): a, c, t, g, unknown or other
  misc_feature (159)..(159): n is a, c, g, or t
tcagagcactgtagcacgaccggtgctcgatttagtcgctgcgtaagggggagcatcacccagcaaccacgatctgtcctctagacgaatcccctgagagctccgttcctcaccatggactggacctggaggatcctcttcgttggtggcagcagcctnaggagcccactcccaggtacagttggtgcagtcgtggggctggaggtgaagagccgtggggcctcgagtgaaggtctctgcgaaggcttgtggataccaccttcaccggctactagtactccacgtggtcgacgacgacggccccgtagggacgtaacgggtccgttaggacggtaggtacggttacggggaaccggacgttaccaaaaaccccgttaacgggaacccgggttacgggaaccctaaaaccgaaaaccaacccggaccgtaaacgtaaacggttaaaacgggtttaccggaacgggggtttaccgaacgggggttacccaaaccggacgtttaccgggaaacccggtacggggtaaccctaccccgggtttacccgttaccgaaacgtacccgaggtaaccgtacccggtttaaccggtttaggggaacggttacgggaaacgttcggagggtactgggaaacggtactcggtaacgaccggaccgtacggtcgttagtacttcgttaggacggacgagaggtaaggtacgtaacgttggacgtacggatacgacggttgtcggttaacgtaggtggttaacgg

SEQ ID NO: 239661 - DNA, 920 bp, Homo sapiens
  misc_feature: GYAE6OF02JGWD9.4.18.B07.1.454.CMB.1.raw
  modified_base (333)..(333): a, c, t, g, unknown or other
  misc_feature (333)..(333): n is a, c, g, or t
tcagagcactgtagcacgaccggtgctcgatttagtcgctgcgtaaggggagcatcacccagcaaccacatctgtcctctagagaatcccctgagagctccgttcctcaccatggactggacctggaggatcctcttcttggtggcagcagcctcaggacgcccacctcccaggtacagttcggtgctagtcgtggggactggaggtgaacgaacgcctggtcggcctcgagtacgaacggttctccgtgacgaaggtccttacgtacggtactaaccgtacccttaccgaacccggtctacttaacgttactacccgtaacgttggggtacnccggaacgaccggtacccccgttgggaaaccgtaaggggtacccttttaggacggttacggggtaacgtcgggggtaaaccggtacttaaccccggtaaaaccccgttaacggtaccccggggttaacggtacccgaaaaccgtaaaaacccgaacccgggaccgtaaacccgtaaacggttaaaccggttttacggaacgggggacccgtaaaacgggggttcccctaaacccgtaaggttaacccggaaacccgggtaacggggaacccgttaaccgtttcccccggttaaacgaaccggtacccgaaacggtaacccggtttacccccttaggtttaaccgggacggggtttaaccgaacgggaccgtacgggtaccgggtaacgggtaagttaaccggtaccttaagggaaccgtaacccgggtacccgggttacccgttacggttttaaacgtcccgttaggttacgggaccgtaaaggggtacgggtaaacgggaacggttacggtaacgttaccggggtaccggttaaacgttaccggtacggttacggttacgggttaagggtttaaacgtaaccgggg

SEQ ID NO: 239662 - DNA, 887 bp, Homo sapiens
  misc_feature: GYAE6OF02HEJI4.4.18.B07.1.454.CMB.1.raw
  modified_base (158)..(158): a, c, t, g, unknown or other
  misc_feature (158)..(158): n is a, c, g, or t
  modified_base (190)..(190): a, c, t, g, unknown or other
  misc_feature (190)..(190): n is a, c, g, or t
tcagagcactgtagcacgaccggtgctcgatttagtcgctgcgtaagggggagcatcacccagcaaccacatctgtcctctagagaatcccctgagagctccgttcctcaccatggactggacctggaggatcctcttcgttgggagcagcacgcctnaggacgcccactacccgaggtactaggttggnctaggtcgtggggctaggtggtagaaggacggtccggtagggccttacgaggtacggaacggttcctccgtggaaccgtaaggtccttacgtacggacttaccacccgtttaccgaccggtacctaacgttataccgtcctaacggttggggtacgaccgaaccggtaccgggtacccccgtacggggaaacggtaacgggttccgttacgggtaacgggtacggtaacgggttaacgggggaaccggtaacctaaaccccgtaaacccccgggtaacccgggttaccggggttaacgaaaccccgaaaccggtaaaaacccggaacccggtaaccgtaaacgggttaaaaccgggttaaccggtttaaaccgggaaccgggggtaccggtaaccggggttacccaaacggtaaccgttaccgggaaaccccgggttaacgggaccctttaacccggttcccttaaccgggactaacgaccggtaaccgtaccggtttaacggtacggggtaacgttacgggaccgttaggaccggtagtaggacttacgtacggtacggaacgtaccggtaccggttacgttacgttacgttacggtggaacggtacggtacgaagggttacgggaacgttacggttggtaaccggtacggaagtacggtaggtacgttacgggttaaggtacggtacggttacgg

SEQ ID NO: 239663 - DNA, 655 bp, Homo sapiens
  misc_feature: GYAE6OF01D7P4V.21.15.B04.1.454.CMB.1.raw
  modified_base (298)..(298): a, c, t, g, unknown or other
  misc_feature (298)..(298): n is a, c, g, or t
  modified_base (334)..(334): a, c, t, g, unknown or other
  misc_feature (334)..(334): n is a, c, g, or t
  modified_base (405)..(405): a, c, t, g, unknown or other
  misc_feature (405)..(405): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggagcttggtccaggccggggggtcctgagactgtcctgtgaagtctctggattgtatagcagagattggatgcactgggtccnccagacttcaggaaaggtctggagtgggtggccaanataaaaccagatggaaagtgtagaagcactatgtggcctctggtggaggggccattcgacaatctccaganacagtgaccaaagaactcgtttgtaactctagactaaagtggaactaggcccgttaggaacgtacgggacccggaaggggaacccaaccgggggtcccttacgttacccgtttaaatttaaacccggttggttaccgggtacccggtaaaccccgggggtaatttaacgggttacgggtacccgtttaaaccgggttaccgttaaacggttttcgggtaccccgggtttccccgggttacccgggggggg

SEQ ID NO: 239664 - DNA, 522 bp, Homo sapiens
  misc_feature: GYAE6OF01AUYO2.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggagcttggtccaggccggggggtccctgagactgtcctgtgaagtctctggattgtatagcagagattggatgcactgggtccgccagacttcaggaaagggtctggagtgggtgccaacataaaccaagatggaagtgtagaagcactatgtggcctctgtggaggggccgattcacaatctccagagacagtgaccaagaactcgttagtatctgacaatggacagcctagagagccgaggacgacggctctactacttacgtgtgccgacggatagtggctacgtcagttcgcgtccgtcgggg

SEQ ID NO: 239665 - DNA, 520 bp, Homo sapiens
  misc_feature: GYAE6OF01BRB07.21.15.B04.1.454.CMB.1.raw
  modified_base (332)..(332): a, c, t, g, unknown or other
  misc_feature (332)..(332): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggagcttggtccagccggggggtcctgagactgtcctgtgagtctctggattgtatagcagagattggatgcactgggtccgccagacttcaggaaagggtctggagtgggtgccaanataaaccaagatggaagtgtagaagcactatgtggcctctggtgaggggccattcacatctccagagacagtgaccaagactcgttgtatctagacaatggacagcctagacgagccgaggacgacggctctactattacgtgtcgcgaccggatagtggcttacgtctagttcgcgtccgtcggggg

SEQ ID NO: 239666 - DNA, 526 bp, Homo sapiens
  misc_feature: GYAE6OF01AWFPP.21.15.B04.1.454.CMB.1.raw
  modified_base (495)..(495): a, c, t, g, unknown or other
  misc_feature (495)..(495): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccagccgggggggtccctgagactgtcctgtgaagtctctggattgtatagcagagattggatgcactgggtccgccagacttcgaggaaagggtctgggagtgggtggccaacataaaaccaagataggaagtgtagaagcactatgtggcctgtgtgaggggccattcacaatctccagagacagtgaccaagaactcgttgtatctagacaaatggaacagcctagagagccgaggacacggctctctattacgtgtcgcgaccggntatggctacgtcagttcgcgtccgtcggggg

SEQ ID NO: 239667 - DNA, 586 bp, Homo sapiens
  misc_feature: GYAE6OF01BAKBI.21.15.B04.1.454.CMB.1.raw
  modified_base (431)..(431): a, c, t, g, unknown or other
  misc_feature (431)..(431): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggaggcttggtccaggccggggggtccctggagactgtcctgtgaagtctcgtggattgtatagcagagattggatgcactgggtccgcagacttcgaaggaaagggtctggagtgggtggaccaaacgataaaaccaagagaggaaagtgtagaagcaactagtagtggcctcgtggtggacgggccgtaattcaacaatcctaccagagacaggtnaccgaaagacttcgttgtactcgtgactaagtggaacaggtcctaggacgtacgccggaaggaccacggaccttcgtactattaaccgtggtacgccggaccggattagtcggacgttaaccgtctaagttccggccggttcccggtaccggggg

SEQ ID NO: 239668 - DNA, 511 bp, Homo sapiens
  misc_feature: GYAE6OF01BVQ86.21.15.B04.1.454.CMB.1.raw
  modified_base (481)..(481): a, c, t, g, unknown or other
  misc_feature (481)..(481): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccgggggggtccctgagactgtcctgtgaagtctctggattgtatagcagagattggatgcactgggtccgccagacttcaggaaagggtctggagtgggtggccaacataaaccaagatggaagtgtgaagcactatgtggcctctgtgaggggccattcacaatctcagagacagtcgaccaagactcgttgtatctgcaatggacagctgagagccgaggacacggctctctattactgtgcgacggntagtggctacgtcattcgcgtccgtcgggg

SEQ ID NO: 239669 - DNA, 522 bp, Homo sapiens
  misc_feature: GYAE6OF01AUM7N.21.15.B04.1.454.CMB.1.raw
  modified_base (486)..(486): a, c, t, g, unknown or other
  misc_feature (486)..(486): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttcctgttgctattttagaaggtgtccagagtgaggtgaaagtggtggagtcggggggaggcttggtccagccggggggtccctgagactgtcctgtgaagtctctggattgtatagcagagattggatgcactgggtccgccagacttcaggaagggtctggagtgggtggccaacataaaccaagatggaagtgtgaagcactatgtggcctctgtggagggccgattcacatctccagagacaggtgaccaagaactcggttgtatctgacaatggacagcctgagagccgaggaccacggctctctatactgtcgacggaccggntacgtggacttacgtcagttcgccgtccgtcggggg

SEQ ID NO: 239670 - DNA, 640 bp, Homo sapiens
  misc_feature: GYAE6OF01CSSZG.21.15.B04.1.454.CMB.1.raw
  modified_base (309)..(309): a, c, t, g, unknown or other
  misc_feature (309)..(309): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttgggttttccttgttgcttattttagaaggtgtccagagtgaggtgaaagtggtggaggtcggggggagcgttggtccgagggccggggggtccctgagactgtcctgtgaagtctctggattgtatagcaagagtattggatgcacgtcgggtccnccagtacttcgaaggtaaaggtctagggaggtgggtacggaccaaacaagtaaaaccgaagtagtagggaaagtggtagaagcaacgtagtggtcggccttcgtaggtaggacgggggtaccctatttaccgaactaactccgtaccgaagacgaacagtacgaaccaaagtaccttggttgtaattcctagaactaaagtcgggaacacggcctaggacgacgaccggaagaccgacggctctacgtacttacgtggtcgacggtaccggtattacggacggtaccttaccggtacttaacggttcggtcccggttccggtaaccggggg

SEQ ID NO: 239671 - DNA, 519 bp, Homo sapiens
  misc_feature: GYAE6OF01BDEK7.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcgtggtttcctgttgctatttagaaggtgtccagagtgaggtgaaagtggtggagtcggggggagcttggtccaggccggggggtcctgagactgtcctgtgagtctctggattgtatagcagagattggatgcacgtgggtccgccaggacttcgagggaaagggtctgggagtgggtggccaacataaaaccaagatggaagtgtagaagcactatgtggcctcgtgtggaggggccattcgacaatctcagagacagtcgaccaagactcgttgtatctgacaatggacagcctgagagccgaggacacggctctctatactgtcgcgacggtatagtggactacgtcagttcgcgtcgtacgggg

SEQ ID NO: 239672 - DNA, 567 bp, Homo sapiens
  misc_feature: GYAE6OF01D0V7S.21.15.B04.1.454.CMB.1.raw
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcggggggaggcttggtccaggccggggggtccctgagactgtcctgtgaagtctctggattgtatagcagagattggatgcactggggtcccnccagacttcgaggaaagggtctggagtgggtgccaanataaaccaagataggaagtgtagaagcactatgtggcctcgtggtggaggggcctattcacaatcctcagagacagtcgaccaaagactcgttagtatctgactaaagtggaacacgacctaggaagtacggaccggaaggaccgacggtcctacgtacttaacttacgtggtcgacggaccggtatacgtcggcttacgtctagttcggccgtccggtaccggggg

SEQ ID NO: 239673 - DNA, 529 bp, Homo sapiens
  misc_feature: GYAE6OF01DV9EN.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggagcttggtccaggccggggggtcctgagactgtcctgtgaagtctctggattgtatagcagagattggatgcacgtgggtccgccagacttcgaggaaagggtctggagtgggtggccaacataaaccaagatggaagtgtagaagcactatgtggcctcgtgtgaggggccattcacatctccagagacagtgacaagactcgttgtatcgtgcaaatggacagcctagagacgacgagacacggctctactattacgtgttcgacggaccggtatagtacggacttacgtcgtattcggcgtccggtcgggg

SEQ ID NO: 239674 - DNA, 654 bp, Homo sapiens
  misc_feature: GYAE6OF01DQOZ6.21.15.B04.1.454.CMB.1.raw
  modified_base (340)..(340): a, c, t, g, unknown or other
  misc_feature (340)..(340): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttcctgttgctattttagaagtgtcagagtgaggtgaaagtggtggaggtcggggggaggcttggtccgaggccggggggtcctgagactgtcctgtgagtctcgtggtattgtatagcagagtattggatgcacgtgggtccgcagacttcgaggaacggtcgtaggagtgggtcgaccaanaataaaccgaagagtaggaagttgaggaacgctactagtgtcgtccttgtggtggacggggtcctaagttacaacgtaattccgacgaaggaacgacgaggtcgaacctaaaggtaaccttcggtttagtacttcgtacggaactaaaaggttcgaacgtacggtacctagggacgaacggacccggtacggaaccgtacgggacccttacttacgttaacgttataccggggttcgaccggtaacccggtattaacggtacggtaccgttaacgttcaacgtttcgggtcccggttcccggtaacccgggggg

SEQ ID NO: 239675 - DNA, 565 bp, Homo sapiens
  misc_feature: GYAE6OF01APZDM.21.15.B04.1.454.CMB.1.raw
tcagtcgtcgctcgcacgaccggtgctcgatttagacagtatatatccggcggggaggtctcagagaggagccttagccctgggactccaaggcctttccacttggtgatcagcactgagcacagaggactcaccatggaattggggctgtagctgggttttccttgttagctattttagaaggtgtccagagtgaggtgaagtggtggagtcggggggaggcgttgggtccaggccgggggggtccctgagactgtcctgtgagtctctggattgtatagcagagattggatgcactgggtccgccagacttcaggaagggtctgggagtgggtggccaacgataaaccgaaggatgggaagtgtgaaagcacgtatggtggcctactggtgaggggcctattcacaatctccagagacagtcgaccaagactcgttagtactctagactaagtggacagacctaggagacggccgaaggacgacggcctcgtcgtacttacgtggtcgacggaccggtattacgtaggcctacggtctagttcggtccgtccggtaccggggg

SEQ ID NO: 239676 - DNA, 670 bp, Homo sapiens
  misc_feature: GYAE6OF01C5AA6.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattgggctgagctggttttccttgttgctattttagaaggtgtccagagtgaggtgaaagtggtggaggtcgggggagcgttggtccgaggccggggggtccctgagacgtgtcctgtgaagtctctggattgtatagcagagagttggatgcacgtgggtccgtccgagacttcgaaggaaaggttctagggagtgggtcgaccgaaacgattaaaaccgaagtaagtaggaaagtggtagaaagcaacgtaagtggtcggacccttgtcggtagggacggggtcctacgtttaccaacgtaactccgtaccgaaggaacgaccgtaagtcgaacccgaaaggtaaccttcggtttagttaactcgtgaacgtaaagtcggtaacacggtcctagaacggagacccggacggtaacgccggtcttaccgttaccgtaactttacgtcggtaccgaccgggaacccggttaagttacggtacggtaccttaaccgggtcttaagttccggtcccggttccggtacccggggg

SEQ ID NO: 239677 - DNA, 549 bp, Homo sapiens
  misc_feature: GYAE6OF01EEJW4.21.15.B04.1.454.CMB.1.raw
  modified_base (424)..(424): a, c, t, g, unknown or other
  misc_feature (424)..(424): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctggggttttccttgttgctattttagaaggtgtccagagtgaggtgaaagtggtggagtcggggggaggcttggtccagccgggggggtcctgagactgtcctgtgaagtctctggattgtatagcagagattggatgcactgggtccgccagacttcaggaaagggtctggaggtgggtggcctaacataaaaccaagataggaagtgtgaaagcactagtgtggccttcgtggtggaggggcccgtaattcacaatcctccagagacagtnaccaagactcgttagtatctgcaaatggacagcctgagacggccgaggaccacggtctctactatacgtgtcgacgacccggtatagtcggactacgtactaagttcggccgtcggtaccggggg

SEQ ID NO: 239678 - DNA, 708 bp, Homo sapiens
  misc_feature: GYAE6OF01CGI38.21.15.B04.1.454.CMB.1.raw
  modified_base (306)..(306): a, c, t, g, unknown or other
  misc_feature (306)..(306): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcggggggagcgttggtccgaggccgggggggtcctgagactgtcctgtgaagtctcgtggattgtatagcagagtattggatgcacgtgggtcccncagtacttcgaagggaaacggtcgtgggaggtggggtacggacccaaaacgaacttaaaaacccgaaggtagtaggggaaagttcggtagaaaggctaacgtagtgtcggtcctcgtggtagggacggggtccctagtttacccgaactaaacgttccgttacccgaaaggaacggtaaccgtaacgggttaccgaaacccgtaaaaggttaacccttcgggttttacgtaacgttaccgtaggtaaccgtaaaagtcgggaaccgtacgtacccgtaggaaacggaccggaccggaacgggaaccaccgggtaccttccgttacttacgtttacgtcggttacggaccgaacggtattacgtcggtacttacgtactagttcggtccggtccggtacgggg

SEQ ID NO: 239679 - DNA, 684 bp, Homo sapiens
  misc_feature: GYAE6OF01DMXUV.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtgggaggtcggggggaggcttggtccgaggccgggggggtccctgagactgtcctgtgaagtctcgtggattgtatagcagagtattggatgcacgtgggtccgccagtacttcgaagggaaagggtcgtgggaggtgggtgaccaaacaataaaaccgaagaatggaaagtgtagaagcactagtggtcggcctcgtggtggacggggccgtattcaactaactcctaccgaggaacgacgtacgtcgaaccgaaagtaaccgttcggtttagtacttcgtagtaacctaaagttcgggaacacggtaccgtagggaacgtaacggacccgggaagggtaacccgtaccgggtacccttacgttaccttaaacgttacccgttagggttccggacccgggtaaccggtagtttacggtacgggtaccttaaccggttactaacggttttccgggtaccggttcccgggttacccgggggg

SEQ ID NO: 239680 - DNA, 697 bp, Homo sapiens
  misc_feature: GYAE6OF01EIFXT.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttgggttttccttgttgctattttagaaggtgtccagagtgaggtgaaagtggtggaggtcggggggagcttggtccaggccggggggtcctgagactgtcctgtgaagtctctggattgatagcagagattggatgcacgtggggtcccgccagacttcgaagggaaacgggtcgtgggaggtggggtaggacccaaacgaacttaaaaacccgaaggtaagtacggggaaaggttggtaggaaacgcgtaacgtagttcggtggtcccttacgtggttagggaacgggggtccctaagtttaccgaactaacgttcctaccgaagtaacgtacgaaggttcgaacccgtaaaggtaacccttcgggtttattaacgttccgttaggaacctaaaaggtcgggaacctacggtcccgtagggacgaacgggtaccgaacgggtaccgaccgggtctaccgtacgttacttacgtcggtcggaccggtaaccggtatacgtgggtaccttaacggtactacgtttggcccgttcgggtacccgggg

SEQ ID NO: 239681 - DNA, 684 bp, Homo sapiens
  misc_feature: GYAE6OF01AXLJI.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttgggttttccttgttgcttattttagaaggtgtccagagtgaggtgaaagtggtggaggtcggggggagcttggtccaggccggggggtccctgagactgtcctgtgagtctctggattgtatagcagagattggatgcacgtgggtccgcagacttcgagggaaagggtctgggagtgggtcggaccaaagactaaaaccgaagagtaggaagtggtagaaggctaacgtagtggtggcccttgtggtcggacggggtcctattcaactaatcctaccaaggagaactaggtcaccgaaagtaaccgttgttagtaattcgtacgacgtaaagttacggaacacggtaccgtaggaacggacgggtaccggaacgggaaaccgacccgggacttccgtttaccttaacgtttaaccgttcggttaccgggtaccgggtaacccgggttaacttacgggttacggttaacccggtttaaccggtacgttaaagttttccgggtccgggtttacccgggttacccgggggggg

SEQ ID NO: 239682 - DNA, 585 bp, Homo sapiens
  misc_feature: GYAE6OF01B2W50.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccggggggtccctgagactgtcctgtgaagtctctggattgtatagcagagattggatgcacgtgggtccgccagacttcgaggaaaggtcgtggagtgggtgaccaacataaaccaagatggaagtgtagaagcactagtggtggcctcgtgtggacggggccgtatttccaactaactcctacccgaaggaacggaacaggttacgaacccgaaaggtaaccttcggtttagtacttcgtagacaaagttcggaactacgccgtagacggacgaccgaggacacggtctctcttagttacgtgtgaccgacggtatacgtcggactacgtctattcggcgttccggtacgggg

SEQ ID NO: 239683 - DNA, 535 bp, Homo sapiens
  misc_feature: GYAE6OF01AS4T2.21.15.B04.1.454.CMB.1.raw
  modified_base (343)..(343): a, c, t, g, unknown or other
  misc_feature (343)..(343): n is a, c, g, or t
  modified_base (401)..(401): a, c, t, g, unknown or other
  misc_feature (401)..(401): n is a, c, g, or t
  modified_base (473)..(473): a, c, t, g, unknown or other
  misc_feature (473)..(473): n is a, c, g, or t
  modified_base (498)..(498): a, c, t, g, unknown or other
  misc_feature (498)..(498): n is a, c, g, or t
tcagtcgtcgctcgcacgaccggtgctcgatttagacagtatatatccgcgggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcggggggaggcttggtccgaggccggggggggtccctggagactgtcctgtgaagtctctggattgtatagcagagattggatgcactgggtcccgccagacttcaggaagggtctggagtgggtggccaanataaaccaagatgggaagtgtagaagcatatgtggcctgtgtggaggggccattcaanatctccagagacagtgaccaagactcgttatatcagacaatggacagcctgagagccgaggacacggctctntacttacgtggtcgacggaacggtntagtcggtctacgtacagtttcgccggtccgtcgggg

SEQ ID NO: 239684 - DNA, 686 bp, Homo sapiens
  misc_feature: GYAE6OF01BY1W4.21.15.B04.1.454.CMB.1.raw
tcagtcgtcgctcgcacgaccggtgctcgatttagacagtatatatccgcgggggaggtctcagagaggagccttagccctggactccaaggccctttccacttggtgatccagcactgagcacagaggactcaccatggaattggggctgagctgggttttcctgttgcttatttagaaggtgtccagagtgaggtgaaagtggtaggaggtcgggggagcttggtccagggccggggggtcctgagactgtcctgtagagtctctggattgtatagcagagattggatgcacgtgggtcccgacagacttacgaggtaaagggtctagggaggtgggtcggacctaaacgaattaaaaccgaagtagtagggaaagtgtaggaaagaccgaacttaagtcggtcggtacccttgtcggtagggacggggtacctaagttccgaacgtacgttcctaccgaagtaacgaactaggtacgaacccgaacgtaaccgttacgttacgtactacgtacgtacaaacgttcggaacctacggtacccgtaggaacggtacgggaccggtaacggaccggaccggtaccgttactaacgttacgttaccgttaggtaccggtaccggaaccggtagttacgtcggtacgttaaccgtctaagttcggtcccggttccgggtaacccgggg

SEQ ID NO: 239685 - DNA, 526 bp, Homo sapiens
  misc_feature: GYAE6OF01CP1SL.21.15.B04.1.454.CMB.1.raw
  modified_base (385)..(385): a, c, t, g, unknown or other
  misc_feature (385)..(385): n is a, c, g, or t
  modified_base (463)..(463): a, c, t, g, unknown or other
  misc_feature (463)..(463): n is a, c, g, or t
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
  modified_base (497)..(497): a, c, t, g, unknown or other
  misc_feature (497)..(497): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccgggggggtccctgagactgtcctgtgaagtctctggattgtatagcagagattggatgcacgtgggtccgccagacttcaagggaaaggtctgggagtggggtggaccaacataaaccgaagagtaggaagtgtagaagcactatgtggcctntgtggaggggccgagttcacaatcctccagagacagtcgaccaagaactcgttgtatctgacaatggacagcctgagngacgaggacncgctctntacttactgtgcgacgntagtgactacgtcattcgcgtcgtcgggg

SEQ ID NO: 239686 - DNA, 616 bp, Homo sapiens
  misc_feature: GYAE6OF01DC1IZ.21.15.B04.1.454.CMB.1.raw
tcagtcgtcgctcgcacgaccggtgctcgatttagacagtatatatccgcgggggaggtctcagagaggagccttagccctggactccaaggcctttccacttggtgatcagcactgagcacagaggactcaccatggaattggggctgagctgggtttccttgttgctattttagaaggtgtcagagtgaggtgaaagtgggtggaggtcggggggaggcttgggtccaggccgggggggtccctggagactgtcctggtgaagtctctggattgtatagcagagattggatggcacgtggggtcccgccagaccttcgagggaaagggtctgggagtggggtggccaacataaaccaagataggaagtgtagaagcactaatgtcggcctcgtgtggaggggccgattcactaatcctccagagacagtcgaccaacgaacttcggttgtactctgacaaagttgacgagtccgtaggtaacgaggtacccgggacggaccgtaccggtccgttaccttaccgtactttacgtacgggttcggaccggtaccgggtataacggttcggtaccgttaccgtcgtaaggtttcgcccggttcccgggtaccggggg

SEQ ID NO: 239687 - DNA, 661 bp, Homo sapiens
  misc_feature: GYAE6OF01EQG5S.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaagtgtcagagtgaggtgaagtggtggaggtcgggggagcgttggtccgaggccggggggtcctgagactgtcctgtgagtctcgtggattgtatagcagagattggatgcacgtgggtcccgccagacttcgagggaaagggtcgtagggaggtgggtcggaccaaacataaaaccaagagtaggaagtgtagaagcaactagtggtcggccttcgtggtaggacgggggtcccgtaagtttaccgaactaacttccgtaccgaaggaacgacgtaagtacgaacccgaaaggtaaccgttcgtttagtaacttcgtagacgtaaacgtcgggaaccaggtcccgtaggaacggacggacccgggaacgggaaccgaccgggtccttccgtaccttaagttaaccgttggtacgcccgggtaaccggtattacggtacggtaccgttacgtactagtttcggcccggttcccgggtaccggggg

SEQ ID NO: 239688 - DNA, 534 bp, Homo sapiens
  misc_feature: GYAE6OF01ATD6I.21.15.B04.1.454.CMB.1.raw
  modified_base (358)..(358): a, c, t, g, unknown or other
  misc_feature (358)..(358): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttgggttttccttgttgctattttagaaggtgtccagagtgaggtgaaagtggtggaggtcggggggagcgttggtccgaggccgggggggtccctgagactgtcctgtgagtctctggattgtatagcagagattggatgcacgtgggtccgccagacttcaggaaagggtctggagtgggtgcaacataaacaagatggaagtgngaagcactagtgtgcctgtgtggagggcctattcactatctccagagacagtcgaccaagactcgttatatctgactaagtgaacacgctggagacggaccgaggacacggctctcttatacgtgtcgacgacggatacgtggaccttacgtctagttcgccgtccggtacggggg

SEQ ID NO: 239689 - DNA, 574 bp, Homo sapiens
  misc_feature: GYAE6OF01BW3AX.21.15.B04.1.454.CMB.1.raw
  modified_base (342)..(342): a, c, t, g, unknown or other
  misc_feature (342)..(342): n is a, c, g, or t
  modified_base (534)..(534): a, c, t, g, unknown or other
  misc_feature (534)..(534): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggagcttggtccaggccggggggtcctgagactgtcctgtgaagtctctggattgtatagcagagagttggatgctacgtgggtccgccagacttcgaggtaagggtctaggaggtgggtaggccaanacgtaaaccaagatggaagtgtagaacgcactagtgtcggctcgtgtggacgggggcctaattcactaagtcctaccgaagacgacgaggtacgacctaaagtaacttcgttagtactcgtgacaagtcggacagcctaggagacgccgaaggacacggctctacgtacttacgtcgtcggacgtaccggtntacgtcggcttacgcgtagtttcggccggtcgtaccgggg

SEQ ID NO: 239690 - DNA, 623 bp, Homo sapiens
  misc_feature: GYAE6OF01DLHOV.21.15.B04.1.454.CMB.1.raw
tcagtcgtcgctcgcacgaccggtgctcgatttagacagtatatatccgcggggaggtctcagagaggagccttagccctggacctccaaaggcctttccacttggtgatcagcactgagcacagaggactcaccatggaattgggctgagctgggttttccttgttgctattttagaaggtgtccagagtgaggtgaaagtggtggagtcgggggagcttggtccaggccggggggtccctgagactgtcctgtgaagtctcgtggattgtatagcagagattggatgcacgtgggtcctcagacttcgaggaaggtctggaggtgggtgccaaacactaaaaccagataggaagtgtagaagcactatgtgcctgtgtggacgggccgtattcaacgtaatcctaccgagaacgacaggtacgaaccgaaagtaacgttcgtttacgtatcgtagacaaagttcgggaacacgtccgtaggacggtacggaccggaaggaaccgaccggtccttaccgttaccgtactttacggtcggttacggaccggtaacccgggtaattaacggttggaaaccgttaccggttactagtttcggacccgtttccgggtaaccggggg

SEQ ID NO: 239691 - DNA, 620 bp, Homo sapiens
  misc_feature: GYAE6OF01EB7CS.21.15.B04.1.454.CMB.1.raw
  modified_base (319)..(319): a, c, t, g, unknown or other
  misc_feature (319)..(319): n is a, c, g, or t
  modified_base (494)..(494): a, c, t, g, unknown or other
  misc_feature (494)..(494): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagtcttgggttttccttgttgcttattttagaaggtgtccagagtgaggtgaaagtggtggaggtcggggggagtcgttgggtccgagggcccgggggggtccctggagtactgtcctggtgaagttctcgtggtattgtatagcagagtattggatgcacgtcgggtccncagacttcgaaggaaggtctggagtgggtgaccaaacgactaaaaccgaggagtaggaaggtgtaggaagcaacgtagtggtcgcctgtggtaggacggggcctaacttcaactaacttccgtaccgagacgacagtacgaccaaagtacttcgttatatctagactaagtgacncgtacgtgagaccggaccgaaggaccgaccggtcctacttacgttacgttacgtggtcgacccggaacgttagtacggttcggaccttacggtcgttagttccggcccggtccggtaacccggggg

SEQ ID NO: 239692 - DNA, 566 bp, Homo sapiens
  misc_feature: GYAE6OF01ELMW4.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccagccggggggtcctgagactgtcctgtgaagtctctggattgtatagcagagattggatgcactgggtccgcagacttcgaggaagggtctggagtgggtgccaacataaaccaagagtggaagtgtagaagcatatgtggcctctgtggagggccgattcaacaatctaccgagagacagtcgaccaagtaactcgttagtatctgactaaagtgggacaggcctaggacgagccggaaggacgaacggtcctacgttactacgttaactggttcggaccggtaaccgggattacggtgggaccttaacggtcaagtttcggcgttcccggtcggggg

SEQ ID NO: 239693 - DNA, 655 bp, Homo sapiens
  misc_feature: GYAE6OF01DUSZ7.21.15.B04.1.454.CMB.1.raw
  modified_base (290)..(290): a, c, t, g, unknown or other
  misc_feature (290)..(290): n is a, c, g, or t
  modified_base (629)..(629): a, c, t, g, unknown or other
  misc_feature (629)..(629): n is a, c, g, or t
tcagtcgtcgctcgcacgaccggtgctcgatttagacagtatatatccgcggggaggtctcagagaggagccttagccctggactccaaggcctttccacttggtgatcagcactgagcacagagactcaccatggaattgggctgagcttgggttttccttgttgctattttagaaggtgtccagagtgaggtgaaagtggtggaggtcggggggagtcgttgggtccgagggtcccgggggggtccctggagaccgtgtcctggtgtaagtctcgtggattgtatagnagagtattgatgcacgtcggtccgcagtacgttacgaagggtaaggtcgtaggtaggtgggtacgaccaaacaataaaaccgaagtagtaggaagtgtagaacgtctacgtagtcggtcggtccttcgttggtaggacggggtcctagtttaccaacgtaacttccaccgagaacgtacgtagtacgaaccgaaacgtacttcggttagtaactcgtacgaactaagtcggaactaacggtcctaggacgacgtaccggaacggaccgtaccgtctaccttacgttacgttacgtcggtcggaacccggtaacgtagtacgttcggacgttacgttacngtttaccggtcggtcccgggtacggg

SEQ ID NO: 239694 - DNA, 692 bp, Homo sapiens
  misc_feature: GYAE6OF01ECBY8.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcggggggagcttggtccaggccggggggtcctgagactgtcctgtgagtctctggattgtatagcagagattggatgcacgtcgggtccgccagacttcgaggaagggtctgggaggtgggtcgaccaaacactaaaccgaagagtaggagtgtagagctactagtggtcggcctcgtggtaggacgggcctattacactaactctaccgagacgacagtacgaccgaacgtacttcgttagtactcgtagactaagtcggaacacggtaccgtaggaacgaccggtacccgggaacgggtaacccgaccggggttccttaccgtttaaccgttaacgtttaaccggtttacgggtaccgggtacccgggttaaaccccgggttaagtttaacgggttccggggttaacccgtttaacccggttacggttaaccgggttttcccgggtaccccgggtttccccggggttaccccgggggggg

SEQ ID NO: 239695 - DNA, 545 bp, Homo sapiens
  misc_feature: GYAE6OF01BWHEO.21.15.B04.1.454.CMB.1.raw
  modified_base (513)..(513): a, c, t, g, unknown or other
  misc_feature (513)..(513): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccgggggggtccctgagactgtcctgtgaagtctctggattgtatagcagagattggatgcactgggtcccgccagacttcgagggaaagggtctagggaggtggggtcggacccaaacataaaaccgaagatggaagtgtagaagcactatgtggcctcgtggtggaggggccgtattcacaatcctcaagagacagtcgaccaagactcgttagtatctagacaaagtggacagcctagagacgccggaagccacggctctctattactggtcgcgacggntacgtgtctacgtcagttcgcgtcggtcgggg

SEQ ID NO: 239696 - DNA, 590 bp, Homo sapiens
  misc_feature: GYAE6OF01AI2GW.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggaggcttggtccaggccggggggtccctgagactgtcctgtgagtctctggattgtatagcagagattggatgcactgggtccgccagtactcgaggaaggtctggagtgggtgccaacataaaccagatggaagtgagaagcactagtgtacggctctgtggacgggccgtattcgactaatcaccagacgactaggtcgaccaaaggactcggttagtactctagacaaagtcggaactacgaccgttagagtaccggaccgaggtaccgaccgggtccttcctacgtttacgttacgttcggtaccggacggtacggtataccggtaggtacccgtaccgtatacggttcggaccggttccccggtacggggg

SEQ ID NO: 239697 - DNA, 633 bp, Homo sapiens
  misc_feature: GYAE6OF01BLHGT.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcggggggaggcgttggtccaggccgggggggtccctggagactgtcctgtgagtctctggattgtatagcagagattggatgcacgtcgggtccgccagacttcgaagggaaagggtctgggaggtgggtggacccaacaataaaaccgaagatgggaagtggtagaacgcactagtggtcggacctcgtggtggacggggccgtattccgaacgtaactcctaccaggaacgacgtacgtcgaacccgaaagtaaccgttcggttataactcgtacgacgtaaagttcggacgacgtaccgtaggagacggtaccgaaggaccaccgggtctacgtacttacgtaccgtcgtcggaccggtaacccggtgtacgttaccggacttaccggtctaagtttccggcggttcccggtaccggggg

SEQ ID NO: 239698 - DNA, 650 bp, Homo sapiens
  misc_feature: GYAE6OF01APPYB.21.15.B04.1.454.CMB.1.raw
  modified_base (359)..(359): a, c, t, g, unknown or other
  misc_feature (359)..(359): n is a, c, g, or t
  modified_base (627)..(627): a, c, t, g, unknown or other
  misc_feature (627)..(627): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcgtgggtttccttgtgcttattttagaaggtgtccagagtgaggtagaaaggtggtggaggtcggggggaggcttggtccgagggcccggggggggtccctggagtacgtggttccgtgtggaacgttctctggattgtatagcagagtattggatgcacgtgggtccgccagacttcgaaggaaaggtcgtggaggtgggtgccaaanaactaaaccaagagtggaagtgtagaagctaactatgtcggcctacgtggtacggaggggaccgtagttaccacgaacttccgtaccaggacgtacgaggttcgaaccgaaagtaaccttacgttagttactactacggaacgtaaacgtcggaacctacggacccgttgggaacggtacggaccgggaacggtaaccgaacccggtccgttaccttactttaaccgttacgtcggttcgaccgggacgtagtacgtggtactacgtntacgttgcccgtcgggtaccggg

SEQ ID NO: 239699 - DNA, 747 bp, Homo sapiens
  misc_feature: GYAE6OF01CS80X.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagtcgttgggttttccttgttgcttattttagagtgtccagagtgagtgaagtggtggaggtcgggggagtcgttggtccgagggtccggggggtcctggagactgtccgtgtagagtctcgtggtattgtatgcagagtagttggatgactacgtcgggtcccacgtacgtacgttacgaaggggtaaacgggttcgtaggggtaggttcggggtacgaacccgtaaaaccgtaaacgtaaaaacccggaaaggtaacgttaagggggtaaaggtttacgggtaaaggtaaacggaccgttaaaccgttaaaggttcgggtaaccggtcccgtttaggtcgggttaggggaccggggtaccctaattacccgaaagtaacgttcccgtaacgaaggaacgtaacgtaggtaccgaacccgttaaagaacccgtttggttaataccttcgtagaacctaaagcgactacggaccgtaggacgacggtaccggaaggtacgaccgtcttacgtacctaagttcgtacggcgtacccgtaacgtacgttacgtacggtacctacggttaccaggtttacggcccgttcccggggtaacggg

SEQ ID NO: 239700 - DNA, 641 bp, Homo sapiens
  misc_feature: GYAE6OF01BS8WH.21.15.B04.1.454.CMB.1.raw
  modified_base (185)..(185): a, c, t, g, unknown or other
  misc_feature (185)..(185): n is a, c, g, or t
  modified_base (404)..(404): a, c, t, g, unknown or other
  misc_feature (404)..(404): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaagttggggctgagtcttgggttttcctgttgcttattttagaaggtntccagagtgaggtagaaagtggtgggaggtcggggggagtcgttgggtccgacgggtcccgggggggtccctggacgtacgtgtccgtgtagtagtctcgtggtattgtatagcagagtagttggatgcacgtgggtcccacgagacttacgaaggtaaggtcgtaggaggtcgggtacgaccaaagaactaaaacgaagagtaggaagtagtacgaanactaacgtagtcggtcggtccctagtcgggttaggaaccggggtctaacgttacgacgtaacgttccaccgaagacgaagtacggtacgaaccgtaaagaaccgtttgttagtacgttacgagaacgtaaagcggtacgaacgtccgtaggacgacggaccggagaccgcgtctacgtctacttgacgtcgacgacggtatcgtggccttacgtatacgtcgccgtcggtaccgggg

SEQ ID NO: 239701 - DNA, 827 bp, Homo sapiens
  misc_feature: GYAE6OF01E4X4V.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattgggctgagctgggttttccttgttgctattttagaaggtgtccagagtgaggtgaaagtggtgggaggtcgggggaggtcgttgggtccgacgggtcccgggggggttcccctggaacgtaccgttcgttcccgtggtaggtaaacggttccgtcgttgggtaatttggtaagtaagccgaaggaagtagtttgggaatggacctaccgtgggggtccccaccgagtaccgttacgaaggggtaaaggggtccgtaggggaggttcggggttcgggacccaaaacgtaaacgtaaaaaccgaaggtaagtagggtaaaggttggtaaggaaacgtacgtaaccttaagttcgggttaccggccctttacggttagggtaggggaaccgggggtacccttaacgtttaacccgaaccgtaaaccgttcccgttaacccggtaaggtaacgggaaccgtaacggtaccggaacccgtaaaacggtaaccgtttacggtttacgttacgttaccgtaggtaaccgaaagttacgggaactacggacccgtaggaacggaaccggaccgtacgggaaccgtaccgggccttaccgttactttaaccgtacgttacggtcgtaccgggtaacgtacgtacgtaggtaccgttacggtcttaacggttcgtaccgggtcccggtacccgggg

SEQ ID NO: 239702 - DNA, 692 bp, Homo sapiens
  misc_feature: GYAE6OF01EHM5D.21.15.B04.1.454.CMB.1.raw
  modified_base (315)..(315): a, c, t, g, unknown or other
  misc_feature (315)..(315): n is a, c, g, or t
  modified_base (537)..(537): a, c, t, g, unknown or other
  misc_feature (537)..(537): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattgggctgagtcgttgggttttccttgttgtcttattttagaggtgtccagagtgaggtgaaagtggtggaggtcgggggagtcgttggtccgacgggcccgggggtcctgagcctgtcctgtgagtctgtaggtattgtatagcagtagtattggatcgctacggtcgggtcccncgagtaccttacgaagggtaaggtcgtgggaggtcgggtacgaccaaacgtaaactaaaccgaaggtacgtaggaagtaggtacgaacgactacgtagttcggtacgtccgttagtacggtgggacgggtaccgtattaccaacgtactcacgagagaacgtcgtacgactaaaggtaccttcggttactagtcctagactaaagtcgggaacacggtaccngaacgggaccgaccgggaacggtacccacgggttcccttactaaccgtttagttaacccggttgtaaccgggaccggttaacccggtaagttacggtacggttaccctaggttacccgtttaaggtttcggtcccggttcccggggtacccgggg

SEQ ID NO: 239703 - DNA, 918 bp, Homo sapiens
  misc_feature: GYAE6OF01DHQFN.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccagtggaagttggggctgagtcgttgggttttccttgttgtcttattttaaggaaggtcgtccaggaggtggaggtaggaaaggttgggtagggacggggtcgggggggaggtcgttcgggtccggacggggtcccgggggggtccctggacgtacgttcgtccgtggtagtaagtctgtggattgtatagcagtagtagttggatgcctacggtcgggtcccgaccgtagtaccgttacggaaaggggtaaacgggttccgtaggggtaacgggttggggtcggaaacccaaacgtaaaccgtaaaaaccgaaggtaaggttaggggtaaaggtttggtaaggaaacggtaccgtaaacgttaggtcgggttacgtcccgttcggttaggggtacgggtaaccggggggtaccttaacgtttaacccgtaaacgtaaaccgttaccgtaaccccggttaaaaggtaaccggaaacggttaacgggtaaccgaaacccggttaaaaacggttaaacccgtttgggttttaacgttaacgttaccgtttaaccggaaacgttaaacggttacgggaaaccgtccgggtaaccgttacgggaaacggacccgggtaaacccggggaacggtaacccggtaccgggtaccctttacgtttaccgtttaaacggttaacccgttagggaacccggtaaccgggtaacccggttaagttaccgggtaccgttacccgttaccggtacgttaaggtttccgggccccgggttaccggggtaaccccgggggg

SEQ ID NO: 239704 - DNA, 532 bp, Homo sapiens
  misc_feature: GYAE6OF01E3PWU.21.15.B04.1.454.CMB.1.raw
  modified_base (424)..(424): a, c, t, g, unknown or other
  misc_feature (424)..(424): n is a, c, g, or t
  modified_base (454)..(454): a, c, t, g, unknown or other
  misc_feature (454)..(454): n is a, c, g, or t
  modified_base (500)..(500): a, c, t, g, unknown or other
  misc_feature (500)..(500): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtgggaggtcggggggaggcttggtccaggcccgggggggtccctggagactgtcctgtgaagtctctggattgtatagcagagattggatgcactgggtccgccagacttcgaggaaagggtctaggaggtgggtggccaacaataaaaccgaagatggaagtgtagaagcactatggtcggcctcgtgtggaggggccattcacatctaccagagacagngccaagactcgttagtatctgcaatggacngcctgagagccgaggacacgctctctattactgtcgacgaccggtntagtggactacgtcattcgccgtcggtcgggg

SEQ ID NO: 239705 - DNA, 664 bp, Homo sapiens
  misc_feature: GYAE6OF01DWUBS.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttgggttttccttgttgctattttagaagtgtccagagtgaggtgaagtggtggaggtcgggggagcttggtccgaggccggggggtcctgagacgtgtcctgtgaagtctcgtggattgtatagcagagtagttggatgctacgtcgggtcccgcgagtacttacgaaggggtaaacggttcgtagggtagggtgggttacgggacccaaaacgtaaactaaaaacccgaaggtacgtagggtaaagtgtaagaacgactaacgtagtggtcggtacctgtggtaggtacgggaccgtattacactaactacgtaccgagacgacgtacgtacgtaccgtaacgtaacgttacgttagttacgtacgtagtaacgtaacgtacgacgaacgtaccgtacgacgtacggaccggtacggacgaccggtcgtaccgttacgttacttacgttcgtcggtacgacggtacgtacgtcgtacgtcgtaaaaactgttacgtccgtcggtacccggg

SEQ ID NO: 239706 - DNA, 858 bp, Homo sapiens
  misc_feature: GYAE6OF01C4CGY.21.15.B04.1.454.CMB.1.raw
tcagtcgtcgctcgcacgaccggtgctcgatttagacagtatatatccgcagggaggtctcagagaggagccttagccctggactccaaggcctttccacttggtgatcagcactgagcacagaggactcaccataggaagttggggctgagtcgttgggttttccttgttgtacttagtttttaggaaggtgtaccgaagtagtgaggtgaaaggtgggtggagggtcggggggagtcgttggtcccgacgggtcccgggggggttccctaggagtaccgttcggtccgttggtagaacgttccgtcgttggtagtttgtagtacgcgaagagtagttggagtcgacgtcgtcgggtcccgaccgaagtacgttcgaagggtaacgggtcgtagggcgggttcgggtacgacccgtaaacgaacgtaaaaacccgaggtaagttagggaaacgtttaggaaggtaaacgaccgttaaagttagtacgggttcggtccccgttaggtcggggtaacgggtacggggaccctttattacccgtaacaaccgtttaccgtaaccgaacgggtacgaacggttaacgtaccgaacccgttaaaggttaaccgtttccggttagtaccttacgtaccggaactaaaggtacgggtaactaacccgggtaccgtaggggtaaccgacgggtaaccccggggaaagttacccccggacggttacccgtttacccgttaaccgttaacccgttacggtacgggttacccggaaacccgggttaacccgtacgttttacccgggtacggttaacccgtttacccggtagttacccgggttcggttccccgggtttaaccccggggg

SEQ ID NO: 239707 - DNA, 732 bp, Homo sapiens
  misc_feature: GYAE6OF01DOAZB.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttgggttttccttgttgcttattttagaaggtgtccagagtgaggtgaaagtggtggaggtcggggggagtcttggtccgagggcccggggggtccctggagactgtcctgtgaagtctcgtggtattgtatagcagtagtagttggatcgactacggtcgggtcccgaccagtaccgttacggaaaggggtaaacgggttcgtaggggaaggtcggggtacgaacccaaaacgtaactaaaaaccgaaaggtagtagggaacgttggtagaaagcctaacgttagtcggtacggtacccttggtacgggttgggaacggggtccctaatttccgaaacgtaaacttcccgtaaccgaaggtaacgaacgtagtaccgaaccgaaaggtaaccgtttcgtttacgtactcgtacgtaacaaacggtcggaacgacggtccgtaaggaacggacggacccggaacggacccgacgggtcctttaccttacgtaccgtttacgtcggtcggtaaccggtaaccggtataccggtggtacccttacggttactaggtttcggtcccggtaccgggtacccgggg

SEQ ID NO: 239708 - DNA, 681 bp, Homo sapiens
  misc_feature: GYAE6OF01E5BCB.21.15.B04.1.454.CMB.1.raw
  modified_base (286)..(286): a, c, t, g, unknown or other
  misc_feature (286)..(286): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttgggtttttccttgttgcttattttagaaggtgtccagagtgaggtgaagtggtggaggtcgggggagcttggtccgagggcccggggggtcctgagactgtcctgtgagtctcgtggattgtataggcagagnttggatgccagtcggtcccgccagacttgaggaagggtcgtgggaggtgggtcggaccaaacgtaataaaaccgaagaactggggaaagtcggtaagaacgccaacgttagtggtaccggtccttcgtcgggtaggacggggaccgttacttaccgaacgtaaccttcctaccgaagtacggaacgtacgtaccggaactaaacggtaccgtttacgttggtaactcgtagaacgtaagtcgaacgacgtacgaggacgtaccggaccggtaacggaccgtaccgtcgttacgttacttacgtacgttcgggcgtaccggaaccggttagttaaccgtacggttacccgttacgtacgtaagttccgggttacccggtcccgggtaacccggggg

SEQ ID NO: 239709 - DNA, 847 bp, Homo sapiens
  misc_feature: GYAE6OF01CBOZ4.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagagactcaccatggaattgggctgagtcttggtttccttgttgcttattttagaagtgtcagagtgaggtagaagtggtggaggtcgggggagtcgttggtccgacgggccggggggtcctgagtacgtgtcctggtgaagtctcgtaggtatttgtatacgacaaggtagttacgttaggtattcggacgtacggttcgggggtacccgtaacccgtagtaccgtttaccggaagggtaaaacgggttccggtaggggtaagggttcggggtacgaacccgtaaaacgtaaaccgttaaaaaccgaaggtaagtaggtaaaggtttagtaaggtaaacgacgtaacgttaacggttcgggtaaccggttaccgttcgttaggggtaacgggaacggggtaccgttaacgtttaaccggaaaccttaaacgttccgttaacccgaagggttaaccgaacgaagggttacccgaaaccgttaaacgtacccggtttaggtttactaacgtttacgtaacgtaacgtaaagttaccggacgacccggtcgtaaagggaccgtaacgggaacccggttaagggaaccccgtcgggtaacctccgttttaaacctacgtttacgggtaccggttaccggtaaacccgggaccggttagttaccggtacccgggtttacctaacggttacgttcggtacgggttccccggtccgggttaacccccggggg

SEQ ID NO: 239710 - DNA, 718 bp, Homo sapiens
  misc_feature: GYAE6OF01BBQ3U.21.15.B04.1.454.CMB.1.raw
  modified_base (662)..(662): a, c, t, g, unknown or other
  misc_feature (662)..(662): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttgggtttccttgttgcttattttagaaggtgtccagagtgaggtgaagtggtggaggtcggggggagcttggtccaggtcccggggggtcctggacgctgtcctgtgtaagtctcgtggattgtatagcagagtagttggatgctacggtcgggtcccgccgagtacttcgaagggtaaggtccgtaggaggttgggtcgaccgaaactaactaaaaccgaagacgtagggtaagtcggtaacgaagacgtaacgtagtggtccggaccctttcggtagggtacgggtaaccggggtacccgtaatttaccgaaccgtaacttccccgtaacgaaggtaacgtacgtaacgttaccggaacctaacggtaaccgtttcggttacgttacttacgtagtaacccgtaaagttcgggaactacggtaccctagggacgtaccggaccggtacgaccggtacgtccgttacgttaccgttacgttacgtcggtacggtaccgtaaccgggttnttaccggtcggtaaccttcggtacgtagtttccggtcccggttccgggtacccggg

SEQ ID NO: 239711 - DNA, 572 bp, Homo sapiens
  misc_feature: GYAE6OF01AJXOR.21.15.B04.1.454.CMB.1.raw
  modified_base (343)..(343): a, c, t, g, unknown or other
  misc_feature (343)..(343): n is a, c, g, or t
  modified_base (377)..(377): a, c, t, g, unknown or other
  misc_feature (377)..(377): n is a, c, g, or t
  modified_base (533)..(533): a, c, t, g, unknown or other
  misc_feature (533)..(533): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcggggggaggcgttggtccgaggccgggggggtccctgagactgtcctgtgaagtctcgtggattgtatagcagagattggatgcacgtggtccgcagacttcgaaggaagggtctgggagtgggtggccaanaataaaccaagataggaagtgtagaagcacgtanggtggcctcgtggtggaggggccgtattccaactaatcctaccaaggacacgagtcgaccaaaggaccttcggttgtactcgtgactaagtggaacagccgtagaaggtcgaccggaacggacgaccggtctctcttatcgtgtcgccggacggtntacgtcgacgttacgtcagttcgtccggtcggtccgggg

SEQ ID NO: 239712 - DNA, 538 bp, Homo sapiens
  misc_feature: GYAE6OF01AMJHY.21.15.B04.1.454.CMB.1.raw
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctatttagaagtgtcagagtgagtgaaagtggtggaggtcgggggtaggcttggtccaggcccgggggggtccctggagactgtcctgtagagtctcgtggattgtatagcagagattggatgcacgtggccgcagacttgaggtaaggtctggagtgggtgccaanactaaacaagnaggaagtgaggaancactangtggcctgtggtggacgggtccgtattacacgtaatcgtacgagagacagtacgaccaaagacctcgttgtactcgacgcaagtcgatacgctaggacgtagccgtaagacgacgctctactattcgtagtcgacgtacgattaggcgcttacgctagtcgcgtcggtccggg

SEQ ID NO: 239713 - DNA, 756 bp, Homo sapiens
  misc_feature: GYAE6OF01AX691.21.15.B04.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcgttgggtttttccttgttgcttattttagaagtgtccagagtgaggtgaaagtggtggaggtcggggggagcgttggtccgagggcccggggggtccctgacgactgtcctgtgagtctcgtggtattgtatagacagagtagttggatggactacggtcgggtcccnccgagtaccgttacgaagggtaaagggtcgtagggtaggttggggtcggaacccaaagtaaactaaaaccgaaggtagtagggtaagtggtagaacgactaacgttagtcgggtacggtcctcgtacgggtcgggacggggtcctaacgttacaactactaccgtaccgaagacgtaacgtacggtaccgaaccgaaacgtacgtttcggttagtaaccgttaccgagtaaaccgtaaagtccgggtaaactacggtacccggtaggaaaccggtaccgggaaccgggtaaccggaccggtacccggttcttaacccgttaccgtttaacgttaccggttgggtcccgtaacccggggaacggttacgttacgggtaccggttaaccgttacggttaccgttaaggttcccggtccggttcccggggtaacccgggg

SEQ ID NO: 239714 - DNA, 838 bp, Homo sapiens
  misc_feature: GYAE6OF01AOTOM.21.15.B04.1.454.CMB.1.raw
  modified_base (729)..(729): a, c, t, g, unknown or other
  misc_feature (729)..(729): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctggttttcctgtgctatttagagtgtccagagtgaggtgaaaggtggtggaggtcggggggagcgttggtccgagggcccggggggtccctggacgacgtgtccgtgtgaacgttctcgtggtattgtaataggtacaggtagtagttggatcggcgtacggttcgggtcccgaccgaaggtacgtttacgaacggggtaaaggggttccgtaggggtaggtcggggttcgggaccctaaaacgtaacgtaaaaacccgaaggtacgttagggtaaaagttcggtaagggaacggtaccgtaaacgttgttacgggttacgggtcccctttaggttcgggtacggggtaaccgggggtccgttaaatttcccgtaacgttaaaccgtccgttacccggaaaggtaaaccggaaccgtaaacgggttacccgaaaccccgtaaaacgggtaaccctttaaccgggtttcgttaaacgttacgtaacggtaacgtaaaaggtacccgggaactaccgggttccccgtaaggaacgggaccggtacccggaacggacccgtacccggggacttaccggttnttaacccgtttacggttagggtccggtacgggaacccgggttagttaccggccgttaaccgttaccggttaccgtagttacccggtccccggttccgggtacccggggg

SEQ ID NO: 239715 - DNA, 892 bp, Homo sapiens
  misc_feature: GYAE6OF01B2UXO.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttggttttccttgttgctattttagaaggtgtccagagtgaggtgaaagtggtggaggtcgggggagtcgttggtccgacggccgggggtccctggagactgtccgtgtggtaagtcttcgtggtattgtattagctagagtagttggtagtcgcgaccgtgggtccccgaccgtacgtacgtttacgaacgggtaaaggggtcgttcggggaggttaggggtcggtacccgaaaacgtaaaccgttaaaaccgaaaggtaacgtaggtaaaggtaggttaaggaaacggtaccgtaacgtttaaagttcggttacggtacccgttcgtacgggttcgggaacggggtacccggtaacgttttacaaacccgttaaacgttcccgtaacccgtaacgggaaccgtaaccgtaacgggttaccggacccgtaaaacggtaacccgtttacgggttttacgttaacgttcgttacggaaacttaaaaccggtcgggtaaaccgaccggtacccgttaggggaaacggttaccgggaaccccgggtaaagggtaaccccggaaccgggttacccgttaacccgttttaaccggtttaaaccgttttaaacccggttggttaacccggggaacccgggttaacccgggtaacgtttaaggttaccccgggtttaacccggtttacccgttacggttaaaccgtttttccgggccccgggttttaaccccgggtaaccccgggggg

SEQ ID NO: 239716 - DNA, 524 bp, Homo sapiens
  misc_feature: GYAE6OF01AO7B8.21.15.B04.1.454.CMB.1.raw
  modified_base (376)..(376): a, c, t, g, unknown or other
  misc_feature (376)..(376): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattgggggctgagctgggttttccttgttgctattttagaaggtgtccagagtgaggtgaaagtgggtggagtcggggggaggcttggtccagccgggggggtccctgagactgtcctgtgaagtctctggattgatagcagagattggatgcactgggtccgccagacttcaggaaagggtctggagtgggtgccaacataaaccgaagatggaagtgtgaagcactatgtggcctntgtgaggggcattcacaatctcgagagacagtgcctaagaactcgttagtatctgacaagtggaacagccgtagagagccgaggaccgacggctctctaattacgtgtcgacgacggatcgtagctacgtctattcgcgtcgtcgggg

SEQ ID NO: 239717 - DNA, 644 bp, Homo sapiens
  misc_feature: GYAE6OF01D6GED.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcggggggagcttggtccaggccggggggtccctgagactgtcctgtgagtctctggattgtatgcagagattggatgcacgtgggtccgccagacttcgaagggaagggtctggaggtgggtcggaccaacaataaaccgaagatagggaagtgtagaagcactatcggtcggtcctcgtggtcggacggggtccgtagttccaacgtaacttccgtacccgaaggaacgaactaaggttcggaacccgaaaggtaaccgttccggtttagtacttaccgtaggtacctaaagttccggaacacggtccgtaggacgtacgaccggaggaccgacggtcctaccttacgttacttaccgtggtaccggacccggtaacggtagttacggcggttaccgttaacgtctagtttcggccggttccggtccgggggg

SEQ ID NO: 239718 - DNA, 797 bp, Homo sapiens
  misc_feature: GYAE6OF01CEXU4.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaagttggggctgagtcgttgggttttccttgttgcttattttagaaggtgtccagagtgaggtagaagtggtggaggtcgggggagcgttggtccgacgggccgggggggtccctggacgtacgtgtccttggtagaagttctcgtggtattgtagtagcagagtagttggatgcgtacggtcgggtcccgcacgtacgttacgaagggtaaacggtcgtagggtacggtggggtacgaccaaacgtaaacgtaaaaccgaaggtacgttagggaaaggttacggtaaggaaacgtcgtaacgttagttagggtcggtcccgttagttcgggtagggtaccggggtaccgtacgtttaccgaaaccgtaacgttcccgtaacccggaaggtaacgtacccggtaaggtcgaaaacccgtaaacgggttaacccgtttcggtttaaccggttaacgttacgtaacgtaaacgtaaaggttaccgggaaccgtaaccggtccggttaagggaacggtaacccggaccgggaacgaacccggtacgggtcccttaacgtaccgttaacgttacgttcggtaccggtacccggtaaacggtgttacggtaccggttacctaccggttacttaggttcccggtccgggtcccggtaacccggggg

SEQ ID NO: 239719 - DNA, 874 bp, Homo sapiens
  misc_feature: GYAE6OF01DW8VO.21.15.B04.1.454.CMB.1.raw
  modified_base (795)..(795): a, c, t, g, unknown or other
  misc_feature (795)..(795): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccagtggaagttggggctgagcgttgggttttccttgttgtcttattttagaaggtgtccagagtgaggtagaagtgggtggaggtcggggggagtcgttgggtccgagggtcccgggggggttccctggacgacgtcggtcctggtagtagtctcgtggtattgtatagcagagtattagatcgcgtacgtcgggtcccgacgtacgtaccttacggaagggtaacgggttcgtagggtagggtcggggtacgtaacccgaaaacgaaaacgtaaaaacccgaagtaacggttaaagggaacggttagggtaacggaaacggtacccgttaaacgttagttaacgggttccggttacccgttcgttaacggggtacgggaaacccgggggtaccgtttaacgtttaccgaaaccttaaaccgttccctaaaccggtaacgtaaacggaaccgtaacggttaccgaaacccggtaaaggttaacccgttttacgggtttaactaccgttacgttaactaacgttaaagtccggaacgtaccggttaccggtacggaacgggtaaccggtaccgggaaccggtacccggtaaccggttcctttaaccgttacgtttaaaccgtttcggaccgggttaacccgggtaaccggtaaacccgggtttntaaaccgggtttcccggaacggttttacccgacgttttacggtacccgggttccccgggttacccgggtaacccggggg

SEQ ID NO: 239720 - DNA, 803 bp, Homo sapiens
  misc_feature: GYAE6OF01DDA4Q.21.15.B04.1.454.CMB.1.raw
  modified_base (179)..(179): a, c, t, g, unknown or other
  misc_feature (179)..(179): n is a, c, g, or t
  modified_base (256)..(256): a, c, t, g, unknown or other
  misc_feature (256)..(256): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcgtggtttccttgtagctatttagaggtntcagagtgagtgaagtggtggagcgggggagcgttggtccgaggccgggggtccctagagacgtgtcctgtgaagtntcgtggtattgtagtagacgtagagtagtggatcgacacgtcgggtaccaccgaacgtccttacggaagggtaaaggtcgtagggtagttgggtacgaccaaacgactaaaaccgaagagtacggggtaagtcgtaacggaacgtaccgtaacgttagttcggtacggtacccgttaggttacgggtacgggaacggggtacccgttaacgtttaccggaactaaaccgttccccggttaaaccgacgggtaacgtaaccggtaacggttaccgggtaaacccgtaaacggttaaacccgtttccgggtttaaccggttaacgtacccggtttaaggaacctaaacggttcgggaaacgtaccggtaccctacgggtaaacgacccgggacccggttaacgggaaccccggtacgggtaccttacccgtaacgttaaccggtttacgacgggttacccggacccgggtaaaccggtttagtacccggttaagtacccgttacggtaccgtttaacggtcccggtccggttacccggggtacccgggg

SEQ ID NO: 239721 - DNA, 792 bp, Homo sapiens
  misc_feature: GYAE6OF01B2C1R.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggattggggctgagctgggttttccttgttgcttattttagaaggtgtccagagtgaggtgaagtggtggaggtcggggggagcttggtccgagggcccggggggtccctgagtactgtcctgtgagtctcgtggattgtatagcagagtagttggagtgccacgttcgggtacccgccagtaccgttccgaagggtaaacggggtcgtagggaggtggggtacggacccaaacgaaacgttaaaacccgaaggtacgtagggtaaaggttaggtaacggaaaggcctaacgttagttacgggtacgtacccgttgtgggttacggggaccgggggtaccgtaacgtttaccgaaccgtaattcccgtaccgaaggaacgtaaccgtaggttcgaacccgtaaacgttaaccgtttacggtttacgttaacttccgtacgtaacgtaaagttcgggaaccgtacggtacccgttagggaacggtaacccgggacccggtaaccgggtaacccgtaccggggttacccttaccgtttaccctttaaacgtttacccgttgggtaaccgggtacccgggtaaccggtacgtacgtttacgggaccgtttaccggtaccttaagggtttccggtccggttcccccgggtaacccgggggg

SEQ ID NO: 239722 - DNA, 887 bp, Homo sapiens
  misc_feature: GYAE6OF01CQV4R.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcacagtggaagttgggctgagtcgttggttttccgttgtgtcttagttttagaaggtgtccgagaggtagtaggtagaaggttggtagggagggtcggggggagtcgtttagggcccgacggggtcccggggggtacccttggacgtacgttcgtccgtaggtagtaacgttccgttggtaggttatttacggtaacttacggacgtaaggacggttagttcggagttcgaccgtacggttcgggccccgacgaacgttacgttacggaaacgggtaacggttcggagggttacgggtcggtacggtacccaaaagtaacgtaaaacgaaggtagtacggtaaagttggtaacgaagtaccgtacgtaacgtcgggtacggttcccttagggtacgggttaggggacccgggtacttaacgttacccgaaattacccgttcccgtaaacggacggtaaagtaaccccgtgtaacccgtaaaaccgtaacggttaccgtttacgggtttaactaacgtaacgttaacccggttaagtaaaaccggaccgggttacgaaaccccggttggaaccggtaacgggccggtaaaccgggaaccggaccgggttacccgttacttaacccgttacggtttaacccggttagtaccggggtaacccgtaaacccgggttaccgttaattacccgggtacggtttaacccgtaggtttaccgttaccggttcggggttaaacccggttcccggggttaaaccgggg

SEQ ID NO: 239723 - DNA, 701 bp, Homo sapiens
  misc_feature: GYAE6OF01A392K.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttgggttttccttgttgcttattttagaaggtgtccagagtgaggtgaaaggtggtgggaggtcggggggagtcgttggtccgagggcccgggggggtccctgagactgtcctgtgagtctcgtggattgtatagcagagtattggatgcctacggtcgggtacccgccaagtaccttcggaaagggtaaacggggttcgtaggggtagggtggggtacggacccaaacgaactaaaaccgaagtagtacggaagtggtagaagctaactagtgtcgtcctcgtggtagggacgggtcctagttaccaactaactcccgtacgaggtacgaacgtaggtacgaacgtaaacggttaccgttcgtttagtacttcacgtaacgtaaagtcggtaacacgacccgttaggaacggtaacggacccgggaacggaaccgtaccggtcctacgttaccgttacgttaacgtcggtacggacccggtacgggtaacttacggtccggtaccgttaccgttacgtaggttccggttccggtcccgggtacccgggg

SEQ ID NO: 239724 - DNA, 687 bp, Homo sapiens
  misc_feature: GYAE6OF01BJAJO.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcgttgggttttccttgttgctattttagaaggtgtccagagtgaggtgaaagtggtggaggtcgggggaggcgttggtccgaggccggggggtccctgagactgtcctgtgagtctcgtggattgtatagcagagtagttggagttgcgtacgtcggggtccgacccgaggtaacctttcggaaggggtaaacgggttcgtagggtacggttggggtacgggaaccaaacgtaaactaaaaaccaaggtaagtagggaaaggtggtagaagacaacgtagtggtcggccttacgtggtcggacggggtcctacgttcgaactaactccgtaccgaaggaacgacgtagttcgaaccgtaaacggtaccttcggttacgtatacgttagaacgtaacgtacggtacgtagacccgtaggacgtacggacccgaacggaccgacgtcctaccgttacgttacgtttacgtagtcggacccgtacggtaagtacgtacggacttacgttcgtacgtttcggcccgttccgggtaccgggg

SEQ ID NO: 239725 - DNA, 569 bp, Homo sapiens
  misc_feature: GYAE6OF01D7EWO.21.15.B04.1.454.CMB.1.raw
  modified_base (305)..(305): a, c, t, g, unknown or other
  misc_feature (305)..(305): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcggggggaggcgttggtccgaggccgggggggtccctgagacgtgtcctgtgaagtctctggattgtatagcagagattggatgcacgtggtccncagacttcgaggaagggtctggaggtgggtggaccaaacgaataaaaccgaagataggaagtgtagaagcactagtcggtcggcctacgtggtaggacggggtccgtattacaactaacgtactccgaagagaacgagtcgaccaaagtaactcgttagtatactgacaaatcggacacgcgtagacgtagacggagacgacgcttctctattctgtcgacggacggtatacgtggacgtacgtctattcgcgtcggtccgggg

SEQ ID NO: 239726 - DNA, 723 bp, Homo sapiens
  misc_feature: GYAE6OF01BCQUA.21.15.B04.1.454.CMB.1.raw
  modified_base (642)..(642): a, c, t, g, unknown or other
  misc_feature (642)..(642): n is a, c, g, or t
tcagtcgtcgctcgcacgaccggtgctcgatttagacagtatatatccgcgggaggtctcagagaggagccttagccctggactccaaggcctttccacttggtgatcagcactgagcacagaggactcaccatggaattgggctgagcttggttttccttgttgtcttattttagaaggtgtccagagtgaggtgaagtggtggaggtcgggggagcttggtccgagggccggggggtccctggagacgtgtcctggtgaagtctcgtggattgtatagcagtagattggatgcgacgtcggggtcccgaccgagtaccttacgaagggtaaacgggtcgtagggaggttggggtacgaccaaacgaactaaaaccgaagtagtaggaagtcgtagaagaccgtagtaagtcggtcggtcccttgttcgggtagggacggggaccgttaagttccaacgtaattccctacgaagggtaacgtaacgtaggttacccgaaccgtaaaagttaacccgttcggtttaagttacgttaccgttaaggtaacctaaaggttccgggaaccacgtacccggtagaacggtacggaacccggtaggaacccgtaccggtaccgttaccttaagttaacgtttaccgngggttccggaaccgtaaccgggttattacgggtcgacccgttaagttccaggttttacccgccggtcccggtacccggggg

SEQ ID NO: 239727 - DNA, 972 bp, Homo sapiens
  misc_feature: GYAE6OF01AYIAA.21.15.B04.1.454.CMB.1.raw
tcagtcgtcgctcgcacgaccggtgctcgatttagacagtatatatccgcggggaggtctcagagaggagccttagccctggactccaaggtccctttccacttggtgatcagcacgtgagcacagaggactcaccatggaagttggggctggagtcgtttgggtttttcccttggttgtactttattttaggaaggttgtaccagaggtgtaggtagaaaggtggtgggagggtcggggggagtccgtttgggtcccgacggggtccccggggggttaccctggacgtaccgttcggttccgtaggtaggtaacgttccgtcgttagggtaatttggtaacgttaacggcgtaaggtaaggttagtttacgggacgtggtacccgtacggttccgggggtaccccgaccgtaacgtaaccgtttacgaaaaggggtaaagggttagttagggacgggttgggtaccgaccccaaaacgtaaaacgtaaaaccggtaaggtaacggttagggtaaaggttaggtaacggaaaacggtaccgtaaaccgtttaggtttacgggttaccggtacccccgtttggttaccgggggttaaacgggggtaacccgggggtaccccttaagtttaacccgaaacttaacccgtttacccgaacccgtaaaggaaacggaacccttaaggggtaccccgtaaaacccgtaaaagggtttacccgtttttagggtttaaaccgtttacgtaacccgttacggtaaaacgtaaacgggtacgggtaaaccctccggttaacgaaccggggttaagggaaccccgggttaaccgggaacccgggaccgtaaccggttacccgtcctttaaacggttacgttttaacggccggttaacccgggacgttacggttaacgtacggtccgtacccggttaacgtaccgttagggtttcccggttccgggtcgggttaccccggggg

SEQ ID NO: 239728 - DNA, 803 bp, Homo sapiens
  misc_feature: GYAE6OF01B8ZWO.21.15.B04.1.454.CMB.1.raw
tcagtcgtcgctcgcacgaccggtgctcgatttagacagtatatatccgcgggggaggtctcagagaggagccttagccctggactccaaggcctttccacttggtgatcagcactgagcacagaggactcaccagtggaagttggggctgagtcgtgggttttccttgttagcttattttaaggaaggtcgtccagtagtgaggtgaaagtgggtgggagggtcggggggagtcgttgggtccgacggggtcccggggggggtccctggacggtaccgttcggtcccgttggtaggtaacgttcgttacggttagggtacttttaggtagtaagcgaaggtagtagtttagggaattggaccgtaccggttcgggggtcccgaccgtacggtacccgttacggaaacggggtaaaacggggttccggtagggggtagggttacgggggtcggaacccgaaaactaacggtaaaaaccgaaggtagtaaggggtaagttggtaaggaaactcgtaacgtagtggtacggtcctggtggtagggacggggtacctattccgaaactacttccgtaccgaagggtaacgtaaccgtaggtaccgaaaccgaaacggttaccgttacggtttacgtacttacgtaggaaaccgtaaaggtcgaacgtacggtaccgtaggaacggacggtaaccgggaacggtaccgaccgggtacttcctagttactttacggtgttccggaccgacggttaagttcgtacggtcccgttaagtcttaggttccgcgggttccgggtacccgggg

SEQ ID NO: 239729 - DNA, 701 bp, Homo sapiens
  misc_feature: GYAE6OF01B2TW2.21.15.B04.1.454.CMB.1.raw
  modified_base (281)..(281): a, c, t, g, unknown or other
  misc_feature (281)..(281): n is a, c, g, or t
  modified_base (333)..(333): a, c, t, g, unknown or other
  misc_feature (333)..(333): n is a, c, g, or t
  modified_base (400)..(400): a, c, t, g, unknown or other
  misc_feature (400)..(400): n is a, c, g, or t
  modified_base (448)..(448): a, c, t, g, unknown or other
  misc_feature (448)..(448): n is a, c, g, or t
  modified_base (555)..(555): a, c, t, g, unknown or other
  misc_feature (555)..(555): n is a, c, g, or t
tcagtcgtcgctcgcacgaccggtgctcgatttagacagtatatatccggcggggacggtctcgagagaggagccttacgcccgtggacctccgaaggccctttccacgttggtgacgtcagcacgtgagcacaggacgctccacatgatggggctgacgtcgttcgggttttcctcgttgtcttattttaaggaacggttgtacccaggtagtggtacggtagaaaggtgggtggacggtcggggggactcgttggtaccgacgggcccggggggttccnggaggtacctcggtccgtagttgacgttcgtcgtaggtgttaggtatacggnagaggtactttacggagtcgaccgtacgtcgggtccgaccagtacgtacggaaggtaggtcgtaggngtacggcgacaaactagtaaaaccgagactacggaagtgacgtaacgntaacgtagtcgcgtcgtcgtggacggtaggctatacgaacactccgacaggacgtaccaaggtcaacctaagacggttcttaccggattacacggaataacggaccncgacgtccgagaccggacccggttcgacgtacccggacgtcctacgtttacaccgttaacgttcggaccgacccgggttactaaaccgtgggtcccgtaacccgtgttacctacgggttcccgtccgggggtaaccccggtcgggg

SEQ ID NO: 239730 - DNA, 652 bp, Homo sapiens
  misc_feature: GYAE6OF01EUDB5.21.15.B04.1.454.CMB.1.raw
  modified_base (385)..(385): a, c, t, g, unknown or other
  misc_feature (385)..(385): n is a, c, g, or t
  modified_base (437)..(437): a, c, t, g, unknown or other
  misc_feature (437)..(437): n is a, c, g, or t
tcagtcgtcgctcgcacgaccggtgctcgatttagacagtatatatccgcgggaggtctcagagaggagccttagccctggactccaaggcctttccacttggtgatcagcactgagcacagagactcaccatggaagttgggcgtgagcgttggttttcgttgttgtcttatttagtaagtgtcagagtgaggtagaagtggtggtaggtcggggaggtcgttgtccgacggccgggggtcccgtcgagtacgtcgtcgtgtgtagtctcgtgtgttgtagtagagagagtagttagtagtgtacgtacgtggtccgccgtagtaccgttacgaaggaaggtcgtggaaggttgggtggtaccgaacgaagtaaaaccgaaagnaataggtaaagtagtagaagtacgacgtagtagtaggtaccgtcgtaggtcnggtaagggtccgtagttactaacgtaaacgtactaccgtacgtaacgaacgtacgtacgtaccgtaacgtaacgtacgttagtagtacgtacgtacgtaagtaggacgtagaccgtacgacgaagaccgacggaaccgtaaccggtaccgttacgttaccttacgttaacgttacgtacgtaccggtaaccggtaagttacgttaggtcgtaccg

SEQ ID NO: 239731 - DNA, 784 bp, Homo sapiens
  misc_feature: GYAE6OF01AZVS4.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaagttgggctgagcttgggttttccttgttgcttattttagagtgtccagagtgaggtgaaagtggtggaggtcgggggagtcgttggtccgagggcccgggggggtcctggagtacgtcgtcctgtgaacgtctcgtggtattgtatagcgaagagtagttggatacgctacggtcgggtcccgccgaggtacctttacgaacgggtaacgggtcgtgggaggtcgggtcggacccaaataaacgtaaaaccgaagtaaggtaggtaaacgtggtaacggaaacgcgtaacgttacgtggtacgtacccttcggttggtacggacggggtaccctacgttacaaccgtaaatcccgtaccgaaggtaccgaacgtacgtacgaacccgtaaagtaaccgttcgtttaaggttacgtacgttacggaacttaaacggtacggtaaccgtacggtaaccgtacggaacggaacccggtacccgaacgggtaacccggtaccggtaccttaacccggttaccgtttaaacgtttaccggttacggggtaccttacccggggaaaccggtttacgttaccggttaccggtacccggtttacggttaccgtttaacgggttccggtcccgggttcccggggtaacccgggg

SEQ ID NO: 239732 - DNA, 705 bp, Homo sapiens
  misc_feature: GYAE6OF01A71EJ.21.15.B04.1.454.CMB.1.raw
  modified_base (308)..(308): a, c, t, g, unknown or other
  misc_feature (308)..(308): n is a, c, g, or t
tcagtcgtcgctcgcacgaccggtgctcgattttagacagtatatatccgcggggaggtctcagagaggagccttagccctggactccaaggcctttccacttggtgatcagcactgagcacagaggactcaccatggaagttggggctgagtcgttgggttttccttgttgcttattttagaaggtgtccagagtgaggtagaaaggtggtggaggtcggggggagtcgttggtccgagggcccggggggtcctgacgtactcgtccgtgtgagtctcgtggtattgtaatagcgagagtagttggntcgcgtacgtcgggcccacgagtaccgttacgaagggtaaacggtcggtagggtagggtgggtacgacccaaacgtaactaaaaccgaagtacgtagggtaagtggtagaagactacgttagtcggtacgtcctggtggtacgggaggtacctatacaactacgttccgacaggacgacgtagtcgaaccgtaactcgttgttagtactaccgagtaacgtaagtcggaataaccgtcggtaacggaggtaacccggtacggacggaacccgtaccgttaccttcgttaacttaacgtttccggaacggttacggtacccggaagggttcttaacgggtccgttaaccgttaccggtacgttacggtacccgttcccgggtaccgggtaacccgggg

SEQ ID NO: 239733 - DNA, 790 bp, Homo sapiens
  misc_feature: GYAE6OF01ARJCN.21.15.B04.1.454.CMB.1.raw
  modified_base (190)..(190): a, c, t, g, unknown or other
  misc_feature (190)..(190): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttgggttttccttgttgcttattttagaaggtgtccagngtgaggtgaaagtggtggaggtcggggggagcgttggtccgaggccggggggtcctgagacgtgtcctgtgagtctcgtggtattgtatgcagtagtagttggatgcgtacgttcggccgtccgacgtacgttacgaagggtaaacgggtcgtagggtagggtcgggttcggacccaaacgtaaacgtaaaaccggaagaagtaggggtaaacgttggaacgtaaaggcctaaacgtttaagtcgggttacggtccttacggttggttacggggaccgggggtaccgtacgtttaccgaaccttaacgttccctacggtaaggaacggtaacgtaacggttaccgaaccccgtaaaaggtaacccgtttacggtttaagtacgttaccgtaaggaaacgtaaacgttaccgggaaccacggtacccggttaaggaacgggaaccgtaccgggaaccggaaccgtaccggtcctaccgtttacttaaacggttaccgttcgggtcgaacccggggttaaacgtacgggtaacgtttcccggttacggtttaaccgttactttaccggtcgggttccccggttacccggggtacccgggggg

SEQ ID NO: 239734 - DNA, 921 bp, Homo sapiens
  misc_feature: GYAE6OF01CA48M.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccagtggaagttggggctggagtcgttcgggttttccttgttgtctttaagttttaaggaaggttcgtccaggtagtaggaggtaggtaaaggtgggtgggacgggtcggggggtagtcgttcgggtaccgacggggtcccgggggggttccctaggacgtacgtcggtccgttggtacggtacgttcgtcggttaggtacgtttagtattacgcgtaaggagtagttaggacgtcgaccgtacggtcgggtccccgacgaacggtacgttacggaacgggtaacgggtcgtaggggtaggtcggggtacgaacccgaaactaacgtaaaaccggtaagaggttaacgggtaaggttggaacggaagtaccgtacgtttaaggttaccgggtccggttaccttagggttacgggtcgggtaaccgggtaccgtacgttaaccgaaccgttaaccttcccggtaacgtacgaaacggtaccggtaacgtaaccggaccgtaaaacggtttaccgtttaccgggttaattacgttaccggtaacgaaacgtaacgggttaccgggtaaccgacgggtttaccgaaggtaacgggttaacccggggaaccggttaacggtaacccgggtacccggttaccctttaaccggtttaccgtaaaaccggtttacgggtccggttaaccgggtacccgggtaaacggtttacgttaccgggtaacgtttaacccggttacccggttagtttaccccggggttcggttaccccggggttccgggtaaaccccgggggg

SEQ ID NO: 239735 - DNA, 818 bp, Homo sapiens
  misc_feature: GYAE6OF01BH4T2.21.15.B04.1.454.CMB.1.raw
  modified_base (702)..(702): a, c, t, g, unknown or other
  misc_feature (702)..(702): n is a, c, g, or t
  modified_base (713)..(713): a, c, t, g, unknown or other
  misc_feature (713)..(713): n is a, c, g, or t
  modified_base (772)..(772): a, c, t, g, unknown or other
  misc_feature (772)..(772): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaagtttggggctggagtcgtttcggggtttttcccttggttcgtctttaagtttttaaggaaagggtttgtaccctaaggtaggttggtaagggttaggtaaaacggttggggttaggggtacgggggttacggggggggaggttcggtttcgggtaccggaacgggggtcccccggggggggttacccctggtaacggtccgttcggtccgttaggtaggtaacgttcttcggtggtagtttgtaagttacggactaaggtacgtaaggtttggacgttacggccgttaccgggttccgggtcccgtaccgtaacggttaccggttacgggaacggggtaacggggttcgtaaggggtgggttacgggtaccgaaccaaagtaaccgtaaaacgacgtaggtagggaacgtgtagacgtccgtaagtagtccggtcgtccgtaggtggtcgggtacggacgtactttcgaacttacgttacccagtaaggtacgacgttacgccgaaaccgtaaacgttccttaggttacctcgttacgcgtaaacgttaagccggaaccgtanacgggtaacgnggtacccggacggttacgcgtaccgttcgtacttgtaaccgtcgtaggccgtaccgagngttagccgtaacttcgtaacgtcgtcggtcccggtcgaccccgggg

SEQ ID NO: 239736 - DNA, 672 bp, Homo sapiens
  misc_feature: GYAE6OF01AEWGD.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgcttattttagaaggtgtccagagtgaggtgaaagtggtgggaggtcggggggaggcgttgggtcccgagggcccggggggggtccctggagactgtccgtgtggaagtctcgtggattgtatagcagagtattggatgcctacgtccgggtcccccagtaccttcgagggaaacggtcgtgggaggtgggtggaccaacaataaaccgaagagtaggaagtgtagaagcactagtggcgtcctcgtggtcgggacggggtccgtattcaactaactcctaccgagacgacagtcgaccgtaagtaactcgttacgtactcgtacgactaaagtcggaactacgccgtaggacggacggacccgggaacggaccgtaccgggtccttaccgttacttaacgtttacgttacggtacggtacccggtaaccggtaaggtttcgacggtccgtttaacggttccgtacgtttacggtcccgggttcccgggtcgggggtaaccccggg

SEQ ID NO: 239737 - DNA, 758 bp, Homo sapiens
  misc_feature: GYAE6OF01C7WID.21.15.B04.1.454.CMB.1.raw
  modified_base (121)..(121): a, c, t, g, unknown or other
  misc_feature (121)..(121): n is a, c, g, or t
  modified_base (168)..(168): a, c, t, g, unknown or other
  misc_feature (168)..(168): n is a, c, g, or t
tcagtcgtcgctcgcacgaccggtgctcgatttagacagtatatatccgcggggaggtctcagagaggagccttagccctggactccaaggcctttccacttggtgatcagcactgagcanagaggactcaccataggaagttgggctgagcgttggtttcttgttgnttatttagaggtgtcagagtgaggtagaaaggtggtgggagggtcgggggagtcgttggtccgacggggtcccggggggtcctggagtcgtgtccgtgtagaacttcgtgtgtattgtatagagagagtagtcggatcgcgtacggtcgggtacccgcgaacgtacgttacggaagggtaaacggttcggtagggtacggtcggggtacgaaccctaaacgtaaacgaaaacgaaggtaggtacgggtaagtacggtaacgtaagacctaagtattcgggtcgtccgttagcgggttacggggacgggtaccctattaaccgaacgttaacggttaccacggaaagaaccgtaactaacggttaccgaaaccgtaaacggtttaaccgttggtttaagttactaccgttaagaaacgtaaacggcggtaaccgtaggacccgtaggaaacccgcgggtttacccaaggtaaccccgtgtacctttcgttaaaccttgttacggacggccgaaaccgggttacaaggttacgtacccgtaccgttttacgtaccgttgtttacccgggacccggtccccggggttacgggg

SEQ ID NO: 239738 - DNA, 704 bp, Homo sapiens
  misc_feature: GYAE6OF01CTETQ.21.15.B04.1.454.CMB.1.raw
  modified_base (243)..(243): a, c, t, g, unknown or other
  misc_feature (243)..(243): n is a, c, g, or t
  modified_base (300)..(300): a, c, t, g, unknown or other
  misc_feature (300)..(300): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttcctgttgctattttagaaggtgtccagagtgaggtgaaagtggtggagtcggggggagcttggtccaggccggggggtccctgngactgtcctgtgaagtctctggattgtatagcagagattggatgcacgtgggtcccncaggacttcgaggaagggtctagggaggtgggtaggaccctaaacgacgtaaaaccaaggtaagtaggaacgtagtagaaacggtctaacgtaattcggtacggccccttgtagggtcggtaacggggggtccctaaagtttcccgaaaccgaaactttcccgtaacccgaaaggtaacgaaaccccgtaggttaccggaacccgtaaacggtaaacccgttcggtttacgttaaacgtccttaagggacctaaaagtcgggaacacgacccgttggaacgacggccccggaaagggacccgtaccgggacttccgtacttaacgttacgtcggttacggaccgtaaccggtataccggtggtaccgttacgctaatttcgggaccgttcccgggtaacggggg

SEQ ID NO: 239739 - DNA, 908 bp, Homo sapiens
  misc_feature: GYAE6OF01B61ZE.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacgagagacctacacagtaggaagttgggctgagtcgtttcgggttttccttgttagtactttagtttagaggtcgtccaggtagtaggaggtagaaggtgggtgggtacgggtacggggggtagtcgttcgggtacccggaccgggggtcccggggggtaccctaggacggtaccgttcggttccgtggtaggtacgttcgttacgtaggttagtttagtaacgtagacgtaaggtagttaggttaggtacgtacggtaccgtaccgggtccgggtacccgtaccgtaaccgtaacgttaccggtaaaggggtaaccgggttcggtaggggttacgggtacgggtaaccgaaacccgtaaaacgtaaaccgtaaaaccgtaaggtaaggttaaaccggggtaaggttaacggtaacggaaacgttacccgttaacgttacggttcggtccggttaccggtttacggtacggggtacggggtaacccggggtaccttaacgttaacccgtaaaccgtacccgtaacccgtaacggaacgtacggtaaccgtaaccgtacggtaaaccgaacgttaccgttacggttaacgttacgtacgtaacggtaacgtaacggtacgtaaccgtcggtaaccggtacggtaaccggtacggggacccgtaaccggaccgtaccggttaccgttacctacgttaaccgttacgtaccgggtacgtaccggtaaccggtacgtacggtacgtaccgttacgtacggtacggttcccggtaccgggtacgggtccccgg

SEQ ID NO: 239740 - DNA, 716 bp, Homo sapiens
  misc_feature: GYAE6OF01DVM3W.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattgggctgagtcgttgggttttccttgttgtcttatttagaaggtgtcagagtgaggtgaaaggtggtggaggtcgggggagtcgttggtccgagggcccggggggtccctgacgtcgtcgtccgtgtgtaagtctcgtggtattgtatagcaggagtagttggatgcgcgtcgggtccgcgagtacttacgaagggtaagggtcgtgggtagggtgggtacgaaccaaacgtaaacgtaaaaccgaagtaagtaggtaagttggtaagaacgtacgtaacgtaggttacggtcggtccgtcggttgggtacggggtaacggggacccttaacggttacccaaacgttaacgttaccccgtacccgtaaagggaccaacgtaccggttagaaacccgtaaacggtaaccgtttaccggtttagtatttaccgtgtaaactaagtacggactaacggtaccgtaggaacggacggtaccgaacgggtacgaccggtcctacgttcgttacctttagtcggtaacgccggacgttacgtagtcgtaactcgtactaggtcccgtcggtccggtaccggg

SEQ ID NO: 239741 - DNA, 779 bp, Homo sapiens
  misc_feature: GYAE6OF01DJ81U.21.15.B04.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagacagtatatatccgcggggaggtctcagagaggagccttagcccctggactccaaggcctttccacttggtgatcagcactgagcacagaggactccaccatggaagttggggctgagccgttgggttttccttgttgcttatttagaaggtgtcagagtgaggtagaaagtgggnggagggtcggggggagtcgttcggtccgacggggtcccgggggggttccctggaacgtacgttcggtcccgtgtaggtaacgtcgtccgtgggtaacttggtatagacgagagtattgggatcgactacggtcgggtccgactaggtactacggaagggtaaggtcgtgggtaggtggtaccggaacaaaccgtaacgaaaccgaaggacgtaggtagttacgaggtaacacgttactacggttcggacggtttcccgtggttacgggtacgggacggggtaccgtacgttacctaacggtacctccgtaaccgtaggaaccgtagtaacggtaccgaaaccgtaaacgttaccgtttacggtttattacgttaccggttacgaaagtaacggttacgcggttaaaccgccggtaggaccggtacgaacccgggcgttaaccggcggtactacccgtttagtaacccttgttaccgggacgtaccggggtaacgttacgtacgggtccggttaaccgttacccgtacgttacggttaccggtccgggttaccggggttaccccggggg

SEQ ID NO: 239742 - DNA, 786 bp, Homo sapiens
  misc_feature: GYAE6OF01C5HKD.21.15.B04.1.454.CMB.1.raw
tcagtcgtcgctcgcacgaccggtgctcgatttagacagtatatatccggcggggaggtctcagagaggagccttacgccctggactccaaggcctttccacttggtgatcagcactgagcacagagactcaccagtggaagttggggctgagtcgttggggttttccttgttcgtacttattttaaggaaggttcgtaccaaggtagtggtaggtaggaaaggtgggtgggacgggtcggggggagtcgttcgggtccgacggggtcccggggggtccctggtacgtacgttcggttccttggtacggaacgttcgtacggtaggttattcggtaagtacggacgtaaggtaagtagttacggaatcggaccgtcggtacggggtccctaccgtaacgtaacgttacgggaaagggtaaacgggttcgtagggtacgggtcgggtacgaaccaaacgtaacgtaaaccgaagtacggtaggtaagtggtaacgaacgcgtaagttagtcggtaccgtccgttcggtacggtacggggtacgggtaccctaattaccgaacctactcccgtacggaaggtaaccgacgtacggtaccgtaaccgtaaaggttccgtttgttacgttgaccctaggaaactaacggtcgtaacgccgtagtacggtacggacgacgggtaacggactccggtctacccgttacaccgtttagcggtaaccgtaccggtaacgtacgttacgtcgacccttacgtacgtccgttacggccgggtcccggtacccgggg

SEQ ID NO: 239743 - DNA, 859 bp, Homo sapiens
  misc_feature: GYAE6OF01DNHGA.21.15.B04.1.454.CMB.1.raw
  modified_base (819)..(819): a, c, t, g, unknown or other
  misc_feature (819)..(819): n is a, c, g, or t
tcagtcgtcgctcgcacgaccggtgctcgatttagacagtatatatccgcggggaggtctcagagaggagccttagccctggactccaaggcctttccacttggtgatcagcactgagcacagagactcaccatggaagttgggctgagtcgttgggttttcctttgttgtactttaagttttaaggaaggttcgtaccaggtagtggtaggtaggtaaaggtgggtagggagggtcggggggagtcgttgggtcccggacggggtcccgggggggttcctggacgtaccgttcggttaccgtggtaggaacgttcgttacggtaggttactttggtaagtaggacgaaggtagttagttggtagtccggtacgtaccgggttcgggtacccgcgtaacggtaccgttacgggaaagggtaacgggtcgtggggtaggttcgggtacgaacccaaacgtaaactaaaaccggtaagtaacgtaggggtaagttacggaagaaacgtacgtaacgtttacgtacgggtccggtacccgttacgggttcggtaacgggggtacccgggtaaccggtttaacttaacccgtaaccggttaaccttaccccggtaacccggaaggttaaacccgtacgtaaacgggtacccggaaaacggttaaacccgtacgtttaacggtttaccggttaacttaccgggtaacgtaaaggtaaccgtacgaacggtccgtacggtaaccggtacgggaccgtaaccggggacgtaacccgggtaccgttcttaccgttacttaaccggttgtacggtccgtaagacggtntacgtcgtacgttactcgtacgtcgccggtcggtaccggg

SEQ ID NO: 239744 - DNA, 880 bp, Homo sapiens
  misc_feature: GYAE6OF01CA2S3.21.15.B04.1.454.CMB.1.raw
  modified_base (437)..(437): a, c, t, g, unknown or other
  misc_feature (437)..(437): n is a, c, g, or t
  modified_base (489)..(489): a, c, t, g, unknown or other
  misc_feature (489)..(489): n is a, c, g, or t
tcagtcgtcgctcgcacgaccggtgctcgatttagacagtatatatcccgcgggggaggtctcagagaggagccttagccctggactccaaggcctttccacttggtgatcagcactgagcacagaggactcacatggaagttggggctggagtcgtttgggtttttccttggttgtactttaagtttttaggaagggttcgtacccgtaggaggttaggaagggtaaggtaaaagggttcgggtaggggtacggggtcggggggggatcggtttcgggacccggaacgggggtcccggggggggttaccctggaacggtcgttacggttcccgttaggtaaggtaaacgttccgttacggtagggttaatttacgtaagttacggagtaaggaaggtagtttagggacttaccggagtaccggtttccgggaaccncccgtaagtacccgttaggaaggtaacggttggtagggagggtacggggtanaacccctaaaagtaaacctaaaacggtaagagttaaggggtaagttacggaagttaaaacggccttaagggtaagtttccggtaacggggtcccttaggtacggggttaacgggaccccggggtacttaacgtaccgtaaacgtaacctcggttaaccgaacggaagtacccgaaggttaacccggaaacgttaaaccgtaaccgtttaggttaacgtaacgttcccgttaaagacggtaaaaccggtgtaacgaaccggtacgtaggaaacccgtagggacccgggttaaggaacccgtacgtaacccttcaaccgttttataccgtagtacccggaacgtacggattaacggtcgagtacggtagtatccgggtcgtcggtaaccgggg

SEQ ID NO: 239745 - DNA, 832 bp, Homo sapiens
  misc_feature: GYAE6OF01ECYMZ.21.15.B04.1.454.CMB.1.raw
tcagtcgtcgctcgcacgaccggtgctcgatttagacagtatatatccgcggggaggtctcagagaggagccttagccctggactccaaggccctttccacgttggtgatcagcactgagcacagagactcaccatggaattgggctgagcgttgggttttccttgttgcttattttagaggtgtccagagtgaggtgaaagtggtaggagggtcgggggagtcgttggtccgacgggtcccggggggtccctggacgtacgtcggtcctggtacgtaagtctcgtggtattgtactagcaggagtagttggagttcgcctacggtccgggtcccgacgtaacggtaccgttacggaaaggggtaaacgggttcggtagggtacgggttcggggtaccggaacccgtaaacgtaaacgtaaaacccggaaggtaacggtagggtaaacggttaggtaagaacggtaccgtaacgttagttacgggttccggtacccttacgggtacgggtacggggtaaccgggggtacccttaacgtttacccgaaccgttaaccgtttccccggttaaaccggaagggaaaccgtaaccccggtaagggtaccccggaaaccgtaaaacggtttaacccggttttcggttttaaagtaccgtttacgtaacggtaaacgttaaaacggtcccggtaacgtaacccggtaccgtaaggaccgggaacgggtacccggaacggaccgtaccggttccttacgttacgttacttacggtcggtacgtaccggtaacgtgtaccgtcgtacgttactcgttacgtcgtccggcgggtacccggg

SEQ ID NO: 239746 - DNA, 708 bp, Homo sapiens
  misc_feature: GYAE6OF01DUBPY.21.15.B04.1.454.CMB.1.raw
  modified_base (616)..(616): a, c, t, g, unknown or other
  misc_feature (616)..(616): n is a, c, g, or t
tcagtcgtcgctcgcacgaccggtgctcgatttagacagtatatatccgcgggggaggtctcagagaggagccttagccctggactccaaggcctttccacttggtgatcagcactgagcacagaggactcaccatggaattggggctgagcttgggttttccttgttgcttattttagaaggtgtcagagtgaggtgaaagtggtgggaggtcggggggaggtcgttggtccgacgggtcccggggggtccctggagtacctgtccgtggtgtaagtctctggtattgtatagacaggagtagttggatcgcgtaccggttcgggtcccgccgaaggtaccgttcggaaggggtaaacgggtcggtggggtaagggtcggggtacggtaaccgaaacgtaaacgtaaaccgaacggtaaggtacgggtaagttaggtaagaacggtaccgtacgttaagtcggtcggtccgtacggttgggtacgggtacggggtacccgtattaccgactaacgtcccgtaacgagacgtacaggtccaaccgtaacgtacgttcgttagtactcgtagaacgtaaggcgtacgcgtacgtacggaagccggtacggacgaacnccggtcttactcgttactacggttcggacggtaccggacgttagtacgtcgtaccttacgttactgttcccgggtcggtcccgggtaccggg

SEQ ID NO: 239747 - DNA, 531 bp, Homo sapiens
  misc_feature: GYAE6OF02HPF5S.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccgggggggtccctgagactgtcctgtgaagtctctggattgtatagcagagattggatgcactggggtccgccagacttcagggaaagggtctggagtgggtggccaacataaaccaagatgggaagtgtagaagcactatgtaggcctcgtgtggagggggccgattcacaatctaccagagacagtgccaagaactcgttgtatctgactaaatggacagcctagagacgccgaggacacggctctctattactgtcgcgaccggtatagtggctacgtctagttgcgtccgtcgggg

SEQ ID NO: 239748 - DNA, 517 bp, Homo sapiens
  misc_feature: GYAE6OF02H62LN.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccagccggggggtccctgagactgtcctgtgaagtctctggattgtatagcagagattggatgcactgggtccgccagacttcaggaaagggtctggagtgggtgccaacataaaccaagatggaagtgtagaagcactatgtggcctctgtgaggggccgattcacaatctccagagacagtgaccaagaactcgttgtatctgcaaatggacagcctgagaggccgaggacacggctacgtctattactgtcgcgaccggatacgtgctacgtccattcgcgtctcgggg

SEQ ID NO: 239749 - DNA, 510 bp, Homo sapiens
  misc_feature: GYAE6OF02FYP7M.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggaggcttggtccagccggggggtccctgagactgtcctgtgaagtctctggattgtatagcagagattggatgcactggggtccgccagacttcaggaaagggtctgggagtggggtggccaacataaaccaagatggaagtgtgaagcactatgtggcctctgtgaggggccattcacaatctccagagacagtgaccaagaactcgttgtatctgcaaatggacagcctgagagccgaggacacggctctctattactgtgccgacggatatggctacgtcatgcgtcgtcggg

SEQ ID NO: 239750 - DNA, 512 bp, Homo sapiens
  misc_feature: GYAE6OF02FYO02.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccagccgggggggtccctgagactgtcctgtgaagtctctggattgtatagcagagattggatgcactgggtccgccagacttcaggaaagggtctggagtgggtggccaacataaaccaagatggaagtgtgaagcactatgtggctctgtgaggggccattcacaatctccagagacagtgaccaagaactcgttgtattctgcaaatggacagcctgagagccgaggacacggctctctattactgtcgcgaccggatagtggctacgtcattgcgtctcgggg

SEQ ID NO: 239751 - DNA, 522 bp, Homo sapiens
  misc_feature: GYAE6OF02FVMNW.21.15.B04.1.454.CMB.1.raw
  modified_base (322)..(322): a, c, t, g, unknown or other
  misc_feature (322)..(322): n is a, c, g, or t
  modified_base (337)..(337): a, c, t, g, unknown or other
  misc_feature (337)..(337): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccagccgggggggtccctgagactgtcctgtgaagtctctggattgtatagcagagattggatgcacgtgggtccgccagacttcaggaaagggtcnggagtgggtgccaanataaaccaagatggaagtgagaagcatatggtggctctgtggaggggcctattcacaaactctaccagagacagtcgaccaagaacctcgttgtattctgacaaatggaacagcctgagagccgaggacacggctcgtctatactggtcgcgaccggatagtggctacgtcatcgcgtctcgggg

SEQ ID NO: 239752 - DNA, 518 bp, Homo sapiens
  misc_feature: GYAE6OF02JIABK.21.15.B04.1.454.CMB.1.raw
  modified_base (338)..(338): a, c, t, g, unknown or other
  misc_feature (338)..(338): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccgggggggtccctgagactgtcctgtgaagtctctggattgtatagcagagattggatgcactgggtccgccagacttcaggaaagggtctggagtgggtggccaanataaaccagatggaagtgtgaagcactatgtggcctctgtgaggggcattcacaatctccagagacagtgccaagactcgttgtatctgcaaatggacagccgtgagagaccggagacgacggctctctattactgtcggcgaccggatagtggctacgtctagttcgcgtccgtcgggg

SEQ ID NO: 239753 - DNA, 519 bp, Homo sapiens
  misc_feature: GYAE6OF02GQ6JI.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccagccgggggggtccctgagactgtcctgtgaagtctctggattgtatagcagagattggatgcactgggtccgccagacttcaggaaagggtctggagtgggtggccaacataaaccaagatggaagtgtgaagcactatgtggcctctgtgaggggccgattcacaatctccagagacagtgccaagaactcgttgtatctgacaaatggacagcctggagaggccgagggacacggctctctattactgtgcgaccggatacgtggctacgtcagttgcgtccgtcgggg

SEQ ID NO: 239754 - DNA, 513 bp, Homo sapiens
  misc_feature: GYAE6OF02HJWZ9.21.15.B04.1.454.CMB.1.raw
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (485)..(485): a, c, t, g, unknown or other
  misc_feature (485)..(485): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggagcttggtccagccggggggtcctgagactgtcctgtgagtctctggattgtatagcagagattggatgcacgtgggtccgcagacttcgaggaaagggtctggagtgggtgccaacataaaccaagatggaagtgtagaagcactangtggcctntgtggagggcattcacaatctccagagacagtgaccaagactcgttagtatctgcaaatggacagcctgagagccgagaccacggctcgtctattactgtgaccgacggatagnggtctacgtcagttcgcgtccgtcgggg

SEQ ID NO: 239755 - DNA, 517 bp, Homo sapiens
  misc_feature: GYAE6OF02HM3O9.21.15.B04.1.454.CMB.1.raw
  modified_base (375)..(375): a, c, t, g, unknown or other
  misc_feature (375)..(375): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcgtgggttttccgttgttagctattttagaaggtgtccagagtgaggtgaaagtggtggagtcgggggagcttggtccagccggggggtccctgagactgtcctgtgaagtctctggattgtatagcagagattggatgcactgggtccgcagacttcgaggaaagggtctggagtgggtggccaacataaaccaagatggaagtgtgaagcactatgtggcctntgtggaggggccattcacaatctccagagacagtgaccaaagactcgttgtatctgacaaatggacagcctgagagcgagacacggctctctattactggtgcgacggatagtggtctacgtctagttcgcgtccgtcgggg

SEQ ID NO: 239756 - DNA, 514 bp, Homo sapiens
  misc_feature: GYAE6OF02FFZI2.21.15.B04.1.454.CMB.1.raw
  modified_base (429)..(429): a, c, t, g, unknown or other
  misc_feature (429)..(429): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccagccggggggtccctgagactgtcctgtgaagtctctggattgtatagcagagattggatgcactgggtccgccagacttcaggaaagggtctggagtgggtggccaacataaaaccaagatggaagtgtgaagcactatgtggcctctgtgaggggccgattcacaatctccagagacagtgccaagaactcgttgtatcngcaaatggacagcctgagagcgagacacggctctctatactgtcgcgaccggatagtggctacgtcagttcgcgttccgtcgggg

SEQ ID NO: 239757 - DNA, 516 bp, Homo sapiens
  misc_feature: GYAE6OF02FJXWA.21.15.B04.1.454.CMB.1.raw
  modified_base (376)..(376): a, c, t, g, unknown or other
  misc_feature (376)..(376): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccagccggggggtccctgagactgtcctgtgaagtctctggattgtatagcagagattggatgcactgggtccgccagacttcgaggaaagggtctggagtgggtggccaacataaaccagatggaaagtgtagaagcactatgtggcctntgtgaggggccattcacaatctccagagacagtcgccaaagactcgttgtatctgacaaatggacagcctgagagcgagacacggctctctattactgtgcgaccggatacgtggctacgtctagttgccgtcgtcgggg

SEQ ID NO: 239758 - DNA, 577 bp, Homo sapiens
  misc_feature: GYAE6OF02IYAWO.21.15.B04.1.454.CMB.1.raw
  modified_base (298)..(298): a, c, t, g, unknown or other
  misc_feature (298)..(298): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggtttccttgttgctattttagaaggtgtccagagtgaggtgaaagtggtggagtcgggggaggcttggtccaggccggggggtccctgagactgtcctgtgaagtctctggattgtatagcagagattggatgcactgggtccncagacttcgaggaaagggtctagggagtggggtggccaaacgataaaaccgaagatggaagtgtagaagcaactatggtaggcctctggtggacgggggcccgtagtttaccacgtaaatcgtacccaaggacgactagtcgacccaaagaacgttcgttagtatcgtagacaaagtgaacgagacctgagacgcgaggacgaggacctgtacctagttaaccgtggtgaccggaccgtatacgtggacctacgttcagttcgtacggtccgtacgggg

SEQ ID NO: 239759 - DNA, 515 bp, Homo sapiens
  misc_feature: GYAE6OF02IEB3F.21.15.B04.1.454.CMB.1.raw
  modified_base (368)..(368): a, c, t, g, unknown or other
  misc_feature (368)..(368): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccagccgggggggtccctgagactgtcctgtgaagtctctggattgtatagcagagattggatgcactgggtcgccagacttcaggaaagggtctggagtgggtggccaacataaaccaagatggaagtgtgaagcactatgnggcctctgtgaggggccgattcacaatctccagagacagtgaccaagaactcgttgtatctgcaaatggacagcctgagagccgaggacacggctctctattactgtcgcgacggactagtcggctacgtcattgccgtcgtcgggg

SEQ ID NO: 239760 - DNA, 523 bp, Homo sapiens
  misc_feature: GYAE6OF02JCTZ6.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggaggcttggtccagccggggggtccctgagactgtcctgtgaagtctctggattgtatagcagagattggatgcactgggtccgccagacttcaggaaagggtctggagtgggtggccaacataaaccaagatggaagtgtgaagcactatgtggcctctgtggagggccgattcacaatctcagagacagtgccaagaactcgttgtatctgacaaatggaacagcctgagagaccgaggacacggctctactattactgtggccgaccggatagtggactacgtactagttcgcgttccgtcggggg

SEQ ID NO: 239761 - DNA, 519 bp, Homo sapiens
  misc_feature: GYAE6OF02F5P9C.21.15.B04.1.454.CMB.1.raw
  modified_base (336)..(336): a, c, t, g, unknown or other
  misc_feature (336)..(336): n is a, c, g, or t
  modified_base (465)..(465): a, c, t, g, unknown or other
  misc_feature (465)..(465): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggagcttggtccagccgggggggtccctgagactgtcctgtgaagtctctggattgtatagcagagattggatgcactgggtccgccagacttcaggaaagggtctggagtgggtggccaanataaaccaagatggaagtgtgaagcactatgtggcctcgtgtgaggggccgattcacaatctccagagacagtgccaagaactcgttagatctgcaaatggacagcctgagagccgaggacacggctcnctattactggtcgcgaccggatacgtggctacggtcattcggcgtccgtcgggg

SEQ ID NO: 239762 - DNA, 514 bp, Homo sapiens
  misc_feature: GYAE6OF02F8E4U.21.15.B04.1.454.CMB.1.raw
  modified_base (466)..(466): a, c, t, g, unknown or other
  misc_feature (466)..(466): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggaggcttggtccaggccgggggggtccctgagactgtcctgtgaagtctctggattgtatagcagagattggatgcactgggtccgccagacttcaggaaagggtctggagtgggtggccaacataaaccaagatggaagtgtagaagcactatgtggcctctgtgaggggccgattcacaatctcagagacagtgaccaagaactcgttgtatctgacaatggacagcctgagagccgagacacggctctntattactgtgacgacggtatagtggctacgtcattgccgtccgtcggg

SEQ ID NO: 239763 - DNA, 749 bp, Homo sapiens
  misc_feature: GYAE6OF02F7I6F.21.15.B04.1.454.CMB.1.raw
tcagtcgtcgctcgcacgaccggtgctcgatttagacagtatatatccgcgggaggtcgtcgagagaggagccttagccctcggactccaacggcctttccaccttggtgtatcagcactgagcacagaggactcaccatggaattgggctgagcttggttttccttgttgtcttatttagaaggtgtccgagagtgaggtgaagtggtggaggtcgggggagtcgttggtccgagggcccggggggtccctggaggaccgttgtccgttggtggaagttccgtcgtaggtattaggtagtagcgaaggaagtagttaggattcgcgacgttcggggtcccgaccgaggtacccgttcgaaagggtaaagggttcgtagggtaaggtcggggtacggacctaaacgaaacgtaaaaacccgaaagtaggttaagggaaaggttaggtaggtaaacgcgtaaaccgttagtcggttagggtccccttacgttggtacgggacggggtaccgtaagttccgtacgtaacgtacgtaccgtacgtacgacgacgtacgtacgaacgaacgtacgttacgttacgttacgtacgtacgtaacgtaacgtaacgaacgtacgtaccgtaacgacggtaccggacgaacgaccggaccgtacgtacgttacgttacgtacgttacgtacgtacggtacgtacgtacgtcgtaaaaaaaaaaaaaaaaaaacgtcgtacgtacgtcgtacgtccgg

SEQ ID NO: 239764 - DNA, 525 bp, Homo sapiens
  misc_feature: GYAE6OF02H77MA.21.15.B04.1.454.CMB.1.raw
  modified_base (338)..(338): a, c, t, g, unknown or other
  misc_feature (338)..(338): n is a, c, g, or t
tcagtcgtcgctcgcacgaccggtgctcgatttagacagtatatatccgcggggaggtaactcagagaggagccttagccctggactccaaggcctttccacttggtgatcagcactgagcacagaggactcaccatggaattggggctgagctgggttttccttgttgctatttttagaaggtgtccagagtgaggtgaaagtggtggagtcgggggaggcttggtccaggccggggggtccctgagactgtcctgtgagtctctggattgtatagcagagattgggatgcactgggtccgccagacttcgaggaagggtctggagtgggtgccaanataaaccaagatggaagtgtgaagcactatgtgcctctgtgaggggccattcacatctaccagagacagtcgaccaagaacgttcgtttgtatctgtacaaagtggacagacctgagacgaccgaggacacggctctctattacgtgtgcgaccggatagtggtctacgtctattcgcgtcgtcggg

SEQ ID NO: 239765 - DNA, 628 bp, Homo sapiens
  misc_feature: GYAE6OF02JE482.21.15.B04.1.454.CMB.1.raw
  modified_base (206)..(206): a, c, t, g, unknown or other
  misc_feature (206)..(206): n is a, c, g, or t
  modified_base (494)..(494): a, c, t, g, unknown or other
  misc_feature (494)..(494): n is a, c, g, or t
tcagtcgtcgctcgcacgaccggtgctcgatttagacagtatatatccgcgggaggtctcagagaggagccttagccctggactccaaggcctttccacttcggtgatcagcactgagcacagaggactcaccatggaattggggctgagctgggttttccttgttgctattttagaaggtgtccagagtgagtgaaagtggtggnggtcgggggagcgttggtccaggcccgggggggtccctggagacgtgtccgtgtgaagtctcgtggattgtatagcagagtattggatgcacgtggtccgcagacttcgaggtaagggtctagggacgtggggtggacccgtaaagaacgtaaaaccaagacgtaggaaacggtggtacgaaagtccaactagtaggtggtaccttcgttaggttgggaacgggggtccgtagtttccgaacgtaaactcgtaccgaagacgacaggtcgaccgaagtaacctggttntatctgacaaagtcggaactacggacctaggacgaggccggtaaggccgaacgcgtctacttattacgtggtacgtccgaacggtattaacgtgggaccttacgcgttaagttccggtacgttccggtacgggg

SEQ ID NO: 239766 - DNA, 541 bp, Homo sapiens
  misc_feature: GYAE6OF02JJXCJ.21.15.B04.1.454.CMB.1.raw
  modified_base (220)..(220): a, c, t, g, unknown or other
  misc_feature (220)..(220): n is a, c, g, or t
  modified_base (269)..(269): a, c, t, g, unknown or other
  misc_feature (269)..(269): n is a, c, g, or t
  modified_base (309)..(309): a, c, t, g, unknown or other
  misc_feature (309)..(309): n is a, c, g, or t
  modified_base (338)..(338): a, c, t, g, unknown or other
  misc_feature (338)..(338): n is a, c, g, or t
  modified_base (366)..(366): a, c, t, g, unknown or other
  misc_feature (366)..(366): n is a, c, g, or t
  modified_base (484)..(484): a, c, t, g, unknown or other
  misc_feature (484)..(484): n is a, c, g, or t
tcagtcgtcgctcgcacgaccggtgctcgatttagacagtatatatccgcggggaggtctcagagaggagccttagccctcggactccaaggcctttccacttggtgatcagcactgagcacagaggactcaccatggaattggggctgagctgggttttccttgttgttattttacaaggtgtccagtgtgaggtgcagctggtggagtctgggggganacttgggtccagcctgggagggtccctggagactctcctgtgcagcctntgcattcaccttcagtgaccacaacatggactggggtccnccgaggcctccgaggggaaggggctgggnggtggggtccggcgtattacgaaggaancgtaacaggtttacagtacagaatacggcgcgtctgtagaaaggagttcaccatctacaagagatagattacaaagaactacactgtactctgacaaatgaacagcctagaaaaccgnggacacggctgtattctggtgaagacgaaagagtaggattggaggtggtagtctagg

SEQ ID NO: 239767 - DNA, 529 bp, Homo sapiens
  misc_feature: GYAE6OF02GYHKL.21.15.B04.1.454.CMB.1.raw
  modified_base (448)..(448): a, c, t, g, unknown or other
  misc_feature (448)..(448): n is a, c, g, or t
  modified_base (477)..(477): a, c, t, g, unknown or other
  misc_feature (477)..(477): n is a, c, g, or t
  modified_base (509)..(509): a, c, t, g, unknown or other
  misc_feature (509)..(509): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggaggcttggtccagccgggggggtccctgagactgtcctgtgaagtctctggattgtatagcagagattggatgcactgggtccgcagacttcgaggaaggtctggagtgggtgccaacataaaccaagatggaagtgtgaagcactatgtggcctcgtgtggaggggtccattcacaatcctaccagagacagtgaccaagaacttcgttagtatctgacaaatggacagccngagagccgaggacacggctctgtattacnggtcggcaccggatacgtcggactaccgttanacgttcgcgttccgtcgggg

SEQ ID NO: 239768 - DNA, 541 bp, Homo sapiens
  misc_feature: GYAE6OF02H2PN8.21.15.B04.1.454.CMB.1.raw
  modified_base (340)..(340): a, c, t, g, unknown or other
  misc_feature (340)..(340): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccgggggggtccctgagactgtcctgtgaagtctctggattgtatagcagagattggatgcactgggtccgcccagacttcagggaaagggtatggagtgggtggccaanataaaccaagatggaagtgtagaagcactatgtgacctcgtgtgaggggcattcacatctccagagacagtgaccaagaactcgttgtatctgacaaagtggacagcctagagacgccggagacgacggcctctctacttacgtggtgccggaccggatagtggacctacggtctaagtttcggccgttccggtccggggg

SEQ ID NO: 239769 - DNA, 520 bp, Homo sapiens
  misc_feature: GYAE6OF02GGDRB.21.15.B04.1.454.CMB.1.raw
  modified_base (335)..(335): a, c, t, g, unknown or other
  misc_feature (335)..(335): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggaggcttggtccagccgggggggtccctgagactgtcctgtgaagtctctggattgtatagcagagattggatgcactgggtccgccagacttcaggaagggtctgggagtgggtgccaanataaaccaagatggaagtgtagaagcactatgnggcctntggtggaggggccattcacaatctccaagacgacagtcgaccaagtaactcgttgtatctgacaagtgacagcctgagagcgagacacgctctctactactggtcgacgacggtatacgtggctacgtcagttcgcgtcgtcgggg

SEQ ID NO: 239770 - DNA, 557 bp, Homo sapiens
  misc_feature: GYAE6OF02GYF69.21.15.B04.1.454.CMB.1.raw
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (378)..(378): a, c, t, g, unknown or other
  misc_feature (378)..(378): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttcctgttgctattttagaaggtgtccagagtgaggtgaaagtggtggagtcggggggaggcttggtccaggccggggggtccctgagactgtcctgtgaagtctctggattgtatagcagagattggatgcactgggtccgccagacttcgaggaaagggtctggagtgggnggccaanataaaccaagatggaagtgtagaagcaactatggtggcctntggtggacggggccattcacaatctacagagacagtgaccaagactcgttgtactctagacaatggacagccgtagacgacgacgaggaccgacggcctacgtacttacgttacgtggtcggtaccggaccggtaattacgtggaccgttcgtacgtattcggccgttcggtccggggg

SEQ ID NO: 239771 - DNA, 519 bp, Homo sapiens
  misc_feature: GYAE6OF02H6IXX.21.15.B04.1.454.CMB.1.raw
  modified_base (299)..(299): a, c, t, g, unknown or other
  misc_feature (299)..(299): n is a, c, g, or t
  modified_base (373)..(373): a, c, t, g, unknown or other
  misc_feature (373)..(373): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggagcttggtccaggccgggggggtccctgagactgtcctgtgagtctctggattgtatagcagagattggatgcactgggtccnccagacttcgaggaaagggtctggagtgggtgccaacataaaccaagatggaagtgtgaagcactatgtgcctntgtgaggggccattcacaatctcagagacagtgaccaagaactcgttgtatctagcaaatggacagcctgagagccgaggacacggctctctattactggtgaccgacggtatacgtggctacgtctattcgccgtccgtacgggg

SEQ ID NO: 239772 - DNA, 524 bp, Homo sapiens
  misc_feature: GYAE6OF02ICZQ7.21.15.B04.1.454.CMB.1.raw
  modified_base (339)..(339): a, c, t, g, unknown or other
  misc_feature (339)..(339): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccgggggggtccctgagactgtcctgtgaagtctctggattgtatagcagagattggatgcactgggtccgccagacttcgaggaaagggtctggagtgggtggccaanataaaccaagatggaaagtgtagaagcactatgtggcctctgtgaggggccattcacatctccagagacagtgaccaagaacttcgttgtatctgacaaatggacagcctgagacgccgagacacggctctctattctgtcgacgaccggtatacgtggctacggtctagttgcgtccgtcgggg

SEQ ID NO: 239773 - DNA, 690 bp, Homo sapiens
  misc_feature: GYAE6OF02JFCKZ.21.15.B04.1.454.CMB.1.raw
  modified_base (300)..(300): a, c, t, g, unknown or other
  misc_feature (300)..(300): n is a, c, g, or t
tcagtcgtcgctcgcacgaccggtgctcgatttagacagtatatatccgcggggaggtcgtcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcgttgggtccaggccgggggggtccctggagactgtccgtgtgaagtctctggattgtatagcagagattggatgcacgngggtccgccagacttcagggaaagggtctgggaggtgggtgggaccctaacgaataaaacccgaaggactagggaaacggtgtaggaaagcaacgttataggtcggccttcgttcggtagggaccgggggtaccggtagtttaccgaacgtaacttcccgtaccgaaggacggtaaacctagggtacgacccggaaaacggtaaccgtttaccggtttagtaacgttccgttcggaactaaacgtcgggacaaacgggtccctaggaaggtaccgaccgggaacgaaccggacggaccttcgttaccttagttactacgggtcggccggtaaccggtattaacgtggccgttaacggtcctacggtttcgtccggttcccggtacggggg

SEQ ID NO: 239774 - DNA, 518 bp, Homo sapiens
  misc_feature: GYAE6OF02JY9MG.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggtttccttgttgctattttagaaggtgtccagagtgaggtgaaagtggtggagtcgggggaggcttggtccagccggggggtcctgagactgtcctgtgagtctctggattgtatagcagagattggatgcactgggtccgccagacttcgaggaaagggtctggagtgggtggccaacataaaccagataggaagtgtagaagcactatgtgctctgtggagggccgattcgacatctcagagacgagcgaccaagactcgttgtatcgtagacaatggacagcctagagacgccgagacgacggctctactattacgtgtcgaccgacgtatacgtggctacgtctagtcgccgtcgtcggg

SEQ ID NO: 239775 - DNA, 891 bp, Homo sapiens
  misc_feature: GYAE6OF02JATA8.21.15.B04.1.454.CMB.1.raw
tcagtcgtcgctcgcacgaccggtgctcgatttagacagtatatattccggtcgggggaggtcgtccagaggaaggagccttagccctgggacgtccaacggcctttccacttggtggatcaggcacctgacgtccacgacgtacggtactcctaaccatcggaaattgggggctcggagcctgggtttttccttgttgcttattttagaaggtgtccacgtgtaggaggttcgcacgactggtacggagtcggtggggagtcttggtccacgtccgtgggggtccctaggagagtacgtcgtagtagtggccttcgtggatttccgtaaagttttaacaccgtattacggaatcggagccgttcggggtaccccgtcgtagggtcctccggaaggggtaacggggccttagggaaagggttcggggtacggacccgaaaacggtaacgttaaaacggggaacgtaacggttacgggaaaaccggttggaaaaaccgtaaaaaagggttactttacgggtacgggtaactttaccgtaacgggtttaacgggaaaaccggggggtacccgtaaaacgtttcccgaaacccttaactttacccgtttaaccgaaaggaaccgaaacccgaaacccggacccgaaaacgggaaacccttacgttaaccgttttaacgtccgttacgtaaccgtaaaagtacgtaaagttaaccggtacgttacggtaacggtaacggtaaccgggtaaagggaacccgtaacgggacgttaagtacgtttaacttaacggttggttacccggtaacggttaacgggaaccggtaaggttaacgaccgggtaagggtaaggggtaccgggttaacggtacggtaaccggtaccggttaacccgg

SEQ ID NO: 239776 - DNA, 568 bp, Homo sapiens
  misc_feature: GYAE6OF02IGEG2.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccgggggggtccctgagactgtcctgtgaagtctctggattgtatagcagagattgggatgcacgtggggtcccgccagacttcgaagggaaagggtctggagtgggtggaccaacagtaaaccaagagtaggaagtgtgaagcactagtggtaggcctcgtgtggacgggcgattcacatctccagagactagtcgaccgaagactcgttagtactctgacaaatcggaacagcctagagacgccggagaccgacgtcctcttactacgttactggtcgaccggaaccggtagtacgtggtacctacgtccttaggttcgccggttcggtaccgggg

SEQ ID NO: 239777 - DNA, 540 bp, Homo sapiens
  misc_feature: GYAE6OF02FWCPH.21.15.B04.1.454.CMB.1.raw
  modified_base (378)..(378): a, c, t, g, unknown or other
  misc_feature (378)..(378): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccagccgggggggtcctgagactgtcctgtgaagtctctggattgtatagcagagattggatgcacgtgggtccgccagacttcgagggaaaggtctgggagtgggtgccaacataaaccaagataggaagtgtagaagcactagtgtggctntgtgaggggcctattcacaatctaccgagagacagtcgaccaagacttcgttgtatcgtagacaaagtcggaacacgacctgagtacgccgaggacacggctcgtctattactggtcgccgaccggatagtcggacttacgtgtatcggcgtccgtacgggg

SEQ ID NO: 239778 - DNA, 535 bp, Homo sapiens
  misc_feature: GYAE6OF02H2XC9.21.15.B04.1.454.CMB.1.raw
  modified_base (411)..(411): a, c, t, g, unknown or other
  misc_feature (411)..(411): n is a, c, g, or t
  modified_base (507)..(507): a, c, t, g, unknown or other
  misc_feature (507)..(507): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccgggggggtcctgagactgtcctgtgaagtctctggattgtatagcagagattggatgcacgtgggtccgccagacttcgaaggaaagggtctgggaggtgggtggccaacaataaaaccaagatagggaaagtggtagaagcactatgtggcctgtgtggaggggccattacacaatcncgagagacagtcgacaagactcgttagtatctgacaaagtggacagcctagagacgccgagaccacggcctatctatacgtgcgcgacggatacgnggactacgctatcggacgtccgtacggg

SEQ ID NO: 239779 - DNA, 619 bp, Homo sapiens
  misc_feature: GYAE6OF02IO4KF.21.15.B04.1.454.CMB.1.raw
  modified_base (340)..(340): a, c, t, g, unknown or other
  misc_feature (340)..(340): n is a, c, g, or t
  modified_base (418)..(418): a, c, t, g, unknown or other
  misc_feature (418)..(418): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggtttttccttgttgctatttttagaaggtgtccagagtgaggtgaaagtggtggagtcggggggaggcttggtccaggccgggggggtccctgagactgtcctgtgagtctctggattgtatagcagagattggatgcactgggtccgccagacttcgaggaaagggtctggagtgggtggccaanataaaaccaagataggaagtgtagaagcaactatggtggcctcgtgtggacgggggcctattcaacaatcctccgaanagactagtcgaccaaagaactcggttagtatcgtagactaaagtggaacgacgtacctagaacgacggaccggaacggaaccggacggtcctaccgttacgttacgtttaaccgtggttcggaccggaacccgggtaattacggtacggtaccgttaccggttacctaagttttccggtccggttcccggtacccgggggg

SEQ ID NO: 239780 - DNA, 608 bp, Homo sapiens
  misc_feature: GYAE6OF02IX91Q.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggtttcctgttagctattttagaaggtgtccagagtgaggtgaaagtggtggagtcgggggaggcttggtccagcggggggtccctgagactgtcctgtgaagtctctggattgtatagcagagattggatgcacgtgggtcccgcagacttcgagggaaagggtctgggagtggggtggccaacgataaaccagacgtagggaagtgtagaagcactatgtgctcgtgtggagggtccattcacaatctacagagacagtcacgaagacgtcgttgtactcgtagactaaagtcgggaacagtccgttaggaacggacgtcccggaaggaaccgacggtaccgttccgttacgttacgtttaccgtcgggttaccgtacccggaacgggtaacttacggtacgggtccgttaaccggttccgaggtttacggtcccggttacccgtaccggggg

SEQ ID NO: 239781 - DNA, 724 bp, Homo sapiens
  misc_feature: GYAE6OF02JUUDT.21.15.B04.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacagtatatatccgcggggaggtctcagagaggagcttagccctggactccaaggcctttccacttggtgatcagcactgagcacagaggactcaccatggaattgggctgagctgggtttccttgttgctatttagaaggtgtccagagtgaggtgaagtggtggagtcgggggaggngttggtcaggccggggggtccctggagcgtgtacctgtgaagtctcgtggattgtatagtcgagtagagttgggaactgcgacgtgggtccgccgtagaccttacgaagggtaaagggtcctaggggaggttaggggtggtacccgaaacgtataaaaacccgtaacgaagtaggaaacggtgtaggtaaaggtaccaacgttaaaggtcggttacggtaccgttccggttaggtacgggtacgggggggtacctacgtttacccggaacgtaaacgtacccgtacccgtaacggtaacggaaccgtaggtacgtacccgaaacgtaacgtacggttacggttacgtactcgtaacgaacttagggaacgtaccggacgtaagtaggacgtaccgggacgtaaaccgcggtaccacgttacgtcttaacgtcggtaaccgtacggtaccggtagttacggtccgtaacggtccgtaaccgttagttccgtaccggtccggttaaccgggg

SEQ ID NO: 239782 - DNA, 513 bp, Homo sapiens
  misc_feature: GYAE6OF02HH2P6.21.15.B04.1.454.CMB.1.raw
  modified_base (477)..(477): a, c, t, g, unknown or other
  misc_feature (477)..(477): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccagccgggggggtccctgagactgtcctgtgaagtctctggattgtatagcagagattggatgcactgggtccgccagacttcaggaaagggtctggagtgggtggccaacataaaccaagatggaagtgtagaagcactatgtggcctctgtgaggggccattcacaatctccagagacagtgccaagaactcgttagtatctgcaaatggacagcctgagagccgagacacggctctctattactggtncgacggatagtggctacgtcagtgcgttcgtcgggg

SEQ ID NO: 239783 - DNA, 560 bp, Homo sapiens
  misc_feature: GYAE6OF02I7507.21.15.B04.1.454.CMB.1.raw
  modified_base (414)..(414): a, c, t, g, unknown or other
  misc_feature (414)..(414): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccgaggccgggggggtccctggagactgtcctgtgaagtctctggattgtatagcagagattggatgcacgtgggtccgccagacttcaggaagggtctggagtgggtgccaacgataaaccaagatgggaagtggtagaagcaactagtgtggcctcgtgtggaggggccgattcactatctccaganacgagtcgaccaagaactcgttacgtatctagactaaagtggaacagccttgaacgagtaccggacggaacgacgctactctattcgtggtcgaccggacggtatacgtcgtacgtacgtccgtatcggtccgtccggttacgggg

SEQ ID NO: 239784 - DNA, 563 bp, Homo sapiens
  misc_feature: GYAE6OF02IJKPT.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccgggggggtccctggagactgtcctgtgagtctctggattgtatagcagagattggatgcacgtcggggtccgccagtacttcgagggaaagggtctgggaggtgggtggaccaacaataaaaccaagataggaagtgtagaagcactatgtcggcctcgtggtggaggggccgattcaactaatcctaccaagagacagtcgaccaagtaactcgttagtactcgttagacaaagtggacagtcctagacgacgccggagaccgacggctactctattacgtgtgaccgacggatacgtggactacggtcagttcgccgtccggtacgggg

SEQ ID NO: 239785 - DNA, 609 bp, Homo sapiens
  misc_feature: GYAE6OF02F1SWD.21.15.B04.1.454.CMB.1.raw
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (412)..(412): a, c, t, g, unknown or other
  misc_feature (412)..(412): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcggtggtttcgtgtaggcgtacttagtaaggtgtcagagtgaggtgaaagtggtggagtcgggggagcttggccaggccggggggtccctgagctgtcctgtgaagtctgtgattggtatagcagagtagttggatgcncgtcgggtccnccagtacttcgagggaaggtgaggtggtcgggtcggaccaacgaactaaaccgaagagtaggaagtgagagaccagtgtgtcgtccgtgtaggtggacggtctagtcctaanacgtcgacgagacgacgtacgtacgaacgtacgtacgttacgtacgtactacgtagtaacgtaggcgacgacgtacggagacggccgacgtacgaccgtacgtcttacgttactagtacgtacggtacggaacgttacggtacgttacgtacgttcgtacgttaccggtcggtccgggttccggtaccgggtaccgg

SEQ ID NO: 239786 - DNA, 576 bp, Homo sapiens
  misc_feature: GYAE6OF02HL4RD.21.15.B04.1.454.CMB.1.raw
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
  modified_base (454)..(454): a, c, t, g, unknown or other
  misc_feature (454)..(454): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaagtggtggagtcgggggagcttggtccagccgggggggtccctgagactgtcctgtgaagtctctggattgtatagcagagattggatgcacgtgggtcccncgagcttcaagggaagggtctagggacgtggggtgccaaanataaaaccagatggaatgtgaagcactatgtgcctgtgngagggccattcacaatcnccaagagacagtcgaccaaagactcggttagtactacgtgaacgtaaatcgggaacncggtacctaggaggaacgcccggaagaccgacggtccttctacgtacttaccgtggtcggtacccggacgtaagttacgtacggccgttacgtctagtttcggccggttaccgtaccggggg

SEQ ID NO: 239787 - DNA, 641 bp, Homo sapiens
  misc_feature: GYAE6OF02JD0NY.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggtttccttgttgctattttagaaggtgtccagagtgaggtgaaagtggtggaggtcgggggaggcttggtccaggccgggggggtccctgagactgtcctgtgaagtctctggattgtatagcagagattggatgcactcggggtccgccagtacttacgaagggtaaagggtctagggaggtggggtacggaccaaacgataaaaccgaagatggaagtgtagaagacatagtgtggcctcgttggtagggacggggccgtagttccaactaaacgtcctacccgaaggacgaccgtaaggtacggaccctaaaaggtaaccttcggttacggttaacttcgtagtaaccgtaaagttacggaacgtacgtaccgtaggaacggacggaccggacggaaccgacggcttacgtacgtacttacgtggtcggacgtaaccggtatacgtcgtaccgttacgtctagtcggtcgtacccggtacgggg

SEQ ID NO: 239788 - DNA, 538 bp, Homo sapiens
  misc_feature: GYAE6OF02H2MR8.21.15.B04.1.454.CMB.1.raw
  modified_base (303)..(303): a, c, t, g, unknown or other
  misc_feature (303)..(303): n is a, c, g, or t
  modified_base (342)..(342): a, c, t, g, unknown or other
  misc_feature (342)..(342): n is a, c, g, or t
  modified_base (379)..(379): a, c, t, g, unknown or other
  misc_feature (379)..(379): n is a, c, g, or t
  modified_base (415)..(415): a, c, t, g, unknown or other
  misc_feature (415)..(415): n is a, c, g, or t
  modified_base (441)..(441): a, c, t, g, unknown or other
  misc_feature (441)..(441): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcgggggagcgttggtccgaggccgggggggtccctggagactgtcctgtgagtctctggattgtatagcagagattggatgcacgtgggtccnccagaccttcgaggaagggtctggagtggggtgaccaanataaaccagatggaagtgtagaagcactatgtgcctntggtggaggggccattcgacaactctaccagagacngtcgaccaaagtactcgttgtatctnacaaatggacagcctagagagccgaggacacggcttacgctagttactggtcgccgacggtatgtggtctacgtctacttgtccggtccgtacgggg

SEQ ID NO: 239789 - DNA, 658 bp, Homo sapiens
  misc_feature: GYAE6OF02HLK0M.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccggggggtccctgagactgtcctgtgaagtctctggattgtatagcagagattggatgcacgtcggggtcccgcctaggtacttcgaagggaaagggtctagggagtggggtggaccaacaataaaaccaaggataggaaagtgtagaagcataatgtggcctcgtgtgggacggggccgtagttccgactaatccgtaccgaggacgacgtacggtcgaccgaaagtaaccgttcggttagttaacgttctacggaacaaacggtggaaccaacggtacccgtacggaaggaccgaaccggaaacggaaccgaaccgggtcttccgtaccttacgtttacggtcggtacggaccggtaacccgggtagtaacgtgggtaccgttaccggtacgttaagtttcggaccgttcccggttacccggggg

SEQ ID NO: 239790 - DNA, 543 bp, Homo sapiens
  misc_feature: GYAE6OF02JG4Y1.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccggggggtccctgagactgtcctgtgaagtctctggattgtatagcagagattggatgcactgggtccgccagacttcaggaaagggtctgggagtgggtggccaacataaaccaaggatgggaaagtgtagaagcactatgtggcctctgtggaggggccgattcacaatctccagagacagtgccaagaactgttgtatctagcaaatggaacagcctagagacgccggacggaacgacggcctctacttacttacgtggtcgccggaccggattagtggtcctacgtcattcggccgtccgtccggggg

SEQ ID NO: 239791 - DNA, 633 bp, Homo sapiens
  misc_feature: GYAE6OF02HVNAO.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcggggggaggcttggtccaggccgggggggtccctgagactgtcctgtgaagtctctggattgtatagcagagattggatgcacgtcgggtccgccagacttcgaaggtaaagggtctgggaggtggggtcggaccaacaactaaaaccgaagacgtaggaagtgtagaacgcactaagtggtcggcctcgtggtggacggggtccgagtttacacgtaactcctaccgaagacgacagtacgaccgaaagtaactcgttagtatcgtgaacaaacgtggaacacgccgtaggacgacggaccggaagggaccgacgggtacccttcgttacgttactttacgtggtaccggaccggaccggtaagttacggtcggtaccgttaccgtcttacggtttcggtcccggttaccggtaccggggg

SEQ ID NO: 239792 - DNA, 686 bp, Homo sapiens
  misc_feature: GYAE6OF02F7ONG.21.15.B04.1.454.CMB.1.raw
tcagtcgtcgctcgcacgaccggtgctcgatttagacagtatatatccgggcggggaggtctcagtagaggagccttaggccctggactccaaggcctttccacttggtagatcagcactgagctaccagaggactcaccactggaattgggctgagctggggtttccttggttcgctattttagaaggtgtccagagtgaggtcgaaagtggtggagtcggggggacggcttggtccgagccgggggggtccctgagtactgtccgtggtgaagtctactggattgtaattagctagagtagttggatgccacgtcgggtccgaccgaggaccttacgaacgggtaaacgggtctaggaggtggggtaggaccaaacgataaaaccgaagagtaggggaacgtggtagaagtctaactagtcgtcggacctcgtggtggacggggtcccgaagttccgaacctaacttcctaccgaggaacgacgtaggtacggacccgaaaggaacgttcggttagtacttcgttacgactaaagtcgggaacaggacccgttaggaacggacgccggtaacggaacgacgggtaccttcgtacttagttaccgtggttcggaccggtaccgggtagttacggtcgggtacttaaccggtaccgtagtttcggtcccggttaccgtaccggggg

SEQ ID NO: 239793 - DNA, 551 bp, Homo sapiens
  misc_feature: GYAE6OF02HNUQU.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggtttccttgttgctatttagaaggtgtccagagtgaggtgaaagtggtggagtcgggggagcttggtccaggccggggggtccctgagactgtcctgtgaagtctctggattgtatagcagagattggatgcacgtgggtcccgcagacttcaggaaaggtctggagtgggtgccaacataaaccaagatggaagtgtgaagcactatgtggcctgtgtgacggggcattcactaatctccagacgacgagtacgaccaagaacctcgttagtactctgacaagtaggaactacgacctggacgaggaccgaggaccgacggctcgtacctattacgtcggtcgacggtaccggatacgtggtacgttacggtactattcggcgttccggtacgggg

SEQ ID NO: 239794 - DNA, 615 bp, Homo sapiens
  misc_feature: GYAE6OF02HV95L.21.15.B04.1.454.CMB.1.raw
  modified_base (337)..(337): a, c, t, g, unknown or other
  misc_feature (337)..(337): n is a, c, g, or t
  modified_base (379)..(379): a, c, t, g, unknown or other
  misc_feature (379)..(379): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaggtgtccagagtgaggtgaaagtggtggaggtcgggggagcgttggtcaggccggggggtccctgagactgtcctgtgaagtctctggattgtatagcagagattggatgcacgtggtccgccagacttcgaggaaagggtctggagtggggtgaccaanaataaaccaagataggaagtgtagaagcacgtatgcggcctntggtggacggggccgtattcacaactctaccgaggacgacgagtcgaccaagtaaccttagttgtatcgttgaacgtaaagtcgggaccagccgtaggaacggacgaccgggaaggaaccgacggtaccttacgtaccttagtttacgtacggtcggtacccggaaccgggtattaaccggtcgggtacttaaccggtcgttaacgtttcggtacccggttcccggtacccggggg

SEQ ID NO: 239795 - DNA, 648 bp, Homo sapiens
  misc_feature: GYAE6OF02HUV3M.21.15.B04.1.454.CMB.1.raw
  modified_base (307)..(307): a, c, t, g, unknown or other
  misc_feature (307)..(307): n is a, c, g, or t
tcagtcgtcgctcgcacgaccggtgctcgatttagacagtatatatccgcggggaggtctcagagaggagccttagccctggactccaaggcctttcccacttggtgatcagcactgagcacagaggactcaccatggaattggggctgagctgggttttcctgttgctatttagaaggtgtccagagtgaggtgaaagtggtggaggtcgggggagcttggtccaggccgggggggtccctgagactgtcctgtgaagtctcgtggattgtatagcgagagtagttggatgcacgtcggggtcccncgagtccttcgaaggaaagggtctgggaggtgggtacggaccaaacgtaagtaaaaccgaagacgtaggaaagtcggtagaagtcaagtatggtcgccgttgtaggtgggtacggggcctaacgttacaacgtaactctaccgaggacgacgaggtcgaaccgaacggtaacttcgttagtatcgtagactaaagtcggaacgacgtaccgtaggaacgacgtaccggaacggaacccgacggtccgttactaccgttaacgtttaccgtggttacggacccggtaacggaattacggtcggacgttcgtacgttacggttcggtaccgtcgggtaccggg

SEQ ID NO: 239796 - DNA, 660 bp, Homo sapiens
  misc_feature: GYAE6OF02FPOQS.21.15.B04.1.454.CMB.1.raw
tcagtcgtcgctcgccacgaccggtgctcgatttagacagtatatagtcgtcggggaggtctcagagaggagccttagccctggactccaaggcctttccacttggtgatcagcactgagcacagaggactcaccatggaattggggctgagctgggttttccttgttgctattttagaaggtgtccagagtgaggtgaagtggtgaggtcgggggaggcggttaggtccgtaggccgggggtaccgtcggtacgggtacctgtccgtgtcgtacgtcgtcgtggattcgtataggctagtacgtagttggtatgtcgtacgtggtacccgtcgtacgaccttacgtaggtaacggtacggtaggtaggtggggtggtccgtaacgactaaaccgtagaagtacggaagtagtaggaagtcgaacgtaatgtaggtccgtagttcgtggtagggtacgtaggttcgactaactctactagagacgagtacgaccaaagtaccttgttatattctagacaaagtcggacgacgtacgtagagacgaccgaaggtccaaccggtcttaccgttagttacttcggtacggtcgggtaccggtacgggtactacgttacggacttaccgggtacgtaccgtcggtacccggttccggtaccggg

SEQ ID NO: 239797 - DNA, 718 bp, Homo sapiens
  misc_feature: GYAE6OF02JCJ1B.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggaggcttggtccaggccggggggtcctgagactgtccgtgtgaagtctcgtggattgtatagcagagattggatgcactgggtccgccagacttcgaggaaagggtctgggagtggggtgccaacataaaccgaagatagggaagtgtagaaaggcaacgttagtcggtcggtcccttacgtggtcgggacgggggcccgtaagtttccaaccgaacttcctacccgaaggaacgtaacgaagggttacgaacccgtaaacggtaaaccgtttccggtttagtaaaccttccgtacggacctaaaaggtcgggaaacacggtccctagggtaacgacgggtaccggaaacgggaccctaaccggggctttaccgttacttaacgtttccgtacggttaacgggaccccgggtaaacgggttaacgttacggtttaccgggaacccgttttaccggtacttaccggtttccgggtaccccggttaccggggttaacccggggggg

SEQ ID NO: 239798 - DNA, 742 bp, Homo sapiens
  misc_feature: GYAE6OF02JLTZO.21.15.B04.1.454.CMB.1.raw
  modified_base (310)..(310): a, c, t, g, unknown or other
  misc_feature (310)..(310): n is a, c, g, or t
  modified_base (559)..(559): a, c, t, g, unknown or other
  misc_feature (559)..(559): n is a, c, g, or t
tcagtcgtcgctcgcacgaccggtgctcgatttagacagtatatatccggcggggaggtctcagagaggagccttagccctggactccaaggcctttccgaccttggtgatcagcgactgagcacagaggactcaccagtggaattgggctgagctggtttccttgttgctatttagaggtcgtccagagtgaggtagaagtggtggagtcgggggaggcttggccgaggccggggggtcctggacgacgtgtcctgtagagtcgtcgtggtattgtatgacagaagtagtaggatgctacgtgggtccncagtacttacgaggaacggtcgtagggaggttcgggtacgtaccaaacgtaacgtaaaaccgaaggacgtggaagttaggtacgaaaggtcgtaacgttagtacggtacggtccttacgtagggtaccgggaagggggtacccgtaacgtttacccgaaacgtaaaccgtttccgtaacccgaaggtaaccgtaacgtacggttacgaacccgtaaacggtaacgttaccgttacgttaatcccgtaanaacccgttaaaggtccggtaacgtacggtaacccgtgggaacggacggtaacccggaaggtaccggaaccggtaccttacgttaaccttacggtttaccgtgggtacggtacccggtaacggtaagtaccgttggtacccttacggtcgttacgttaccgggtaccctccgggttaacccggg

SEQ ID NO: 239799 - DNA, 594 bp, Homo sapiens
  misc_feature: GYAE6OF02I1V19.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggagcttggtccaggccggggggtccctgagactgtcctgtgaagtctctggattgtataggcaggagtattggatgcacgtgggcccgccagaccttacaggaaagggtctgggtaggtggggtcggaccaacgaataaaaccgaagatagggaagtgtagaaagcaacgtatggtcggtccttcgtggtacggacgggggtacctagttacgaacgaactaccgtcctaagacgacgtaggtacgaccaaacgtaacttaccggttagtacttcagacaagtcggacagccgtgacgagcccgaggtaccgacgtctctacgtatacgtgtcgaccgtacggatagtcgacgtacgcgtagtcgtacgttcggtacggg

SEQ ID NO: 239800 - DNA, 537 bp, Homo sapiens
  misc_feature: GYAE6OF02FLWBP.21.15.B04.1.454.CMB.1.raw
  modified_base (398)..(398): a, c, t, g, unknown or other
  misc_feature (398)..(398): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggtttcctgttgctattttagaaggtgtccagagtgaggtgaaagtggtggagtcgggggaggcttggtccagccgggggggtccctgagactgtcctgtgaagtctctggattgtatagcagagatggatgcactggtccgcagacttcgaggaaaggtctggagtgggtgccaacgataaaaccaagactggaagtgtagaagcactatgtggcctgtgtgaggggccattcacaatctcagngacagtgacaagaactcgttgtatctagacaaatcgggaactacggacctacggacgtaggcccgagggaccacggcgtactacgtattacgtgtcgccgaccggtatagtcggactacgtcagttcgcgtcgtacggg

SEQ ID NO: 239801 - DNA, 691 bp, Homo sapiens
  misc_feature: GYAE6OF02HYAYT.21.15.B04.1.454.CMB.1.raw
  modified_base (339)..(339): a, c, t, g, unknown or other
  misc_feature (339)..(339): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgagtgaaagtggtggagtcgggggagcgttggtcgaggcccggggggtcctgagatgtctgtgaagtctctggattgtatagcaggagagttggatgcgactgggtccgaccgagacttcgaggaaaggtctggagtgggtagccaaanaactaaacgaagataggaagtgtgaaagcgaacgtaagtgtacgggtccttctggtacggacggggtccgtaagttccaaactaaagttaccgtacccgaaggaacgaacgtacgttacgaaccgaaagtaaaccgttacgtttacggttatcgtagactaaaagtacgggaacagtaccgtggaacgaacggacccggaaagggacccgaaacggtcccgtattaacccgtaacgtttaacgttacggtcgtaacccgggtaacccggaaagtttaacgtccgggttaacccttaaccggttaccgttaaacggtttcggtaccccgggttacccgttaacccgggggggg

SEQ ID NO: 239802 - DNA, 528 bp, Homo sapiens
  misc_feature: GYAE6OF02GJ5AB.21.15.B04.1.454.CMB.1.raw
  modified_base (373)..(373): a, c, t, g, unknown or other
  misc_feature (373)..(373): n is a, c, g, or t
tcagtcgtcgctcgcacgaccggtgctcgatttagacagtatatatccgcgggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccagccgggggggtccctgagactgtcctgtgaagtctctggattgtatagcagagattggatgcactgggtccgcagacttcaggaaagggtctggagtggggtgccaacataaaccaagatggaagtgtgaagcatatgtgcctngtgaggggccattcacatctacagagacagtcgaccaagaactcgttagtatctgacaaatggacagcctggagaggccgaggaccgacggctcttctattactggtcgccggacggtatagtggacctacgtcagtttcggcgttccgtcgggg

SEQ ID NO: 239803 - DNA, 666 bp, Homo sapiens
  misc_feature: GYAE6OF02IGHJX.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgtctattttagaaggtgtccagagtgaggtgaaagtggtggaggtcggggggaggtcgttgggtccgagggtccgggggggtcccgttggacggtacgtgtccgtgtacggaagtcgtctggtattgtatagcagagtattggatgcacgtcggtccgccacgacttcgaaggtaaacgggtcgtaggaggtagggtgggaccaaacaacgtaaaccgaaagacgtaggaagtggtagaagcaactagtggtcggacctcgttggtagggacggggtaccgtagtttaccgaacgtaaacttccgtaaccgaaggaacggtaacgtaaggtacgtaacccgaaaggttaaccttacggttagttactcgtacgtaactaaagtcggaatacggcctaggacgaacgccgaagaccgacgtccttactacgtacttaacgtggtacggtccgacggtacttagtggacctacggtcagtttacggccgttcggtaccgggg

SEQ ID NO: 239804 - DNA, 789 bp, Homo sapiens
  misc_feature: GYAE6OF02H1TF3.21.15.B04.1.454.CMB.1.raw
  modified_base (343)..(343): a, c, t, g, unknown or other
  misc_feature (343)..(343): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttcctgttgctattttagaaggtgtccagagtgaggtgaaagtggtggagtcggggggagcgttggtcaggccggggggtccctgagactgtccgtgtgaagtctcgtggattgtatagcagagagttggatgcacgtggtccgcagacttcgaaggaaaggtctggacgtggggtcggaccaaanaacgtaaaaacccgaaggtaagtagggtaaaggttggtaggaaacggtccaagttaagttcggtacggtccccgttgtagggttgggaacgggggtcccgtaagttaccgaaacgtaacgttacccgttaccccggaaagtaaaccgggaacgtaaagggttccgggaacctaaaaaccgggtaaacgtttccgggtttaaacggtttaacgttaccgttacgggttaaaccctaaaaagggtttacgggaaacccgaaacggttacccgttacggaacgggtaacgggaaccccggttaaagggaacccggtaaaccgggtcccgttacgttaccgttaacgtttaaccgttacggttacgggacccggtacggtaagtttaaccggtggttacccgttaaccgttacgttaacgtttcggtcccggttccggttaacccggggg

SEQ ID NO: 239805 - DNA, 791 bp, Homo sapiens
  misc_feature: GYAE6OF02JS9P0.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctggtttccttgttgtctatttagaaggtgtccagagtgaggtgaaagtggtggagtcgggggaggcttggtccaggccgggggggtccctggagacgtgtcctgtgagtctctggtattgtatgcagagtagttggtatgcgtacgtcgggtcccgaccgtagacttccggaagggtaaaaggggttccgtaggggacgggttggggttacgggacccgtaaactacgtaaaaaccccgaaaggaagttaggaaaggttcgtaggaaaggtccaacgttaagttcgggtacggtaccctttcggtaggtacgggaggggggtacccgtagtttacccgaaacgtaaccgtacctttacccgaacgggtaacgtaaccggaaggttaccgaacccgtaaacgggtaaaccttaccgggtttacgttaacgttaccgttacggtaacgtaaaacgttacgggaaacgtacgggtacccgttaggaacggaccgggaccggtaaccgggtaccgaaccgggtactacccgttaagttaactttcccggttaggttaccggtacccggtacggttaacgtacgggttacggaccggtttacgtacccgttaggttcgggttaccggtacccggttaccgggggg

SEQ ID NO: 239806 - DNA, 757 bp, Homo sapiens
  misc_feature: GYAE6OF02JZMPW.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggtttcctgttgctattttagaaggtgtccagagtgaggtgaaagtggtggaggtcgggggaggcttggtccaggccggggggtcctgagactgtcctgtgaagtctcgtggattgtatagcaggagagttggatgacacgtgggtccgccgagacttcgaagggaaagggtctagggtaggtgggtcggacccaaagacgtaaaacccgaaggtagtacgggaaggtggttaaggaaacgtaccgaagttaagtagggttacggtcccgttacgttagggtacgggaacgggggtacccgtacgtttaccgaaaccgttaacgttaccgtacccgtaaggtaaacggaaccgtaggtaccgtaaccgtaaacggtaaaccgtttcggtttagtaacgttccgttaacgaacgtaaacgttacgggaaccaacggtacccgtaggaaccggaaccgggaccggaaaggaccgtaccggtaccgtaccgttaccgtactttaccgtcgggtaccggtaaccggtacccggtaagttaccgttacgggtacccttaacgggtaccgttacggttacggtcccgggttacccgggtaacccgggggg

SEQ ID NO: 239807 - DNA, 789 bp, Homo sapiens
  misc_feature: GYAE6OF02IFOPB.21.15.B04.1.454.CMB.1.raw
  modified_base (297)..(297): a, c, t, g, unknown or other
  misc_feature (297)..(297): n is a, c, g, or t
  modified_base (438)..(438): a, c, t, g, unknown or other
  misc_feature (438)..(438): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcgttgggttttccttgttgctatttagaaggtgtccagagtgagtagaaagtggtggaggtgggggaggcgttggtccgacgggcccgggggggtcccgtggacgtacgtgtccgtgtggtaagtcgtcgtggattagttagtacgngaagaggtattagggattcgacgtacgtcgggtcccgaccctagaccgttacgaagggaaaacgggtcgttaggtagggtcgggtacggaccgaaaacaagtaaaaaccgaaggaagttagggaaagtacggttaggaaancgtaacgtacgttggtcggtccgtacgtggtacgggtacgggggaccttaacgttaccgtaacctaaacgttacccgtttaaccgaaacgggaacgtaaacgtaacggtaccggaacccgttaaaacggaaccgttaccggtttagtacgtttaccgtacgtaaactaaacgttacggaaacgtaccggttaccgacggtaaacggaccgaccgggaacggtaacccggaccggtaccgttacccttacggttaacttttaccgacggtcggtaacccgaacccgggtaatttaacggtcggtaacgttaccgttagtagtttaccgggtcccgttaccggttacccgggg

SEQ ID NO: 239808 - DNA, 741 bp, Homo sapiens
  misc_feature: GYAE6OF02JPE06.21.15.B04.1.454.CMB.1.raw
  modified_base (165)..(165): a, c, t, g, unknown or other
  misc_feature (165)..(165): n is a, c, g, or t
  modified_base (168)..(168): a, c, t, g, unknown or other
  misc_feature (168)..(168): n is a, c, g, or t
  modified_base (367)..(367): a, c, t, g, unknown or other
  misc_feature (367)..(367): n is a, c, g, or t
tcagtcgtcgctcgcacgaccggtgctcgatttagacagtatatatccgcggggaggtctcagagaggagccttagccctggactccaaggccttccacttggtgatcagcactgagcacagaggactcaccatcggaattggggctgagctgggtttcgtactnttntagttagtacgtgtactgaggtgaacggtggaggtagtcggggaggacggggtggtctagggccggggttacgcgggggtaccgtcgtagccgtgtcgtaggtgtacgtgtacttggtattagtacggggtagtagagtaggaagtggtagtcgtcggtacggtccgtcggacgtcccgaagtacggtacgtaagggtnaaccgttgggtaggtccgtaagcgttaaacccaaggtaaacctaggaaacgttggagtaaaggtcgaacgtaactacggttagggtaccttaggtcggttagtaacgggggtccctaaaggggtttcccggaacgttacgtacgtaacccgttaacgtacggtaacccgaaggtaccgacccgtaaaggtaccctaacggttacgtacgtttgtagtctaagtggtaacgtaggaccgtagggaccgtagccggaacggacgtaaccgggactaccggtctacgtacctaggtacgtaacggtcccgggaagttaaccggtgtaaccgttaccgggccttaacggttcggacgttccgggtacccgtaccgggg

SEQ ID NO: 239809 - DNA, 614 bp, Homo sapiens
  misc_feature: GYAE6OF02IQOWE.21.15.B04.1.454.CMB.1.raw
tcagtcgtcgctcgcacgaccggtgctcgatttagacagtatatatccgcgggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccgggggggtccctggagactgtcctgtgaagtctctggattgtatagcagagattggatgcacgtgggtccgccagacttcgaagggaaagggtctgggaggtggggtggaccaacataaaaccaagataggaagtgtagaagcaactatgtggcctcgtggtggaggggccagttcacaatctccaagagacagtcgaccaagtaactcggttagtattcgtacgactaaagtcggaacacggtccgtaggaacggacgacccggaacgggaaccgaccggcttaccgttacttacgtttacttgggtacggaccggtaaccggtattaacgtcgggtaccttaacggtccgttagtttcggccggttccggtaccggggg

SEQ ID NO: 239810 - DNA, 638 bp, Homo sapiens
  misc_feature: GYAE6OF02IQ973.21.15.B04.1.454.CMB.1.raw
  modified_base (342)..(342): a, c, t, g, unknown or other
  misc_feature (342)..(342): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattgggctgagctggtttctgtgctatttagaagtgtccagagtgaggtgaaagtggtggaggtcgggggaggcttggtccaggccggggggtccctgagacgtgtcctgtgaagtctcgtggattgtatagcagagagttggatgctacgtgggtcccgcagacttacgaaggtaaggtcgtaggtaggtgggtaggaccaanaacgtaaaccgaagagtaggaagtcgtagaacgcgtaactagtgtcggtcctagtgagggtacgggcctagttcaaccagtctacgagacgtacagtacgacaaagtactcgttgtatcctagactaaagtcggactacggtccgtaggtaacgaccgtaccggaacgggtaacccgacggtaccttaccgtttaccgtaacgtttaccgtacgggtacggacccggtaccggtaattacggtaggtacccgttacggtccgtaacggttcggtccggttaccgttaacccggggg

SEQ ID NO: 239811 - DNA, 565 bp, Homo sapiens
  misc_feature: GYAE6OF02FMHKF.21.15.B04.1.454.CMB.1.raw
  modified_base (302)..(302): a, c, t, g, unknown or other
  misc_feature (302)..(302): n is a, c, g, or t
  modified_base (345)..(345): a, c, t, g, unknown or other
  misc_feature (345)..(345): n is a, c, g, or t
  modified_base (539)..(539): a, c, t, g, unknown or other
  misc_feature (539)..(539): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcgttggtccaggccggggggtccctgagactgtcctgtgaagtctctggattgtatagcagagattggatgctactgggtccnccagacttcagggaaaggtctgggagtgggtggaccaacgaanaaaccgaagatggaagtgtagaagctaactatggtggcctactggtggagggccagttcactaatccaccgagagacagtgacccaagacgttcgttgtatctgacaaagtggacagccgtgacgagacggaggaccacggtctacgtactattacgtggtcgaccgtaccggattacgtggtacctaccggtntaagttcggtccgtccggtaccgggg

SEQ ID NO: 239812 - DNA, 768 bp, Homo sapiens
  misc_feature: GYAE6OF02JYYD0.21.15.B04.1.454.CMB.1.raw
  modified_base (611)..(611): a, c, t, g, unknown or other
  misc_feature (611)..(611): n is a, c, g, or t
  modified_base (634)..(634): a, c, t, g, unknown or other
  misc_feature (634)..(634): n is a, c, g, or t
  modified_base (755)..(755): a, c, t, g, unknown or other
  misc_feature (755)..(755): n is a, c, g, or t
tcagtcgtcgctcgcacgaccggtgctcgatttagacagtatatatccgcgggaggtctcagagaggagccttagccctcggactccaaggcctttccacttcggttgatcagcactgagcacagaggactcacactggaattgggctgagctggtttccgttgttggtcttattttagtaagggtgttccgagagtgaggtgaaaggtggtggagtcggggggaggcgttggtccgaggccgggggggtccctggaggacctggtacctgtggaagtctcgtaggtattgtagtagctagagacgttggattcgacgtacgttcggggtccgacccgtaggtaaccgtttcgaacgggttaaaagggggtcctagggtagggttacgggggttcggaccaaaccggtaacgttaaaaacccgaaaggacggttaaaggaaaggttcgttaaagggtaaacgccgtaaccttaaggttacgggtacgggtcccttgtttaggtcgggggtaagggggcccggtaatttacccggaacgtaaactccggtaaccctaaggtacgaaccgtaggttacgacccgtaaagggtactgggtttaactaccggttntacgacttaaagccggtaaacgnggtaccaggtcgaacggcccgtaaaggccggaaagtcccgtagttaccgtcttacgtggttcgggaccttaccgggaaccttaggacccggttactacggtcgtaacctttcggggttccnccggttaccgggg

SEQ ID NO: 239813 - DNA, 597 bp, Homo sapiens
  misc_feature: GYAE6OF02HS8AJ.21.15.B04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgcttattttagaaggtgtccagagtgaggtgaaagtggtggaggtcggggggaggcttggtccagggccgggggggtccctgagactgtcctgtgagtctcgtggattgtatagcagagtattggatgcacgtgggtccgccagacttacgagggaaaggtctggaggtgggtcgaccaaanataaaaccaagataggaagtgtagaagcaatagtgtggccctgtggtggacgggcgtattccaatactcctaccagacgtacgagtacgacctaaagacttcgttagtactcgtagtacaaagtacggacacgaccgtacggaggaccggaccgaggaaccgcgtcgtactacgttacttacgtcggcgtacggtacgtacgttacgtcggtacgttacgtacttaggtccgtcggtccggtaccgggg

SEQ ID NO: 239814 - DNA, 582 bp, Homo sapiens
  misc_feature: GYAE6OF02G7XEZ.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccgggggggtccctgagactgtcctgtgaagtctcgtggattgtatagcagagattggatgcactgggtccgccagacttcgaaggaaagggtctggagtgggtgccaacataaaccaagatggaagtgtagaagcactatgtggcctgtggtggaggggccagttcactaatctccagagacagtacgaccaaagaacgttcgttagtactcgtagactaaagtggaacagaccgtagaagacggtaccggaaggaaccgaccggtactccgtacttacgttacgtaggtcggaccgaccggtaatacgtaggtaccttacggtctaagttcggtccgtccggtaccgggg

SEQ ID NO: 239815 - DNA, 728 bp, Homo sapiens
  misc_feature: GYAE6OF02FKHN8.21.15.B04.1.454.CMB.1.raw
  modified_base (192)..(192): a, c, t, g, unknown or other
  misc_feature (192)..(192): n is a, c, g, or t
  modified_base (336)..(336): a, c, t, g, unknown or other
  misc_feature (336)..(336): n is a, c, g, or t
tcagtcgtcgctcgcacgaccggtgctcgatttagacagtatatatccgcggggaggtctcagagaggagccttagccctggactccaaggccctttccacttggtgatcagcactgagcacagaggactcaccatggaattggggctgagcgtgggttttccttgttgctatttagaggtgtccagagtgnggtgaagtggtggaggtcggggggagtcttgggtccagggcccgggggggtccctggagacgtgtcctgtgaagtctcgtggattgtatagcagagagttggatgactacgtgggtcccacgagtacttcgaaggtaagggtcngggtaggtggggtcggacccaacgaagttaaacccaaggacgttaggaaaggttcgtaggaaacggacctaacgtttaagtcgggttcggtacccgttcgtagggtggggtaccggggaccgtacggtttccaacgttaacgtaccttacccgaaggtaaccgtaacgagggttacggaacccaaagggtaacctttaccggttagtacttcgtaacgtacaaaggtcgggactacgacgtcggaagcggtacccgagggaacccgacggtactacccgttcgtttaactcggtacgttacggccggtaaacccgggttagtaccggttaaccggtcccggttacggtaccgttaaggtttccggtaccggtttacccggtaccccgggggg

SEQ ID NO: 239816 - DNA, 651 bp, Homo sapiens
  misc_feature: GYAE6OF02H3BGE.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaggtgtccagagtgaggtgaaagtggtgggaggtcgggggagcgttggtccgagggccggggggtccctggagacgtcgtccgtggtgaagttctcgtggtattgtatgcagagagttggatgcacgtggtccgcagacttacggaaggaacggtgtggtaggtgggtcggacaacaacgtaaaccgaagagtaggaaggtgtagaagcaatagtggtcgcctgtagtgggacgggtacgtacgtcaacgtaatccgtaacgtacgacgaactaggacgtaaccgaatacgttacggttgtaacgttacgtacgtactaaaggtacgtacgaccgtcgttacgggacgtacggacccgggaagtacccgacggtaccttaccgttacgttaacgttacgttacggtcggtaacccggtacggtacgtacgtacggtcctaccgtccgtaagtccggttaccggtcggtacccggg

SEQ ID NO: 239817 - DNA, 675 bp, Homo sapiens
  misc_feature: GYAE6OF02FSMZU.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcggggggaggcttggtccaggccgggggggtccctgagactgtcctgtgaagtctctggattgtatagcagagtattggatgcagtcgggtccgccagaccttcgaagggtaaagggtcgtagggaggtgggggtcggaccaacgaactaaaaccgaagacgtagggaagtgtagaagcacgtatggtggtaccctgtggtggacggggcctagttacactaatcctccaagagacgagtcggaccaaagtaaccttcggttagtacttcgtcgaactaaagtacggaacacgtaccgtaggaacggacgggacccgggaacgggaaccgtaccggtccttaccgttaccttacgttaccgttcgggttcggaaccgggtaacccggtaagttacggttacgggtacccgttaccggttaccgttaacggtttccgggtcccggttacccgggtaccccgggggg

SEQ ID NO: 239818 - DNA, 575 bp, Homo sapiens
  misc_feature: GYAE6OF02G112U.21.15.B04.1.454.CMB.1.raw
  modified_base (364)..(364): a, c, t, g, unknown or other
  misc_feature (364)..(364): n is a, c, g, or t
  modified_base (476)..(476): a, c, t, g, unknown or other
  misc_feature (476)..(476): n is a, c, g, or t
  modified_base (558)..(558): a, c, t, g, unknown or other
  misc_feature (558)..(558): n is a, c, g, or t
tcagtcgtcgctcgcacgaccggtgctcgatttagacagtatatatccgcgggggaggtctcagagaggagccttagccctggactccaaggcctttccacttggtgatcagcactgagcacagaggactcaccatggaattggggctgagctgggttttccttgttgcttattttagaaggtgtccagagtgaggtgaaagtggtggaggtcggggggaggcgttggtccgagggcccgggggggtccctggagactcgtccgtgtgaagtctcgtggtattgtatagcagagattggatcgctacgtcggtcccgccagtacttacgaagggaaagggtcgtgggaggtggggtggccaaanaactaaaaccgaagagtaggaagtgtagaagcactagtggtcggtcctgtggtggacggggccgtattaccactaatcctacgagacgacgagtcgaaccaagtacttgttntacttcgtgaactaagtgacagaccgtgacgacgcggacgacgaccgctctactatcgtggtcgacgacgatgtgactcgtntagtcgccgtgtccggg

SEQ ID NO: 239819 - DNA, 578 bp, Homo sapiens
  misc_feature: GYAE6OF02GWGNO.21.15.B04.1.454.CMB.1.raw
  modified_base (298)..(298): a, c, t, g, unknown or other
  misc_feature (298)..(298): n is a, c, g, or t
  modified_base (376)..(376): a, c, t, g, unknown or other
  misc_feature (376)..(376): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttcctgttgctattttagaaggtgtccagagtgaggtgaaagtggtggagtcgggggagcttggtccaggccggggggtccctgagactgtcctgtgaagtctctggattgtatagcagagattggatgcacgtgggtccnccagacttcaggaaacggtctggagtggggtgccaacactaaaccaagatggaagtgtagaagcactatgtggccttntgtggaggggccgtatcaacactctaccagacgacagtgaccaagtaaccttcggttgtacttctagactaaagtcggacacgcctagaacgacgaccggagaccacgggcttcgtacttagttaccgtggttacgccggtacccggtaattacgtcggtacttacgtccgtaacgtttcggacccggttccgtaccggggg

SEQ ID NO: 239820 - DNA, 602 bp, Homo sapiens
  misc_feature: GYAE6OF02JHIX5.21.15.B04.1.454.CMB.1.raw
  modified_base (299)..(299): a, c, t, g, unknown or other
  misc_feature (299)..(299): n is a, c, g, or t
  modified_base (348)..(348): a, c, t, g, unknown or other
  misc_feature (348)..(348): n is a, c, g, or t
  modified_base (464)..(464): a, c, t, g, unknown or other
  misc_feature (464)..(464): n is a, c, g, or t
tcagtcgtcgctcgcacgaccggtgctcgatttagacagtatatatccgcgggggaggtctcagagaggagccttagccctggactccaaggcctttccacttggtgatcagcactgagcacagaggactcaccatggaattggggctgagctgggtttcctgttgctattttagaaggtgtccagagtgaggtgaaagtggtggaggtcgggggagcttggtccaggccggggggtcctgagactgtcctgtgaagtctcgtggattgtatagcagagattggatgcagtcgggtccnccgagaccttcgaaggtaaagggtctaggaggttggggtggacccaaanactaaaaccgaagagtaggaagtgtagaagcaactagtgtggcctcgtaggtggacggggcaagtcaacgaatccaccgaagtagacagtcgacgaagaacttcgtgtactacgtnaacaaagtcggaactacgccgtagaacgacggaccggagaaccgacggtacgtaccttacgttacttacgtacggtacggacggtaaccggtataacgtggaccttacggtacgtactacggtccgtcggtaccgggg

SEQ ID NO: 239821 - DNA, 698 bp, Homo sapiens
  misc_feature: GYAE6OF02ICBVZ.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgcttattttagaaggtgtccagagtgaggtgaaagtggtggagtcggggggagcttggtccaggccgggggggtccctgagactgtcctgtgaagtctctggattgtatagcagagattggatgctacgtgggtcccgccaaggtccttacgaacgggtaaagggtcgtaggggaggttggggtggacccaaacgtaactaaaaccgaagtatagggaagtcgtagaagccatagtggcggtcctcgtggtgggaggggacctagttccaactaacgtccgtaaccgaggacgaacgacggttcgaacccgtaaagtaacccgtttggtttagtaaccttcgtacggtaactaaaacgttgggaacctacggaccgttacgggaagtaccgggaccgggtaaccggaaccgtaccgggtaccttaccgttacttacgtttacgtcggtaccggaccggtaaccggtagttaacgtccggttaccgttaccggtacttacggtttacgttcccgggtacccggtaccgggggg

SEQ ID NO: 239822 - DNA, 632 bp, Homo sapiens
  misc_feature: GYAE6OF02JYIHX.21.15.B04.1.454.CMB.1.raw
  modified_base (246)..(246): a, c, t, g, unknown or other
  misc_feature (246)..(246): n is a, c, g, or t
  modified_base (441)..(441): a, c, t, g, unknown or other
  misc_feature (441)..(441): n is a, c, g, or t
  modified_base (620)..(620): a, c, t, g, unknown or other
  misc_feature (620)..(620): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaagtgtccagagtgaggtgaagtggtggaggtcgggggagtcgtggtccgagtcccgggggggtccctgngactgtcctgtgaagtctcgtggattgtatagcagagtacttggatgactagtggtccgccaagcttacaggaaacggtgtaggtaggtggggtcggaccgtaaacagttaaaccaaggtatagggaagtagtgaaggcctaacgtagtagtcggtcctcgtagttacgggacggggtacctagtttcaaacgtnttaccgccgaacgaagaacgtacgtaggacccaaagtaaccgttcgttacgtaggttacctgtaacgtaagtaccggaacgtaacgccgttagaagacggccgtaacggaccggtacgcttacgtacctataccgttggacgtcgaccggtatacgtgtaccgtcgtatcgttaccggngtccggtacggg

SEQ ID NO: 239823 - DNA, 588 bp, Homo sapiens
  misc_feature: GYAE6OF02F5XS9.21.15.B04.1.454.CMB.1.raw
  modified_base (489)..(489): a, c, t, g, unknown or other
  misc_feature (489)..(489): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtcagagtgaggtgaaagtggtggagtcggggggagcttggtccaggccggggggtccctgagactgtcctgtgaagtctctggattgtatagcagagattggatgctacgtgggtcccgccagtacttcgaaggaaagggtctgggaggttggggtcggacccaaactaacgtaaaacccgaagtagtaggaaagtggtagaaagcaactagtggtcggcctgtaggtggacggggtcctattaccaactaactcctaccgagagacagtcgaccaagtactgttatactcagtactaaatggaacngacctgagagccgaagaccacggtctcgtactacttacgtgtcggaccggaccggtaatacgtggccttacgtcctaggttcgccggtccgtaccgggg

SEQ ID NO: 239824 - DNA, 898 bp, Homo sapiens
  misc_feature: GYAE6OF02G4FP9.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattgggctgagctgggtttccttgtgctatttagaaggtgtccagagtgaggtgaaagtggtggaggtcgggggagtcttggtccgaggccggggggtcctgagactgtcctgtgagtctctggattgtatagcagagagttggatgctacgtcgggtcccgaccagtaccttacgaagggaaaggggttcgtaggggtacgggtggggtacggtacccgaaacgtaacgtaaaaacccgaaaggtaacgtaggggtaaacgttggtaaggtaaacgaccgtaaccgttaagttcggttaccgggtccctttacggttacggggttacgggaaacccggggggttacccgttaacgttttaacccgaaacccgttaaaccgttccccgttaaacccggaacggtaaacggtaaacccggtaaacgggttacccggaaacccgtaaaacggttaaacccggtttaccggtttttaacggttaacccgtttaccgttaacgggaaaccgttaaaacggttaccgggaaacgtaacccggtaacccgggtttaagggaaccgggttacccgggaacccgggaaaccgggtaaacccggtacccgggttcccttaacccgtttaccgtttaaccgttttaccggttacgggttaaccgggaaccccgggtaaaccgggttaacgtttaccgggtaccggttacccgtttaaccggttagttaaccggttttccgggtacccgggtttccccgggtaaccggggg

SEQ ID NO: 239825 - DNA, 708 bp, Homo sapiens
  misc_feature: GYAE6OF02JZSE9.21.15.B04.1.454.CMB.1.raw
  modified_base (120)..(120): a, c, t, g, unknown or other
  misc_feature (120)..(120): n is a, c, g, or t
tcagtcgtcgctcgcacgaccggtgctcgatttagacagtatatatccggcggggaggtctcagagaggagccttagccctggactccaaggcctttccacttggtgatcagcactgagnacagaggactcacatggagttgggctgagctggtttcttgtgctaatttagagtgtcgagagtgaggtagaagtggtggaggtcgggggagcgttggtccgaggcccgggggggtccctaggacgtacgtgtccgtgtgaacgtctcgtggtattgtatagcaggtagtagttggatgcgtacgtcgggtcccgcgaggtacgttcgaagggaaccgggttcgtgggtagggtgggtacgaccgaaccgaagtaaaccgtaaaggagtagggaacgttgtaaggaacgacgtaacttaggtcggtcggtccgttcgtggtagggacggtaccgtacgttacgaacctagttccctacgacgaacgtaccgacgtacgaccaaaggtacctcggttacgttacgtacggtcgtaaacgtaaacggtggaacccgtggtaccctagggacccgtaagggacccggaaagggtaacccctaggtcccgttaccgttcgttaacttcggtacgggtccggaacccggacggtagtaaggttccggtaacgttcccgtacgttacggttacggcccggttaccggtaccgggg

SEQ ID NO: 239826 - DNA, 720 bp, Homo sapiens
  misc_feature: GYAE6OF02FIBIB.21.15.B04.1.454.CMB.1.raw
  modified_base (185)..(185): a, c, t, g, unknown or other
  misc_feature (185)..(185): n is a, c, g, or t
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (291)..(291): a, c, t, g, unknown or other
  misc_feature (291)..(291): n is a, c, g, or t
  modified_base (558)..(558): a, c, t, g, unknown or other
  misc_feature (558)..(558): n is a, c, g, or t
tcagtcgtcgctcgcacgaccggtgctcgatttagacagtatatatccgcggggaggtctcagagaggagccttagccctggactccaaggcctttccacttggtgatcagcactgagcacagacggactcaccatggaattgggctggacgcgttggttttcctggttgcttagtttagaggtnccagagtgagtagaacgtggnggaggtcgggggancttggtcccgngggcccggggtcctgcgtactcgtcctgtgacgtctcgtaggtacttgaatcgacgacgngtaacttggactcgactcggtccgtccgcctaagacttacgaacggtaacggtctagggtcggtacggtcgaaacccaaacctactaaaaacccgagtacgtaggaacgttcgaggaaacctcgtaacgtagttcgggtactccgttagtacgggtcgggtaccgggtccttaactacccgaattccgaacgtccgaaagtacgaccgaggttccgaaacctaacgtaaccttcggttgtaacttcgaacgtaaacgcgtagaaccnccggttacacggacgaaccgtaaccggacgacccgtcggtcctttacgtacctttcgggtaactttccgggaacgttacccggccggttaaattcccggtaccggttaccgttaccgtaaccgtccggtttacccggtcccggttaaccccggggtaccggg

SEQ ID NO: 239827 - DNA, 681 bp, Homo sapiens
  misc_feature: GYAE6OF02GE275.21.15.B04.1.454.CMB.1.raw
  modified_base (307)..(307): a, c, t, g, unknown or other
  misc_feature (307)..(307): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgtgcttattttagaaggtgtccagagtgaggtgaaagtggtgggagtcggggggagtcgttggtccgaggccggggggtccctggagactgtcctgtgaagtctctggattgtatagcagagagttggatgacacgtgggtccnccgagaccttcgaaggtaaagggtcgtagggaggtggggtacggacccaaagaactaaaaccgaagtagtaggaaagtgtagaaagcaactaagtgtcggcctcgtgtagagggggtccattcgactaaacgtcctaccgaggtaacgactacggtacgaaccgtaaacggtaaaccgtttcgttaacggttactaccgttaggaacctaaaggtacggaacgacgtaccgtacggaagtacgggacccggtaaggaccgaaccggcttacgtaccgtttacttacggtacgttcgggacccgtaacggtacttaacggtcggtaccgtttaacggtacgttacgtttcggtacccggttcggtaacccggggg

SEQ ID NO: 239828 - DNA, 864 bp, Homo sapiens
  misc_feature: GYAE6OF02GTWZ1.21.15.B04.1.454.CMB.1.raw
tcagtcgtcgctcgcacgaccggtgctcgatttagacagtatatatcccgcggggaggtctcagagaggagccttaggccctggactccaaggcctttccacttggtgatcagcactgagcacagaggactcaccatggaattggggctgagctgggttttccttgttgctattttagaaggtgtccagagtgaggtgaaagtggtggagtcggggggagcttggtccaggccggggggtccctggacgactgtcctgtgaaggtctctggattgtactagcaggacgattggatgacacgtcggggtccgccgagtacttcagggaaaacggggttctagggtacgtgggggtacggtccgaaactaataaaacccgaagaacgtggggaaagttggtagaaagggcctaaccgttatacggttacgggtccccttagtaggttagggacggggggtaccccggtaagtttcccgaaacgtaaacgttcccgttaccccggaagtaacgggaaccgtaaggttacggaccccggtaaaaggaacccgtttccgggtttacggttaagtttaccccgttagggaaaccgtaaaacgtacgggtaacccgtaaacggtaccccggttagggaaccgggtaaacggaccccggggtaaagggtaaccccggtaaccggggttaccctttaacccggtttaccgtttaaacgtttaacccggtttcgggtttaaccgggaaccccgggtttaaacccgggggtaaactttacccgggtacgggggtttaacccgttaacccggggttttaacccgtaacgggtttttccgggaacccggggtttccccgggtttaccccgggggggg

SEQ ID NO: 239829 - DNA, 942 bp, Homo sapiens
  misc_feature: GYAE6OF02IJDPV.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcacatggaattgggctgagctgggtttcctgttgctattttagaggtgtccagagtgaggtgaaggtggtggaggtcggggggaggcgttggtccgagggccgggggggttaccctggagacgttcgtccgtagtcggaagtcttacgtggtagttacggttagtacgtcgaggaaggtagttagggtaagtaggtaccgtaacggttcgggggttaccccggacccgtaagtacccccccgtttacggtaaagggggtaaaaacggggttccgtaggggtaaggggttcgggggttaccggggaaccgtaaaacccgtaaacgttaaaaacccccgaaaagggtaaaccggttaaggggaaagggtttacggtaagggtaaaacggtcgtaaaaccgtagtttaggggtacgggtacccgtttaccgttaggggttacgggtaccgggggtaccggttaacggtttacccgtaaacgttaaacgttccccgttaaccggaaacggaaacggtacgtaacgggttacggtaaccccggtaaaacggttaaccggtttaccggtttaggtttaaccgttaccgttaacgtaaacgttaaacggtacgggtaaccggtaaaccggtaccggtttacgaaccgggaacggttacccgggaacgggtaacccggacggttaccgtacccgttaacggtttaccgttaacgtttccgggtaaaccggtccggtaaccgggtaaacgttacgggttaaccggtcggttaacccggttacgttacggttttcggtaccccgggttaccggtacccggggg

SEQ ID NO: 239830 - DNA, 665 bp, Homo sapiens
  misc_feature: GYAE6OF02JGKVZ.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggagcttggtcaggccggggggtccctgagactgtcctgtgaagtctctggattgtatagcagagtattggatgcacgtggggtccaccgagacttcgaagggaaagggtctggaggtgggtacggcctaacataaaccgaagatgggaaagtgtagaagcaactatgtcggacctcgtgtcggagggggcctaattccgaactaaacgtccgtaccaaggtacgaaccgtagtacgaccaaagtaactacggttgtactacgtcgacgtaaatcgggaacacggtacctaggacgtacgacccggaagtaccgaccggtctaccgttacgttacgtttaccgtacgggtttacggacccgggtaaaccgggtaacgttaccggttagggtacccgtttaacgggtacccgttaaggtttccggtacccgggtttcccgtaacccggggggg

SEQ ID NO: 239831 - DNA, 612 bp, Homo sapiens
  misc_feature: GYAE6OF02GO4OZ.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcgttggtccaggccgggggggtccctgagactgtcctggtgaagtctcgtggattgtatagcagagattggatgcgacgtcggggtccgccgagaccttcgaagggaaagggtcgtgggaggtggggtcggaccaaacaataaaaccgaagaagtaggaagtggtagaagctaatagtagtcggcctgtgtagggagggcctagttcaacaactctaccgagagacagtcgaccaaagacgttacgttgtaatcgtagacaaatcgggactacgccgtagtacggacgtacgagggtacaccggtctaccgtacgttacgtactgggtaccgaccggtaccggtagtacgtaggtacctacgtaccttgttacggtccgtccgggtaccgggg

SEQ ID NO: 239832 - DNA, 640 bp, Homo sapiens
  misc_feature: GYAE6OF02GHB2E.21.15.B04.1.454.CMB.1.raw
  modified_base (183)..(183): a, c, t, g, unknown or other
  misc_feature (183)..(183): n is a, c, g, or t
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (234)..(234): a, c, t, g, unknown or other
  misc_feature (234)..(234): n is a, c, g, or t
  modified_base (285)..(285): a, c, t, g, unknown or other
  misc_feature (285)..(285): n is a, c, g, or t
  modified_base (321)..(321): a, c, t, g, unknown or other
  misc_feature (321)..(321): n is a, c, g, or t
  modified_base (499)..(499): a, c, t, g, unknown or other
  misc_feature (499)..(499): n is a, c, g, or t
  modified_base (521)..(521): a, c, t, g, unknown or other
  misc_feature (521)..(521): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcggtgttcgtgtaggcgtattagaggtgtcagntgagtgaagtgtggngtcgggggagnttcggtcnggccgggggtccagagntgtcctagtgacgtcgtctggtagttgtataggcagtagtagttggatgcncgtgggtccgaccagtacgttcgaagggtaacggtntcgggtaaggttggggtcggaccaaacgacttaaaaccgaagtacgtcgggtaaagtggttagaacgtacagtatggtacggtccttgtagggcggaggggaacttcgtacgtacgattccacgacgtaggacctaggtcccgaacgtaacgtaaccgttggttactaaagtttccgngttaacgaacgttggaaaccgnggtactggacgtacggaccgacggtacgtcgtacttacgttactagttaccgtcgggtacgtaccggtaccgaggttacgttcggtacgttcgtacgtcgtttcggccggtcgtacggg

SEQ ID NO: 239833 - DNA, 645 bp, Homo sapiens
  misc_feature: GYAE6OF02ILQI1.21.15.B04.1.454.CMB.1.raw
  modified_base (374)..(374): a, c, t, g, unknown or other
  misc_feature (374)..(374): n is a, c, g, or t
tcagtcgtcgctcgcacgaccggtgctcgatttagacagtatatatcccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaagtggtggaggtcggggggagcgttggtccaggccggggggtccctggagactgtcctgtgaagtctcgtggattgtatagcagacgattggatgcacgtgggtccgctaggacttcgaggtaagggtctgggagtgggtgaccaagtactaaaccgaagagtaggaagttacggngaaagcaacgttagtcggtcggccttgtggtagggtacggggcctagttcactaatccacgaggacgtaacagtcgacctaagtaaccttcggttacgtattccgtaacgtacgtaaagtcggaaccgacgtcccgtagaacggtcgggacccgggaagggaacccgtaccggtacccgtactttcgttacttacggtcggtaccgggtacgacccggttaatacggtagtacgtaccggttctacggtttcgccggttccgtaccggggg

SEQ ID NO: 239834 - DNA, 907 bp, Homo sapiens
  misc_feature: GYAE6OF02IQHMS.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaagttggggctgagtcgttgggttttccttgttgctattttagaggtgtccagagtgaggtagaaggtggtgggaggtcgggggaggtcgttcggtccggagggtcccgggggggttcctggagtacgttcggtccgttgtggaagttcgtcgtaggtagttaggtagttaacggcgaaggtaggtagtttaggtaagttcggtacgtacggtcgggggttccccgacccgtaaggtaaccgtttcggaaaacggggtaaacgggtcggtcggggtaggtttacgggggtacgggaaacccaaaacgtaacgtaaaaaacccggtaagggtaaacggttacgggaaaagggtttggaaaggaaccgggacctaaaacgtaggttcgggtacggtacccgttggttacggggttaaggggacccgggggtaaccgttaacggttacccgaaacccttaaggttacccgtaaccccgtaaagggacgttaaccgtagggttacccggaaccggtaaaacttaccgggtttacggttaacgttaacgttcgttaacgggtaaacgttaacggtgggtaaaacccgtcgtacccgttaggggaaccctaacggggaccggtaaacgaaccggtcccggtaaacctttcggtacccttttaacggtaccgttacggtacccgggtaacccggtaacggtttaacgtacggttacggtaccgtttaacccggtcgtttaaccgttccgggtaccggttccggggttaaccccgggg

SEQ ID NO: 239835 - DNA, 789 bp, Homo sapiens
  misc_feature: GYAE6OF02IJKSQ.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctggttttccttgttgctattttagaggtgtccagagtgaggtgaaagtggtggaggtcgggggaggtcgttggtccgagggtcccggggggtccctggacgacgtcgtcctgtagagtctcgtggtattgtatagcagagtagttggagtcgcgtacgtcgggtacccgccgtacgtaccgttacggaagggtaaacgggtcgtaggtagggttggggtcggaacccaaacgtaaacgtaaaacccgtaaagtagtaagggaagtaggtagaaacggactacgtttagtcggtcggtacctcgtggttacgggacgggtaccgtacgttacgaacgtacgttacccgtaccgaaggaccgtaacgtacggttcgaaacccgtaaacggtaaccgtttccggtttaacggttaacttcggttaacgtaacgtaaacggtacgggaaccgtacggtaccgtaggaccggaacggtacccgggaacgtaacccggtaccggtccccgtttacgttacctttacgtttaaccggtggttaacccggtacccggtaccggttaacgttaacggtaccgggttaacccgttaaccggttcttaaccggtttcggtaccccgggttaccgggtaaccccgggggg

SEQ ID NO: 239836 - DNA, 796 bp, Homo sapiens
  misc_feature: GYAE6OF02ICNHG.21.15.B04.1.454.CMB.1.raw
tcagtcgtcgctcgcacgaccggtgctcgatttagacagtatatatccgcggggaggtctcagagaggagccttagccctggactccaaggccctttccacttggtgatcagcactgagcacagaggactcaccatggaattggggctgagcgttgggttttccttgttgcttattttagaaggtgtccagagtgaggtagaaagtggtgggaggtcggggggagtcgtttggtccgagggtccccggggggggttccctggacggtacttcggtcccgttggtagtaagttccgtcgttaggtatttaggttaatacggtacgaggtaagtagtttagggaatcgactacggttcggggttccgacccgaaggtacctttacggaacggggaaacggggttccgtagggtagggtcggggttacgggaccctaaacgtaaacgttaaaacccgaaggtaacgttacggggtaaagtggtaggaaacgctaaccgtagttcggtacggtcccttagtcggtacgggacggggtaccgtacgtttaccgaactaaacgttcccgtaaccgaacggtaacgaaccgtaagtaccgaacccgtaaacggaacctttcggttaaacgttacgtacgttacgaactaaaggtacggaacgttacgtaccgtagaacggtacggacccggtaacgacccggtacggaccttacgttacttacgttacgttggtccggaccggtacgtacgttacgtcggtacttaacgtcgttaagttccggtaccggtccggtacccgggg

SEQ ID NO: 239837 - DNA, 798 bp, Homo sapiens
  misc_feature: GYAE6OF02GEKBE.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcgttgggttttccttgttgcttattttagaggtgtccagagtgaggtgaaagtggtggaggtcgggggagcgttgggtcccgagggtcccgggggggtccctggacgacgttgtccttgtagtaacgtctctggatttgtataggcaagagagttaggatgcaccgttgggtcccaccgtaggtccttcggaagggtaaaacgggttctaggggtaagggtggggttacgggaccctaaaacgtacggttaaaaaccccaagggtaacgtacggggtaaaggttcgggtaacggaaacgtacgttaacgttttaagtacgggtttcggtaccccgttacgttacggggtagggtaaccgggggggttccctaaacgtttacccgtaaaccgtaaacgtttacccgttaaccccggtaaggtaaacgggtaacgtaacggtaccggtaacccgtaaaacggttaaacgttacggtttacgttaagttcccgttaaggaaccgttaaaggtcgggaaccgtcggaaccgttaggaacggtaccggaccggttaccgggacgtaaccggtccgttactacggttacttcgtacggtggtaccgtaacgtagttacgcgtacgttcgtcaagttcgtacgtcggtacccggg

SEQ ID NO: 239838 - DNA, 581 bp, Homo sapiens
  misc_feature: GYAE6OF02HUDYS.21.15.B04.1.454.CMB.1.raw
  modified_base (325)..(325): a, c, t, g, unknown or other
  misc_feature (325)..(325): n is a, c, g, or t
  modified_base (450)..(450): a, c, t, g, unknown or other
  misc_feature (450)..(450): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgcttattttagaaggtgtccagagtgaggtgaagtggtggagtcggggggagcttggtccaggccggggggtcctgagactgtcctgtgagtctgtggattgtatagcaggagattggatgcacgtgggtccgccagacttcgaagggaagggtctggnggtgggtggaccaacataaaccgaagtagtaggaagtgtagaagcactatgtgcctagtgtggacgggctattcacaactctacagagacagtcgacctaagtacttcgttgtattcgtcgtaanaagtcggaacacgtcctaggagcggaccggaggaccgacggacttcgtacgttacttacgtggtcggtaccggaccggtaattagtacggtacttacggtacgtacgttcggtccggttaccggtccgggg

SEQ ID NO: 239839 - DNA, 691 bp, Homo sapiens
  misc_feature: GYAE6OF02IXJGY.21.15.B04.1.454.CMB.1.raw
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
  modified_base (650)..(650): a, c, t, g, unknown or other
  misc_feature (650)..(650): n is a, c, g, or t
tcagtcgtcgctcgcacgaccggtgctcgatttagacagtatatatccgcgggggaggtctcagagaggagccttagccctggactccaaggcctttccacttggtgatcagcactgagcacagaggactcaccatggaattggggctgagcttgggttttccttgttgcttattttagaaggtgtccagagtgaggtgaagtggtggaggtcggggggagcgttggtccgagggcccgggggggtccctggacgtacgtcgtcgtgagtacgtctgtgtgtagtagtanacgagtagtgtagtntcgacgtacggtcggtccgacgacgtacgtacggaagggtacggtcgtagggtacggtgggtacgaaccgaataaaccgtaaacgtaaggacgtaggagtaggtagaacgtactagtcgtaggtcggtacttggtggtcggggacggtacctaacgtacaaccgttaagtccgaccgtaaagggtccaaactcgggtaaccgaacccgtaaaacgttccgttcgtttaacgtacgttacgtacggtaaactaaggtaccggtactacggtacgaggacgtaccggacgtaacgacgtacgtctccgttaagtacttcgacgggtacgaaccggtcaggttaccgnggttactacggtccgttaggtccggtccggtccggtacggg

SEQ ID NO: 239840 - DNA, 654 bp, Homo sapiens
  misc_feature: GYAE6OF02JR7FF.21.15.B04.1.454.CMB.1.raw
  modified_base (430)..(430): a, c, t, g, unknown or other
  misc_feature (430)..(430): n is a, c, g, or t
  modified_base (478)..(478): a, c, t, g, unknown or other
  misc_feature (478)..(478): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctatttagaaggtgtccagagtgaggtgaaagtggtggaggtcggggggaggcgttggtccgagggccgggggggtccctggagactgtccctgtgaagtctctggattgtatagcagagagttggatgctacggtgggttcccaccgacgtacttacgaaggtaaaggggtccgtagggtaggtcggggtgggaccccaacgactaaaacccgaaggtaagtgggaaacgtgtaggaaacgcgtacgtagtacgtggtaccncgtgtggacggggcctaagttcgactaagtccgtccaaggacgaacgngtcgaaccctaaagacttcggttatattcagtacaagtgaacgacgtccgtagagggaaccgccgaaggaccacgggtacctctaaccgttattcgggtagtaaccggcggtaaccggtacgttagttaggcccgtttacgaccggttagttccggtccgttacgggtacccgggg

SEQ ID NO: 239841 - DNA, 706 bp, Homo sapiens
  misc_feature: GYAE6OF02HJFUX.21.15.B04.1.454.CMB.1.raw
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggtttcctgttgctattttagaaggtgtccagagtgaggtgaaagtggtggagtcggggggagcgttggccgaggccggggggtccctggagactgtcctgtcgagtctctaggattgtatagcagagtatggatgcagtcggtcnccagcttgaacgggaaggtctgggacgtgggtcgaccaanataaaccgaagngtggaacgtggacagcagtatgtagctgtgaggcgggctagtcactaatcctaccgtaaggacgacgtaggtacgacccgtaaaaggtaccgtacggtttaagttaaccgttcgtaccggtaaacgtaaacggtttaggaacccgtaacggtacccgttaacgggaaccgggtaaccgggaaccccgggtaaccgggaaaacccgggtcccggtaccgtttaaccccggttaagtttacccgttaacgggtttaccgggttccggaaacccgggttacccgggtaagttaaccggtcgggttacccgttaaccgtcgtaacccgtttgggttacccggtcccggttaccgggggg

SEQ ID NO: 239842 - DNA, 715 bp, Homo sapiens
  misc_feature: GYAE6OF02IPWOH.21.15.B04.1.454.CMB.1.raw
tcagtcgtcgctcgcacgaccggtgctcgatttagacagtatatatccgcgggggaggtctcagagaggagccttagccctggactccaaaggcctttccacttggtgatcagcactgagcacagaggactcaccatggaattggggctgagctgggttttccttgttgctattttagaaggtgtccagagtgaggtgaaagtggtggagtcgggggagcttggtcaggccggggggtcctgagactgtcctgtgagtctcgtggattgtatagcagagattggatgcacgtcgggtcccgcagtacgttcgaagggaaagggtcgtagggaggtggggtacggaccgaaacgaaacgtaaaaccgaagaagtagggaagttggaagaacgtacaactagttaggtcggtcccgtcgttaggtagggtaccgggggacctaagttaccaacgtaaacttcccgtacgaaggacgaacgtaagtcgaaccgtaaaggtaaccttacggttagttactacgttacgaactaaaaggtcgaacgaacggtaccgtaggaacgtaacggaccggaacgggaaccgaaccgggtccttaccgttacgttaacgtttaaccgtggttaacggacccgggtaaaccggtagttacggtacgggtaccgtttaacggttaccgttaacggtttcggtccccggttaccgggttaacccggggg

SEQ ID NO: 239843 - DNA, 590 bp, Homo sapiens
  misc_feature: GYAE6OF02GX9U8.21.15.B04.1.454.CMB.1.raw
  modified_base (401)..(401): a, c, t, g, unknown or other
  misc_feature (401)..(401): n is a, c, g, or t
  modified_base (456)..(456): a, c, t, g, unknown or other
  misc_feature (456)..(456): n is a, c, g, or t
  modified_base (467)..(467): a, c, t, g, unknown or other
  misc_feature (467)..(467): n is a, c, g, or t
tcagtcgtcgctcgcacgaccggtgctcgatttagacagtatatatccgcgggggaggtctcagagaggagccttagccctggactccaaggcctttccacttggtgatcagcactgagcacagaggactcaccatggaattggggctgagctgggttttcttgttgctattttagaaggtgtccagagtgaggtgaaagtggtggagtcgggggagcttggtccaggccggggggtccctgagactgtcctgtgagtctctggattgtatagcagagattggatgcacgtcgggtccgccagacgttcgaagggaaacgggtcgtaggaggtggggcggaccaaacgtaataaaaccgaaagagtaggtaaggtgtagaaagacaatagtagtcggcctntgtgggaggggcctagtcaacgaatctacagagacagcgaccaagacttacgttntactcgtgaanaactggacacgtactagaacgacgacgaagacgacgtactcttactacgttacgtaggtacggacggaaccggtataacggtacggtacgtaacgtactacggtggtccgtaccggtaccggg

SEQ ID NO: 239844 - DNA, 660 bp, Homo sapiens
  misc_feature: GYAE6OF02FK5NB.21.15.B04.1.454.CMB.1.raw
  modified_base (608)..(608): a, c, t, g, unknown or other
  misc_feature (608)..(608): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaggtgtccagagtgaggtgaaagtgggtggaggtcggggggagcgttggtccgagggccggggggtccctgagactgtcctgtgaagtctctggatttgtataggcaagagagtttggatgcacgtcggggtcccaccgagtacttacgaagggtaacgggtctgggaggttggggtcggtaccaaacgaagtaaaacccgaagagttaggaagtagtacgaagctactagttgacggtcctagtcggaggacggggtctaacgttcaacgtaactccgtacgaacgtagaccgtaggacgacgtaaacgtaacgttcgttagtacgttacgtgaaccagttacggacgtaacgcgtaggaacggtacggaccggaaggtaccgaccgtccgttacgtactttacgttactcgggtacgtcgaacccgggtnttacggtacggtaccttacgtaccgttacttccggtcgtcccggtacggggg

SEQ ID NO: 239845 - DNA, 712 bp, Homo sapiens
  misc_feature: GYAE6OF02HXTH2.21.15.B04.1.454.CMB.1.raw
tcagtcgtcgctcgcacgaccggtgctcgatttagacagtatatatccgcggggaggtctcagagaggagccttagccctggactccaaaggcctttccacttggtgatcagcactgagcacagaggactcaccatggaattgggctgagctggttttccttgtgctatttagaaggtgtccagagtgaggtagaaagtggtggaggtcgggggaggcgttggtaccgaggccgggggggtcctggagacgtcgtcctgtgaagtctctggattgtatagcagagattggatgctacgtgggtccgaccagtacgttcgaacgggtaaagggtcctagggtaggtggggtacggacccgaaacgtaaagtaaaacccgaaaagtacgtagggaaacgtgttaacggaacgtacgtaacgttaagtgtcgggtacctcgttggtacggacggggtactacttacgaagtaactcgtaccagtagtaacgagtacgacgaaacgtaacgttacgttagtactcgttacgaataaacgtcgggaacgtaacgtccttaaggacggtaaacgccggtaaacggaaccgtaccggaacgttaccgttacgttaaccttacggttaacggtacggtaccggtaaccggtaactttaagggccgtaaccggttacggttaaccgttaacggtaccggtcggttacccgggtaacccggg

SEQ ID NO: 239846 - DNA, 752 bp, Homo sapiens
  misc_feature: GYAE6OF02I6I9L.21.15.B04.1.454.CMB.1.raw
  modified_base (483)..(483): a, c, t, g, unknown or other
  misc_feature (483)..(483): n is a, c, g, or t
  modified_base (704)..(704): a, c, t, g, unknown or other
  misc_feature (704)..(704): n is a, c, g, or t
  modified_base (713)..(713): a, c, t, g, unknown or other
  misc_feature (713)..(713): n is a, c, g, or t
tcagtcgtcgctcgcacgaccggtgctcgatttagacagtatatatccgcggggaggtctcagagaggagccttagcccctggactccaaggcctttccacttggtgatcagcactgagcacagaggactcaccataggaagttggggcttgaagtcgttgggtttttccttgttgtacttatttttagaaggtgtaccgagagttgaggtgaaaggttcggtggacggtcggggggagtcgtttgggtccgagggccgggggggttcccctggacgacttcggttccgttggtagaagttccttcgtaggtactttgtaattacggagtaaggaagtaagtttgggactcgtaccgtacggttccgggttaccccgcaacggttccgttacgaaagggggtaagggttccgtaggggtcgtaggggtccgacccaagtaaaccaaacgaaagtaagtcggaaagttggtacgaacgacgtanaacgttttcggcggtcccttaagttccggacgggtagggggcctttaacgtctaaccgaaccctcgttaaccacggaaacttacggacgtacgaaccgtaacgtacgttcgttatacgttacgtcgtaacgaaacgttcgaaccgctacggtggacgaacgtccgaaacgccgttacggtacctcccggttaattaccgttaagttggccgtaggtaaccngtttaccgngtacccgttagtcccgtagtgggttccctcggtaccggg

SEQ ID NO: 239847 - DNA, 545 bp, Homo sapiens
  misc_feature: GYAE6OF02G9C5I.21.15.B04.1.454.CMB.1.raw
  modified_base (341)..(341): a, c, t, g, unknown or other
  misc_feature (341)..(341): n is a, c, g, or t
  modified_base (373)..(373): a, c, t, g, unknown or other
  misc_feature (373)..(373): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (481)..(481): a, c, t, g, unknown or other
  misc_feature (481)..(481): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggtttcctgttgctattttagaaggtgtccagagtgaggtgaaagtggtggagtcggggggaggcttgggtccaggccgggggggtccctggagactgtcctgtgaagtctctggattgtatagcaggagagttggactgcactgggtccgcagacttcgaggaagggtctggagtgggtgccctaanataaccgagatggaagtgtagaagcatatggngcctctgtggaggggcatcacatcncganacgacagtcacaagacttcgttgtattcgtnanaagtgacacgcctgagacgccgacgcacggtctacgtctattaccnggtcgaccggtaccgggattacgtggaccgttacgtctaggttacggtccttcggtaccggggg

SEQ ID NO: 239848 - DNA, 603 bp, Homo sapiens
  misc_feature: GYAE6OF02JCZUQ.21.15.B04.1.454.CMB.1.raw
  modified_base (301)..(301): a, c, t, g, unknown or other
  misc_feature (301)..(301): n is a, c, g, or t
  modified_base (402)..(402): a, c, t, g, unknown or other
  misc_feature (402)..(402): n is a, c, g, or t
  modified_base (421)..(421): a, c, t, g, unknown or other
  misc_feature (421)..(421): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcgggggagcttggtccaggccggggggtccctgagactgtcctgtgaagtctcgtggtattgatgcagagtattggatgcacgtgggtccnccagtccttcgaaggtaacgggtctgggaggtggggcgaccaaacactaaaaccgagagtaggaagtgagagcatagtgagctgtggaggacgggcctatnactactctacgagagacgngtagaccaaagtacgttcgttagtactcgtagaactaagtcggaactacgtacctagggaacgacggaccggtaacgaccgtcggaccttcgttacttacgttacgtacggtcggaaccggtacggtagttacggtgaacccgttcgtaccgtaggttaccgtccggtacccggtaccgggg

SEQ ID NO: 239849 - DNA, 873 bp, Homo sapiens
  misc_feature: GYAE6OF02I5LA9.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggtttccttgttgctatttagaggtgtccagagtgaggtgaaagtggtggaggtcggggggaggcgttggtccgagggtcccgggggggtcctggagactgtccgtgtgagtctctggtattgtatagcagagtagttggatgcgacgtcgggtccgccaagtacttcgaacgggtaaacgggttcgtagggtaggtcggggtacggtacccgaaacgtaacgtaaaaacccgaaaggtaaggtaacgggtaaaggttaggttaacggaaaggaccgtaaacgtttaagtacgggttccggtcccgtttacgttagggtacgggttaacggggggccccgttaaagtttacccgtaaacggtaaacctttaccggtaccccgtaaagggtaaaccgtaacggtaacggtaccggtaaaccggtaaaaccggttaaaccggtttaccggtttaacggtttaaccgttacggtttaaccggtaacgtaaaaggtaacccgggtaacgaaccgggttacccgtacggtaaacgggaaccgggtacccggaacgggtaacccggtaacccggtaccggttacccttaaccgttaaccgttacggttaccggtaccgggtaaccccggtaaccgggtaaaccgtttacgggtaacccggttaccggttaacccggttacgtttaacgggtttccggtacccgggttacccgttaacccggggggg

SEQ ID NO: 239850 - DNA, 601 bp, Homo sapiens
  misc_feature: GYAE6OF02FY3HL.21.15.B04.1.454.CMB.1.raw
  modified_base (434)..(434): a, c, t, g, unknown or other
  misc_feature (434)..(434): n is a, c, g, or t
tcagtcgtcgctcgcacgaccggtgctcgatttagacagtatatatccggcggggaggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccgggggggtccctgagactgtcctgtgaagtctctggattgtatagcagagtattggatggcacgtgggtccgccagacttcagggaaaggtctggagtgggtggccaacataaaaccaagataggaagtgtagaagcactatggtgcctctgtggaggggccgatcacaatctcagagacagtcgaccaagaacttcgttntatctgacaaatggaacacgtcctagagacgaccgggaaggaaccgaccgggtcttaccgttcttacgttaccgtaggttacggtacccgggaacccgggtaattacggtcggtaccttaaccggttccttaacggtttcgggtaccggttcccggtacccgggggg

SEQ ID NO: 239851 - DNA, 804 bp, Homo sapiens
  misc_feature: GYAE6OF02FU3EI.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcgttgggttttccttgttgcttagttttagaaggtgtccaggagtggaggtgaaagtggtggaggtcggggggagcgttgggtccgagggccggggggttccctggacgactcgtccgtggtagaacgtctcgtggtattgtattagcagagtagttggatcgcgtacggtaggggtcccgaccgaggtaccgtttaccgaacggggtaaacggggttccggtaggggtttacggtgggggtcggaaccctaaacgtaacgtaaaaacccgaaggtagtagggaagttcggtagaacgtcaacgtagtggtacgtcctacggttggtaggggtacgggaccgtagtccgaaacgtactacctaccgaaggacgtaccgagaccgtaaccgtaaggtaaccgtttcggtttacgtaacgttaccggtagtaaaccgtaaacggtcgggtaactacgggttaccgtaagggaccggtaaccggtaacgggaaccgggtacgtaacccgggtcgtttacccttggttttaacccgttacggttacgggtaccgggtaccgttaaccggggttaaaccgttggttacccggttacgtttaaccgggtaccgttttaacgggtcccggtttaccggggtccccgggttaacccgggggg

SEQ ID NO: 239852 - DNA, 751 bp, Homo sapiens
  misc_feature: GYAE6OF02I27Q8.21.15.B04.1.454.CMB.1.raw
  modified_base (356)..(356): a, c, t, g, unknown or other
  misc_feature (356)..(356): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccagtggaagttggggctggagtcgttcgggtttttccttgttgtctttaagttttaggaagggttctaccgaggtaggtggaggtaggtaaaggtgggtagggtaggggtcgggggggagttcgttacgggtccggacgggggtcccggggggtcctggagtcgttcggtccgtggtagtaacgtcctgtggtagttcgtagtagcgtagtagtagttgagtcncgtacggtcggtacccgcagtaccgtacggaagggtaacggtcgtaggtagggtgggtaccgaccgaaagtaacctaaaaccgaaggtaacggttaggtaagttgggtaacgaacgacgtaacgttgtcgggtcgtaccttcggtacgggtaggggtaccggtccgtacgttaccgtaaccgtaacgtacgtaaccgaaggacgtaacggtacgtacggaaacgtaaccgtaccggtttaggttcgttaacgttcgttaacgtaacgtaaacggttcgaacgaccgtacgagaacggccgacgtacgcacggtctacggtactacgttcgtcggccggtaacgcgtatacggtcgtacggttctccgtacgtccggtaccggtacgggtaccggg

SEQ ID NO: 239853 - DNA, 724 bp, Homo sapiens
  misc_feature: GYAE6OF02JX0NR.21.15.B04.1.454.CMB.1.raw
  modified_base (233)..(233): a, c, t, g, unknown or other
  misc_feature (233)..(233): n is a, c, g, or t
  modified_base (380)..(380): a, c, t, g, unknown or other
  misc_feature (380)..(380): n is a, c, g, or t
  modified_base (404)..(404): a, c, t, g, unknown or other
  misc_feature (404)..(404): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatgaattgggctgagctggtttcctgttgctatttagagtgtcagagtgagtgaagtggtggagtcgggggagcttggtccacggccggggggtccctgngacgtgtcctgtgagttctacgtggattgtatagacgagcgagttcggatgcacgtgggttcccgaccgagtacttcgaaggtaaaggtctacgggagtacggggtcgacaaccgaagtaaaccgaagtagtaggaaagtcgtaganactatagtagtcgccgttacgtgnggacgggtccacgttacaaccgtaactccgttaaccgacgaagtaccgtaggtacgtacccgtaaagtaccggtttaccgtttacgtaaacgttccgtaaggacccgttaaaaggtcggaaaccgaacggttacccgaacggtaccggttaaacgggacccccgggttaaagggaaccccggtaacgggtacccgttttaaccgtacccgtttacggttaaccggtttcggtaccgggtaaccgttacgggtaaccttaacggtccggttacgttaccgtacgttaccgtttcggtacccgttacccgggtaacccgggg

SEQ ID NO: 239854 - DNA, 719 bp, Homo sapiens
  misc_feature: GYAE6OF02IGD24.21.15.B04.1.454.CMB.1.raw
  modified_base (640)..(640): a, c, t, g, unknown or other
  misc_feature (640)..(640): n is a, c, g, or t
tcagtcgtcgctcgcacgaccggtgctcgatttagacagtatatatccgcggggaggtctcagagaggagccttagccctggactccaaggcctttcccacttggtgatcagcactgagcacagaggactcaccatggaattgggctgagcgtggtttctgttgctagttttagagtgtcagagtgagtgaaagtggtggaggtcgggggaggcttggtccgagggtccgggggggtccctgaggtacgtgtccgtgtcggtaagttcgtcgtggtaagttcggtagtagtaccgaaggtagttagttggtaagtcgtaccgaccggttcgggtacccgaccgaactacgttacgaagggtaaaacggtcgtaggtaggttgggtacggaccgaaactaacgtaaaacccgaagtaaggtaggtaaagtggtaaggaaacgttacgaacccgttaaggttcggtacggtcccgtagtttaggtaccgggggacggggtacccgtagtttaccgtaactaaccgttaccgtacccgaagggtaacgtaaccgtacgtcggaaacccaaaggttaacccgtttacgtagttaactcgtagtaacctaaggaccgagtaccgactgacgagaccgtaggaccnggactcgtattacgtctagtccggtaccgacgagttacgcgggttactacggtcctaggtcggttccggtggtaccggg

SEQ ID NO: 239855 - DNA, 609 bp, Homo sapiens
  misc_feature: GYAE6OF02ILDDV.21.15.B04.1.454.CMB.1.raw
  modified_base (291)..(291): a, c, t, g, unknown or other
  misc_feature (291)..(291): n is a, c, g, or t
  modified_base (321)..(321): a, c, t, g, unknown or other
  misc_feature (321)..(321): n is a, c, g, or t
  modified_base (332)..(332): a, c, t, g, unknown or other
  misc_feature (332)..(332): n is a, c, g, or t
  modified_base (364)..(364): a, c, t, g, unknown or other
  misc_feature (364)..(364): n is a, c, g, or t
  modified_base (407)..(407): a, c, t, g, unknown or other
  misc_feature (407)..(407): n is a, c, g, or t
  modified_base (492)..(492): a, c, t, g, unknown or other
  misc_feature (492)..(492): n is a, c, g, or t
  modified_base (505)..(505): a, c, t, g, unknown or other
  misc_feature (505)..(505): n is a, c, g, or t
tcagtcgtcgctcgcacgaccggtgctcgatttagacagtatatatccgcggggaggtctcagagaggagccttagcccctggactccaaggcctttccacttggtgatcagcactgagcacagaggactcaccatggaagttggggctgagcttgggtttttccttgttgcttatttttagaaggttgtccagagtgaggtagaaaggtggtggaggtcggggggagcttggtccgacgggcccgggggggtccctggagacgttcgtccgtgtagtaagtctcgtggtntttggtaatagcaggagtagttggatgacncgtcgggtccnccgagtacttagaagggtaagggtcgtagggnggtgggtacgaccaatactaaaaccaagatggaagtgtagaancattagtcggtcggtcctgtggtagggacgggtccgtagttaccaagtactcccacgaggaagactgcgaacaagtacttgttanacttgagactaangacagcctgaacgcgacgagaccgcgtctccttagtcttcgtggccgaccggtacgtatggttaccggcttacgtcgtacgtttcggccggttcggtaccgggg

SEQ ID NO: 239856 - DNA, 798 bp, Homo sapiens
  misc_feature: GYAE6OF02GH63U.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattgggctgagctgggttttccttgttgctattttagaaggtgtcagagtgaggtgaaagtggtggaggtcgggggagcttggtccgagggccggggggtcctgagactgtcctgtgaagtctcgtggtattggtatagcaggagtagttggattggactacggttgggtacccgaccaaggtaccttcggaagggtaaacggggttcgtagggtaggtgggggtacgaacccaaacgtaactaaaaaccgaaggagtacgggtaaagttaggtaacggaaacgctaacgttagtaggttacgggtcccttacgttgggtacgggacgggggtacccgtaagtttacccaaacgtaacttcccgtaccgaaaggtaacggtaacgtacgggtacggaacccgtaaaaggtaacccgtttcgggtttaacgttaacgttacccgttaagtaaccgtaaaaggttaccgggaaacctacgggtacccgttacgggaacggtaaccgggtaacccgggaaagggtaacccgacccggttacctttacccgttaccgtttaacgtttaccgtcgggtaacggtaacccgggtaccggtaatttaacggtcggttaaccttaccggttactaacggtttcggtacccggttcccggtaacggggg

SEQ ID NO: 239857 - DNA, 882 bp, Homo sapiens
  misc_feature: GYAE6OF02F9I1U.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggtttccttgttgtcgtattttagtaaggtagtccgagagtgaggtggtaagtaggtggaggtacgggggacgggcgttggtccgacggccggggggtcccggtcgaggacgtcgtcctcgtgagtactcgtgagttgtatagtcgagtagagttggtagtgtacgacgttacgggtccggtcccgacgtacgttcgtagggaaaacggggttcgtagggtagggtacgggtgggtacccaaccgtaaagttaaaaccccgaaaggtaagtagggtaaacggttagggttacgtaaacggaccgtaaccgttaacgttaggttacgggtacccgttaccgtttcgggttagggtacggggggtacccggtaacgtttaccgtaaccgtaaacgtttcccgtaccccgtaagggtaacgaaccgtaacgggttacggacccctaaaacgggaaaccgttcccggttttaggttaaccttccgttaaccgaacgtaaaacgttcgggtaaccgaacggtcccgttagggaaacggtaccgggacccgggtaaaccggggtaaaccgaccccgggttcttaccgtttacccggttaattttaacccgggttacggtttcgggaaacccgggttaccccggggtaattaacgggtttccggtaacccggtttaacccggttacgttaacggttttacccggttccccgggttaccccggtaaccccggggggg

SEQ ID NO: 239858 - DNA, 721 bp, Homo sapiens
  misc_feature: GYAE6OF02IHJFO.21.15.B04.1.454.CMB.1.raw
  modified_base (517)..(517): a, c, t, g, unknown or other
  misc_feature (517)..(517): n is a, c, g, or t
tcagtcgtcgctcgcacgaccggtgctcgatttagacagtatatatccgcgggggaggtctcagagaggagccttagccctggactccaaggcctttccacttggtgatcagcactgagcacagaggactcaccatggaatgggctgagcttgggttttcttgttgcttatttagaggtgtccagagtggaggtgaaagtgggtggacgggtcgggggggacgtcgttcgggtaccgagggggtccccggggggggtccttggacggacgtcggtccgtggtaggagttctacgtaggtagttgtagtagcaaggtagagttggatggacgacgtcgggtcccgctaacgtacgttacgtagggaaagggtcgtgggagggtcggggtcggtacccgaaagtaacgaaaaccgtaaggagtaggaacggtggtagaagtaccacttagtacggtcgcgttagtcggtagggaccggggtacgtcgtaactaacgtaacgtacgtacgtaacggaacncgaaggtcgaacgtaaccgtaacgtcgttagttaacttcgacgtaactaagaggtacgtaccgacgtacggagaaccggaccgaggtaccgtacgggaccttacgtactacgtttaccgtcggtaaccggtccggtacggtaacgtacggtacggttacggtaacggttcgtaaccggtcggtcccggtaccggtacccggggg

SEQ ID NO: 239859 - DNA, 788 bp, Homo sapiens
  misc_feature: GYAE6OF02JIDR8.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagctgggttttcctgttgctatttagaaggtgtccagagtgaggtgaaagtggtggagtcgggggagcttggtccaggccggggggtcctgagactgtcctgtgaagtctctggattgtatagcaagtagtagttggatgctacgtcgggtccgctagtaccttacgaagggtaaacgggtctaggggtaggtgggggtacgacccgtaaacgaacgttaaaaacccgaaggtacgttacggggtaaaggtttacggtacggtaaaacggtacctaaacgtttaggtaccgggtacggtcccgtttccggttaggggtacgggtaccgggggggtaccctaagtttacccgaacgtaaacgttcccgtaaccgtaaggaaccgtaaacgtacggtacggaacccgtaaacgtaaaccggtttcggtttaacggtacttaaccgtaccggtaacgtaaaacggtcgggtaacctacggtacccgtaggtaacggacggtaacccgggaacggaaccggtaccggtacgttaccgtaccgtttacgttaccggtcggtacgggtaaccgtaacgggtaattacggtaccggtacttaaccggttccgttaacggttcggtcccggttacccggtaccggggg

SEQ ID NO: 239860 - DNA, 906 bp, Homo sapiens
  misc_feature: GYAE6OF02I1HKM.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattgggctgagctggtttcctgtgctatttagaagtgtccagagtgaggtgaagtggtggaggtcgggggagcgttggtccgaggcccggggggtccctggacgacgtcgtcctgtagaagtctcgtggattgtatagcagagattggatgctacgtcgggtcccgaccgtaagtaccgttacgaagggtaaaacggggttcgtaggggagggttggggtaccgggaaccctaaacgaaaccgttaaaaacccgaaaggtaaacgttagggggtaaaacggttggtaacggaaacgaccgttaaaccgtttaaggttcgggtaccggtacccgttccggttggggtaacggggaaccggggggtacccgttaacggtttaccgaaacccgttaaacgtaccccgtaccccgaaagggtaacccggtaaaccgtaagggttacccggaaaacccgtaaaacgggttaaacccgtttccgggtttaaacggttaaccgttacccggttaacggtaaaccgttaaaaccgggtaccgggtaaaccgtaaccgggttaaccccggttaagggaaaccgggtaacccgggtaacccgggtaaaccgggggtaaaccccggttaacccgggtacccctttaaccgggtttaacctttaacccggtttaggttcggttaacgggtacccggtaaccggtaagtttaccggtaccggtttaccgtacccggttacgttcggtttacccggtcccggttacccgggtaccccggggg

SEQ ID NO: 239861 - DNA, 777 bp, Homo sapiens
  misc_feature: GYAE6OF02GK2SR.21.15.B04.1.454.CMB.1.raw
tcagtcgtcgctcgcacgaccggtgctcgatttagacagtatatatccggcggggaggtctcagagaggagccttagccctggactccaaggcctttccacttggtgatcagcactgagcacagaggactcaccatggaattgggctgagcttggtttccttgttgcttatttagaggtgtcagagtgaggtgaaagtggtggaggtcgggggagtcttggtccacggccggggggtcctggagacgtgtccgtgtagtaagtctcgtggtattgtagtagcagagtgttggatgctacggtcggtccgctaggacttacgaagggtaacggtcgtgggaagtggggtcgaccctaaagaaactaaaccgaaaggacgttaaggaagttggtaacggaagacgtaatagttacggtcggaccttacggtcggtaacgggtaaccggggggtcccttaagttacccgtaaactaaccgttcccgtaacccggtagtaacggaaccgttacgtaccggtaaccgtaaacgggttacccgtttaggtttacggttaacttaccgtaaccggtaacgtaaacggttcggaaccgtaacgtacccggttagaaacgggacccggtaaaccggtacgggaacccgtaccggttacgtttacctttaccgtttagtttaaccggtcggtaccgggtaacgtaacccgggttaagttaccgggttacgtaccgtttaccggtaccgttaaccggttcggttacccgtcccgggttaacccggggg

SEQ ID NO: 239862 - DNA, 662 bp, Homo sapiens
  misc_feature: GYAE6OF02GBJ55.21.15.B04.1.454.CMB.1.raw
  modified_base (443)..(443): a, c, t, g, unknown or other
  misc_feature (443)..(443): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcgtgggttttccttgttgctattttagaaggtgtccagagtgaggtgaaagtggtggaggtcggggggagcgttggtccgaggcccgggggggtccctggagactgtcctgtgaagtctcgtggattgtatagcagagtattggatgcacgtcggtccaccgagacttacgaagggtaaagggtctgggaggtgggtcggaccaaactaactaaaccgaagagtaggaagtgtagaagctactaagtgtcggcctcttggcgggaggggcctagttcactaatcctcgaaganacgagtcaccgaaagtacgttcgtttagtattccgtagaactaaacgtggaacctagcccgtagggaacgtaacgggaccgaaaggaccgtaccggtccgttacccttattaaccgtttacggtaggtccggaacccgggtacgggtaaacttcggtaccggttaccgttaccgttagttaacccggtttcgggtacccgttcccggggtaaccggggg

SEQ ID NO: 239863 - DNA, 850 bp, Homo sapiens
  misc_feature: GYAE6OF02GPT1Z.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttggttttcctgttagctagttttagaggtgtccagagtgaggtgaaggtggtggaggtcggggggagtcgttgggtaccgcgggccggggggtccctggacgactggtcgtgtggtaagtctcgttaggattagtactaggcaaggtacgtaagtcggagtcgactcgtacggggtcccaccgtagaccttacgggaaggtaacggtcgttaggagggtcggggtacggacctaaagtaataaaacccggaaggtacggtaggaacgttgggtaaacgtacggtacgtaactttaacgtcgggtccgggtccttacgggtaggggttaacggggacggggtaacccttactttaaccgaaaccgtttaaccgttacccggtaaccggaaacgtaaacggaacgtaggttaacccgaaaccggttaaacgtacccggttacggttttaacgttaacgaccggtttaagaaaacccgtaaaaggtttagggaaccgtttaaaccggaccggttaacgggaaacggtaccccgggaacgggggtttaacccgaacccaaaccgggtttccctaacccgggtttacttaccgtttaccggtacggtcccgggaaccgggttaccggtaagttaccccggtttgaaccccgtttagggtaccccttttaaggcccgggttacccggtaccgggttaacccggg

SEQ ID NO: 239864 - DNA, 696 bp, Homo sapiens
  misc_feature: GYAE6OF02HYRVE.21.15.B04.1.454.CMB.1.raw
  modified_base (297)..(297): a, c, t, g, unknown or other
  misc_feature (297)..(297): n is a, c, g, or t
  modified_base (585)..(585): a, c, t, g, unknown or other
  misc_feature (585)..(585): n is a, c, g, or t
  modified_base (616)..(616): a, c, t, g, unknown or other
  misc_feature (616)..(616): n is a, c, g, or t
  modified_base (629)..(629): a, c, t, g, unknown or other
  misc_feature (629)..(629): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttgggttttccttgttgcttattttagaaggtgtccagagtgaggtagaaagtggtggaggtcgggggagtcgtttggtaccgagggtcccgggggggtccctggagtacgtgtccgtgtagacgtctacgtggtattagtatagngagtagagttggatcgcgtacggtcgggtcccacgtaagtaccgttacggaaggggtaaacgggtcgtaggggaggttcggggtccggaacccaaaacgtaaacgttaaaaacccaagggttaagtacggggtaaaggtggtaaagacgtaactaccgttaaggttggtacggtcccttaggtaggtcggggacgggtactacgtaccgaactacgtccgtaccgaggtaacgactaaggtcaaccgaagttaaccttgttagtactcgtagtaacaaggtcgtaacncgtaccgagaacgacgacggacgaccggtanccttacgtacttnttacgtcggaacgtaccggtagtagtacgtacgtacgtactgtacggtcgcccgttaggtacccggg

SEQ ID NO: 239865 - DNA, 857 bp, Homo sapiens
  misc_feature: GYAE6OF02JSS8C.21.15.B04.1.454.CMB.1.raw
  modified_base (107)..(107): a, c, t, g, unknown or other
  misc_feature (107)..(107): n is a, c, g, or t
tcagtcgtcgctcgcacgaccggtgctcgatttagacagtatatatccgcgggaggtctcagagaggagccgttagccctggactccaaggcctttccacttggtgntcagcactgagcacagaggacgtcaccagtgaagttggggctggtagcttcgggtttttccttggttcgtcgttatttttaggtaaggttggtacctagtagttaggagggttaggaaaggttgggtacgggagggttcggggggaggtcgtttcgggtaccgcggggtacccgggggggttcctacggacgtaccgttcgttccgtgtaggtaacggttcgtcgttaggtactttggtaacgttaggcgtaaaggtaaggtcgttaaggtacgtcggtcgtaggtccggggttccgacccgtacggttaccgttaacggagggtaaacggggtcgttacgggagggttcgggaccggtacccgtaaacgaaacgtaaccgtaaaggtagttacggaagggttcgtaaagggacccgtaagacggttaacttccggggtagtacccgttggtttacccggggtagggtaaccgggggttacctttaacggtttcccgaaaccgttaccggttacctaacggtaaacggtacggaaccgtaacgggtaccggtaacggtaaacgtaaccgttacggttaacgtttcgtaacgttacgacgtaagtacggaagtacgtaccgtagtacggtacggaccggaacgtaccgtacggtacgttacccgtgttaccgttaacggtggtaacgtaccggtacgagttacgtacgttacggccgttcgttacggtccgtaccggttccggtacccggg

SEQ ID NO: 239866 - DNA, 588 bp, Homo sapiens
  misc_feature: GYAE6OF02FNK51.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttgggttttcctgttgcttattttagaaggtgtccagagtgaggtgaaagtggtggagtcggggggagcgttggtccagggccggggggtccctgagactgtcctgtgaagtctctgattgtatagcagagattggatgcacgtgggtccgccagacttcgaaggaaaggtcgtggagtgggtcggaccaacaataaaccaagactaggaagtgtagaagctactagtggtgtcctcgtggtggacggggtaccgtacgttcaactaatccgtacacgaagacgacgtacgaccaaagtaccttacgttgtactctagacaatgacagacctaggaacgacggaccggacggaccgaccggtacctctacgttacttacgtggtggaccgacggtaattacgacggtctacgtactagttcgtcgtccggtaccggg

SEQ ID NO: 239867 - DNA, 775 bp, Homo sapiens
  misc_feature: GYAE6OF02GVKWI.21.15.B04.1.454.CMB.1.raw
  modified_base (188)..(188): a, c, t, g, unknown or other
  misc_feature (188)..(188): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcgttggtttccttgttgcttatttagaaggtgtccagngtgaggtgaagtggtggaggtcggggggagtcgttggtccgagggtcccgggggggtccctggacgactgtcctggtgaaggtctcgtggtattgtatagcagtagattggatgctacggttcggtcccgcgacgtcgttacgaagggtaaacgggttcgtagggtagggttggggtacggtacccaaacgtaactaaaaccgaaggtaacgtagggtaagttggtaggaaacgtcgaacgttagtggtccggtacttacgtagggtacggggaccggggcctttaacgttccgaacgttaaccgttcctaaccggagtaacggaaccgtagtaacgacccgtaaaggttaccgttcggtttataccttggtacgtaaccgtaaaggtccgggaaactcgggtaccgtaggtaaggacccggaaccgggtaacggtaaccggaccgggttaccttaccgttaccgtttaccgttacggttcggtaaccgggtaccggttaaccggttagttaaccggtaccggtaaccgtttccggttaaaccgttcggtttacccgggttcccgggttcccggggtaaccccgggg

SEQ ID NO: 239868 - DNA, 856 bp, Homo sapiens
  misc_feature: GYAE6OF02JKDSK.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcgttgggttttccttgttgcttattttagaaggtgtccagagtgaggtgaaagtggtggaggtcggggggagtcgttggtccgagggcccggggggtccctgagactgtcctgtgagtctctggattgtatgacagtagtagttaggtatgtcgtacgttcggggtacccggaccgaacggtaccttacggaaagggtaaacggggttcgtaggggtacgggtgggggttaccgggaaccctaaaacgtaaaccgtaaaacccgaaaagggtaacggttagggtaaacggtaggttaacggtaaaaccggtaccgtaaacggtttaacggttcgggttccgggtacccgtttaccggtaggggtttacggggaccgggggggtaacccgttaacgtttacccaaaccgtttaaaccgtaccccgtttaacccgaagggtaaaccgtaaaccggtacggtaacggaaacccgtaaaaccgtaccgttttaccgttaacgttacgttaaccgtaggtaaaccgtaaagtccgggaactacggtacctacggaccgggaacggacccggaacggaccggtaacccgacgtttaccgttacctttaacgttaccggtacggttccgggtaacccgtaacgggttaacctacggttacggtaacccttcggtttcgtaccggtttcgggaccccggtttaggaccccgggg

SEQ ID NO: 239869 - DNA, 758 bp, Homo sapiens
  misc_feature: GYAE6OF02GUGQ6.21.15.B04.1.454.CMB.1.raw
tcagtcgtcgctcgcacgaccggtgctcgatttagacagtatatatccgcggggaggtctcagagaggagccttagccctggactccaaggcctttccacttggtgatcagcactgagcacagaggactcaccatggaattggggctgagcttgggttttccttgttgcttattttagaaggtgtccagagtgaggtgaaagtggtggaggtcgggggagtcgttggtccgacgggccggggggtcctgagacgtgtcctgtgaagtctcgtggtattgtatagcaagagtagttggatgcgacgtcgggtccgcgagtaccttacgaagggtaaacgggtcggtagggaggttcgggggtacggacccgtaaacgtaaacgtaaaaaccccgaaaggtaagttacgggaaacgttacggtaagtaaacggcctaaacgtttagttcggtccggtacccttcgtaggttaggggaaaccggggtcccgtaaagtttacccgaactaaacgtccctaaccggaagtaacggaaccgtaaggttacgaccgtaaacgtaaccgtttacgttacggttaacttcgtacgtacgtaaagtaccgggacaacggtaccgtaggacgacggacggacgtacgccggtctacgttacttacgttaacgttcggacgttaccgggtaaccgttaacgtcgttacgggtacccggtttaccgttaggtacccgtttacgggttacccggtacccgggttacccgggg

SEQ ID NO: 239870 - DNA, 687 bp, Homo sapiens
  misc_feature: GYAE6OF02GOWP6.21.15.B04.1.454.CMB.1.raw
  modified_base (237)..(237): a, c, t, g, unknown or other
  misc_feature (237)..(237): n is a, c, g, or t
  modified_base (372)..(372): a, c, t, g, unknown or other
  misc_feature (372)..(372): n is a, c, g, or t
  modified_base (654)..(654): a, c, t, g, unknown or other
  misc_feature (654)..(654): n is a, c, g, or t
tcagtcgtcgctcgcacgaccggtgctcgatttagacagtatatatccgcggggaggtctcagagaggagccttagccctggactccaaggcctttccacttggtgatcagcactgagcacagaggactcaccatggaatgggctggagcgtggtttctgtgctatttagagtgtcagtagtgagtgaagtggtggaggtcgggggagcttaggtccgagggccgggggtcctgganctgtcctgtacgtaagtctcggtaggtatttcgaagtacggctaagagtacgtgaacttggctacggtaccggtccgcgtaagtcgttaaccgagggtaaacggtcgtagggtgggttacggtcggaccctaaanaaacgttaaaccgaaggtaacgtagggtaaacgtacggttaggtaaacggactaacgtttaggtacggtccggtacgttcgttggggtaggaccgggtaccggtacgttaaccacgtaaccgtctaccgagaacgactacggtcgttaaaccgaagtaccgttaacgtcttaacgtcgtacgaaccgtaagtggacaccgtcgaacgtacgaccggaccgtaaccggctacggtctaacgttccttaacgtcgtacgcggaccgttcggtaatcgtaccgtntaccgttcttagtcccggtagtccggtaacggg

SEQ ID NO: 239871 - DNA, 122 bp, Homo sapiens
  misc_feature: GYAE6OF01BWCWN.52.66.F11.1.454.CMB.1.raw
  modified_base (102)..(102): a, c, t, g, unknown or other
  misc_feature (102)..(102): n is a, c, g, or t
tcagcgcagtacgacacgaccggtgctcgatttagtcacgcgagaagggaaaggggctggccctgacgtgttctgttccacctcctctatacgatcgctgancgggctggcaaggcgcatag

SEQ ID NO: 239872 - DNA, 125 bp, Homo sapiens
  misc_feature: GYAE6OF01CCT95.52.66.F11.1.454.CMB.1.raw
  modified_base (122)..(125): a, c, t, g, unknown or other
  misc_feature (122)..(125): n is a, c, g, or t
tcagcgcagtacgacacgaccggtgctcgattagtcacgcgagaaggaaggggctggccctgacgtgtttctgttcccgcctcctctatacgatcgctgagcgggctggcaaggcgcatagnnnn

SEQ ID NO: 239873 - DNA, 120 bp, Homo sapiens
  misc_feature: GYAE6OF01CTIFB.52.66.F11.1.454.CMB.1.raw
  modified_base (120)..(120): a, c, t, g, unknown or other
  misc_feature (120)..(120): n is a, c, g, or t
tcagcgcagtacgacacgaccggtgctcgatttagtcacgcgagaaggaagggctggccctgacgtgttctgttcccacctcctctatacgatgctgagcgggctggcaaggcgcatagn

SEQ ID NO: 239874 - DNA, 149 bp, Homo sapiens
  misc_feature: GYAE6OF02GVYJO.52.66.F11.1.454.CMB.1.raw
  modified_base (127)..(149): a, c, t, g, unknown or other
  misc_feature (127)..(149): n is a, c, g, or t
tcagcgcagtacgacacgaccggtgctcgatttagtcacgcgagaagggaaaggggcgtggccctgacgtgtttctgttcccaccctcctctatacgatcgctgagcgggctggcaaggcgcatagnnnnnnnnnnnnnnnnnnnnnnn

SEQ ID NO: 239875 - DNA, 128 bp, Homo sapiens
  misc_feature: GYAE6OF02GWJ7T.52.66.F11.1.454.CMB.1.raw
  modified_base (124)..(128): a, c, t, g, unknown or other
  misc_feature (124)..(128): n is a, c, g, or t
tcagcgcagtacgacacgaccggtgctcgatttagtcacgcgagaagggaaggggctggccctgacgtgtttctgttcccacctcctctatacgatcgctgagcgggctggcaaggcgcatagnnnnn

SEQ ID NO: 239876 - DNA, 123 bp, Homo sapiens
  misc_feature: GYAE6OF02JQ9T2.52.66.F11.1.454.CMB.1.raw
  modified_base (115)..(123): a, c, t, g, unknown or other
  misc_feature (115)..(123): n is a, c, g, or t
tcagcgcagtacgacacgaccggtgctcgatttagtcacgcgagaaggaagggcctgacgtgttctgttcccgcctcctctatacgatcgctgagcggctggcaaggcgcatagnnnnnnnnn

SEQ ID NO: 239877 - DNA, 664 bp, Homo sapiens
  misc_feature: GYAE6OF01DK2NY.34.19.B08.1.454.CMB.1.raw
  modified_base (437)..(437): a, c, t, g, unknown or other
  misc_feature (437)..(437): n is a, c, g, or t
  modified_base (661)..(661): a, c, t, g, unknown or other
  misc_feature (661)..(661): n is a, c, g, or t
tcagtacacgtgatcacgaccggtgctcgatttagtgagtcagtaaggggctgaggtgaagaagcctggggcctctgtgaaggtctcctgcaagacttctggatataccttcaccgaatactttatacactgggtgcgacacggcccctggacaaggctttgagtggctgggacggatcagacctaacagtggtggcacaaactttgcacagaagtttcagggcagggtcacatgaccagggacacgtccatcagcacagcctacatggagctgagtggactgagatctgacgacgacggccgtatattactgtgtgagagatattgactacgtcgggccagggaaccctggtccaccgtctcctcacgcctaccaccaacgggcccctagtcccggtccttcccccgtgggccctccctgccctacccgagggacncccaacccgtccggaagacgaccaacgacggcccgggtccccgttgggggcccttcggaccccgtttaggggtaacccgaaaaggggttacccctttaacccgtttccccaaacgttcccgtaaaccgggtttacggttaacccgttcggggaaccgggtccccggggggttccgttcgggggaaacccgaaaacgggggccccgaacgtaaacgttaaggcgngcg

SEQ ID NO: 239878 - DNA, 911 bp, Homo sapiens
  misc_feature: GYAE6OF01EKRQU.34.19.B08.1.454.CMB.1.raw
tcagtacacgtgatcacgaccggtgctcgatttagtgagtcagtaaggggctgaggtgaagaagcctggggcctctgtgaagtctcctgcaagacttctggatataccttcaccgaatactttatacactgggtgcgacaggcccctggacaaggcttttgagtggctgggacggatcagacctaacagtggtgcacaaactttgcacagaagtttcgagggcgagggtcaccatgaccgagggacacgtccatcagcacagcctaacacgtggagctggacgtaggactggaacgatccgtaggaccggaacgtacgggtccggtattacgttaacgtggttagttagacggtaagtaacttaagttacgacgttaacggtccgggggtaccgaaacggggtaacccccgtagggtacccgtaacccggttcctaccccgttacgaccgaccccgttacccgaaacccggtaaaccgggtccccttaacggtttccccggggtttcccccttttaccccccggacggggttcccccgtacccccgtttacccggaccccgtttaccccgggaaacgggttacccggaaccccttaacccccgggtaccccggtaaacgggacccggtaaccccgtaacccggaccggggtacccccggggttaccccgttacggggggttaccccttaccgggtacccgggtttacccgggggtaaacctaaaacccgggggtttcccctttaaacccggttttacccccgaaaggttttacccccggtagggttttaaacccgggtttaaccggttacggggtaaccccggggtccggggttaaccccggtttaggggaaccccggaaacggggttccccgggtaacctttaaaccggggaaggttagccgttaacggg

SEQ ID NO: 239879 - DNA, 562 bp, Homo sapiens
  misc_feature: GYAE6OF02FRZGN.34.19.B08.1.454.CMB.1.raw
  modified_base (558)..(558): a, c, t, g, unknown or other
  misc_feature (558)..(558): n is a, c, g, or t
  modified_base (560)..(561): a, c, t, g, unknown or other
  misc_feature (560)..(561): n is a, c, g, or t
tcagtacacgtgatcacgaccggtgctcgatttagtgagtcagtaaggggctgaggtgaagaagcctggggcctctgtgaaggtctcctgcaagacttctggatataccttcaccgaatactttatacactgggtgcgacaggcccctggacaaggctttgagtggctgggacggatcagacctaacagtggtggcacaaactttgcacagaagtttcagggcagggtcaccatgaccagggacacgtccatcagcacagcctacatggagctgagtggactgagatctgacgacacggccgtatattactgtgtgagagatattgactactgggccagggaaccctggtccaccgtctcctcacgcctccaccaacgggcccatccggtccttcccccgtggccgccctgcctccgaggacgccaccgtccgagacgccacgacgccggccctggggcctcggcccgtgggtaccaaacgggtaccttaccttccattccgacgttcgtacgtcggacggccggggtactcgggacgaacgggccgacgaagtacgngnng

SEQ ID NO: 239880 - DNA, 543 bp, Homo sapiens
  misc_feature: GYAE6OF01A5G2Q.9.81.H04.1.454.CMB.1.raw
  modified_base (454)..(454): a, c, t, g, unknown or other
  misc_feature (454)..(454): n is a, c, g, or t
tcagtgatacgtctcacgaccggtgctcgatttagtagtgtagattcgcgggggggttcggtcaggaggcagcgctctcaggacgtcaccaccatggcctgggctctgctcctcctcaccctcctcactcagggcacagggtcctgggcccagtctgccctgactcagcctccctcgcgtccgggtctcctggacagtcggtcaccatctcctgcactggaaccagcagtgacattggtgctttataacgtatgtctcctggtaccaacagcaccaggcaaacgtcccaaactcactagatttatgagttcaataagcggacctacgtcgggtccctgagttcgcttctctggctcagtctggcaacgacgcctccgtcgaccgtctcgtcggctccgaggctgacgtatgacggctagtattattactgtcagtctcatctgacaggcaccanacgtgtacgtacggtagtcggaccgtacggtcgaccggtactacggtccacgtacccgaacggcccaacccacgtcgtccgcgttcccg

SEQ ID NO: 239881 - DNA, 630 bp, Homo sapiens
  misc_feature: GYAE6OF01B09V8.9.81.H04.1.454.CMB.1.raw
  modified_base (302)..(302): a, c, t, g, unknown or other
  misc_feature (302)..(302): n is a, c, g, or t
  modified_base (418)..(418): a, c, t, g, unknown or other
  misc_feature (418)..(418): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgctttataactatgtctcctggtaccaacagcacccaggcaaacgtccccaaactcatgatttangaggtcaataagcggccctcgtggggtccctgatcgcttctctggctcaagtctggcaacacggcctccctgaccgtctcgtgggctccaggctgacgatgagctgatttattacngcagctacatagtcgacgacggacccaaccccaactaaagttccggttaccgttacggggaaacggttaccgggggaaaccccgtaaccggggttacccgtaaccccgggtttccgtaaaccggggttacccgaaccggtaccccccgaaaccggggacccccctaaaccccccggtaaccgtttaccggtacccgtaaccccgtttccccg

SEQ ID NO: 239882 - DNA, 524 bp, Homo sapiens
  misc_feature: GYAE6OF01DZUUE.9.81.H04.1.454.CMB.1.raw
  modified_base (238)..(238): a, c, t, g, unknown or other
  misc_feature (238)..(238): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctcctggtaccaacagcacccaggcaaagtccccaaaactcatgatttatgaggtcaataagcggccctctggggtccctgatcgcttctctggctccaagtctggcaacacggcctccctgacccgtctcgtcgggctccaggctgacgatgaggctgatttattactgcagctcatatgctagtttggttccttctttcaagtatagttcgggcggagggaccaggctcggaccgtccgtgagtcacgacccaaggcctcgcccccgtcgg

SEQ ID NO: 239883 - DNA, 508 bp, Homo sapiens
  misc_feature: GYAE6OF01DTZMH.9.81.H04.1.454.CMB.1.raw
  modified_base (495)..(495): a, c, t, g, unknown or other
  misc_feature (495)..(495): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgctttataactatgtctcctggtaccaacagcacccaggcaaagtcccaaactcatgattatgaggtcaataagcggcctcgtgggtccctgatcgcttctctggctcaaatctggcaacacggcctcctgaccgtctctgggctccaggctgacgatgagctgattattactgcagctcatatgcacggccaccacaatgtctcggaagtggaccacggtccaccgtcctaggtccacgcccaacggcccaaacccntctcctactcccg

SEQ ID NO: 239884 - DNA, 534 bp, Homo sapiens
  misc_feature: GYAE6OF01BHK4Q.9.81.H04.1.454.CMB.1.raw
  modified_base (239)..(239): a, c, t, g, unknown or other
  misc_feature (239)..(239): n is a, c, g, or t
  modified_base (302)..(302): a, c, t, g, unknown or other
  misc_feature (302)..(302): n is a, c, g, or t
  modified_base (437)..(437): a, c, t, g, unknown or other
  misc_feature (437)..(437): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtnctttataactatgtctcctggtaccaacagcacccaggcaaagtccccaaactcatgatttangaggtcaataagcgccctcgtgggtccctgatcgcttctctggctcaagtctggacaacaccggcctccctgaccgtctcgtcgggcctccgaggctgacgtatgacggtctagtattagttactgcagctcatngcacggcacccatatcgtacttcggacggtggaccacggtccaccgtcgtaggtccacggacccgaacggtaccccaacccctatcgtccactcccg

SEQ ID NO: 239885 - DNA, 514 bp, Homo sapiens
  misc_feature: GYAE6OF01AJ20F.9.81.H04.1.454.CMB.1.raw
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (416)..(416): a, c, t, g, unknown or other
  misc_feature (416)..(416): n is a, c, g, or t
  modified_base (509)..(509): a, c, t, g, unknown or other
  misc_feature (509)..(509): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggtnctttataactatgtctcctggtaccaacagcacccaggcaaagtccccaaactcatgatttatgaggtacaataagcggccctcgtcggggtccctgatcgcttctctgctcagtctggcaacacggcctcctgaccgtctctgggctccgaggctgacgatgagctgtattattacngcagctcatatgcaggccaccactatcgtacgtacggaggtcggaccacggtcaccgtcgtaggccacgcccgaacgcccaacccacgtctcnctccg

SEQ ID NO: 239886 - DNA, 516 bp, Homo sapiens
  misc_feature: GYAE6OF01AE564.9.81.H04.1.454.CMB.1.raw
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttangaggtcaataagcggccctntggggtccctgatcgcttctctggctccaagtctggcaacacggcctccctgaccgtctctgggcctccgaggctgacgatgaggctgattattactgcagctcatatgcaggccacccataatgtcttcgggaagtcgggaccaggtccgaccgtcaggtccacgcccaaggccccaacccactcgtccactccg

SEQ ID NO: 239887 - DNA, 505 bp, Homo sapiens
  misc_feature: GYAE6OF01DEG0D.9.81.H04.1.454.CMB.1.raw
  modified_base (435)..(435): a, c, t, g, unknown or other
  misc_feature (435)..(435): n is a, c, g, or t
  modified_base (494)..(494): a, c, t, g, unknown or other
  misc_feature (494)..(494): n is a, c, g, or t
  modified_base (500)..(500): a, c, t, g, unknown or other
  misc_feature (500)..(500): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacatttggtgcttataactatgtctcctggtaccaacagcacccaggcaaagtcccaaactcatgatttatgaggtcaataagcggcctctgggtccctgatcgcttctctggctccaagtctggcaacacggcctccctgaccgtctctgggctccaggctgacgatgagctgattattactgcagctcatatgcaggcacccanaatgtcttcggaagtcggaccacggtcaccgtctaggtcacgcccaacgcccaaacccntcgtcnctccg

SEQ ID NO: 239888 - DNA, 525 bp, Homo sapiens
  misc_feature: GYAE6OF01BKIMN.9.81.H04.1.454.CMB.1.raw
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgcccagactcagcctccctccgcgtccgggtctcctggacagtcggtcaccatctcctgcactggaaccagcagtgacattggtgcttataactatgtctcctggtaccaacagcacccaggcaaacgtccccaaatcatgatttatgaggtcaataagcggccctntggggtccctgatcgcttctctggctcaagtctggcaacncggcctccctgacctctcgtgggctccgaggctgacgatgaggtctagtatttattactgcagtctacatatcgacacggccaacccaatatcgtcgtacggagtcggaccacggtccacgtctaggcacgacccgaacggcccaacccagtctcctactcccg

SEQ ID NO: 239889 - DNA, 680 bp, Homo sapiens
  misc_feature: GYAE6OF01C7YZW.9.81.H04.1.454.CMB.1.raw
  modified_base (126)..(126): a, c, t, g, unknown or other
  misc_feature (126)..(126): n is a, c, g, or t
  modified_base (190)..(190): a, c, t, g, unknown or other
  misc_feature (190)..(190): n is a, c, g, or t
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
  modified_base (555)..(555): a, c, t, g, unknown or other
  misc_feature (555)..(555): n is a, c, g, or t
tcagtgatacgtctcacgaccggtgctcgatttagtagtgtagattcgcgggggagctcctgggagtaggagccccagccctgagattcccaggtcgtttccattcagtgatctagcacttgaacncagaggactcaccaatggagttcgggactgacctggagttttcctttagggtattttaaaaggngtaccagtgtgaagtgcagctggtggagtcgtgggggacgtccgttcggtgccagcccgtggcctacccgtcccgtgacgtccgtccgttccttggcgcccgtccctgtacggtattcagttgttgntagtattntcgcctagtcgctacggttcgggaccggtactaacggttccggaaggggaacggtccgtagggcgtcgggtactcggtagttactttagtggagtcgactactaccagtagctagcgacgcttcgtgggtcggacggggcctacgttaccaccgtattccacgaagaccgaaccgaaaccgaccaaacgaccttacctatactccgtagaactaagtagtacgttacgtntagagtggttaggaccgggtagacccggtttacttacggttaacttggttagtacggtaaaccgtaaaaggtaaacgggttaaacccgggaaacccggtaggggaaaccggcggtacgtaacggg

SEQ ID NO: 239890 - DNA, 756 bp, Homo sapiens
  misc_feature: GYAE6OF01BNBN8.9.81.H04.1.454.CMB.1.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgaagtgcagctggtggagtcgtggggggaggcgttggtgcagcctggccacctccctgacgactctcctgtcgccgcctctggattcattgtttgatgattatcgccatcgctacgtcggggtcccggactaacggttcccgaagggggaacgggtcccgtaggggacggtcggggttactcgtaagggttaactttacgttgggaaggttacgctaaccgtaccgaacgagggtactaagtcggccggtacttcggtagggttacgggacgggggtcccgtaacgtttacccgaaccctacgttacccgttacccgaacggtaaaccgaacccgtaaacccggaaccccgaaaaccggtaaacccccttaccccgttaaacttaactttaccgtacggaactaaaagttacggtaaagttcgggttacgttagggtaagggtacggtttagggaacggtaaccgtaccggggtacccttttaggtaacgttttaacgtgggttacgaaacgtaaaaacggtacgttaaaccgggaaaccccggtagggtacgggacgtcgtaacggg

SEQ ID NO: 239891 - DNA, 576 bp, Homo sapiens
  misc_feature: GYAE6OF01D8EE5.9.81.H04.1.454.CMB.1.raw
  modified_base (449)..(449): a, c, t, g, unknown or other
  misc_feature (449)..(449): n is a, c, g, or t
  modified_base (466)..(466): a, c, t, g, unknown or other
  misc_feature (466)..(466): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatcctcctgcactggaaccagcagtgacattggtgcttataactatgtctcctggtaccaacagcacccaggacaaacgtccccaaactcaatcgtatttatgaggtacaataagcggccctgtcggggtccctgatcgtcttctcgtggctcaagtctggacaacaccggcctcccgtagaccgtctcgtcgggcctccgaggctgacgatggaggctaggtatttagttactgcagctcatntcgacacggaccaccanaacgttcggtaccttacgggaagttcgggaccctacgggtaccgtaccggttccgtacggtccacgaccccgaacggtcccccaaacccctacgtcgtcctaccgttccc

SEQ ID NO: 239892 - DNA, 658 bp, Homo sapiens
  misc_feature: GYAE6OF01AJ5AC.9.81.H04.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
  modified_base (363)..(363): a, c, t, g, unknown or other
  misc_feature (363)..(363): n is a, c, g, or t
tcagtgatacgtctcacgaccggtgctcgatttagtagtgtagattcgcgggggggtcgtcgaggaggcagcgctctcaggacgtcaccaccatggcctgggctctgctcctcctcaccctcctcactcagggcacagggtcctgggcccagtctgccctgactcagcctccctcgcgtccgggtctcctggacngtcgtcaccntctcctgcactggaaccngcagtgacattgggnctttaataactattcgtctccgtggtaaccaacacgcacccgaggaccaaacgtaccccaaaactcatcgattttacngaggtacaagtaagccggtcctcgtcggggtcctgactcgtctttcncgttcggactcaagttctggacaacgaccgggtccctccgtacgacccgttctcggtcggggaccttccgaggtccgtaggaccgtagttacgggaggtccttaggtaactttttacttaaccggttgaccgtacgtccttacaagtttacgtcgaccgacggtcccaaacccgactaaacgttcggttacctttacggggaaacgttcgggaaaccgtaccggttccacccggtttactacgggtccaccgtacccgaacggaccccctaaccctagttccgtctaccgttccg

SEQ ID NO: 239893 - DNA, 703 bp, Homo sapiens
  misc_feature: GYAE6OF01BQYOL.9.81.H04.1.454.CMB.1.raw
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (376)..(376): a, c, t, g, unknown or other
  misc_feature (376)..(376): n is a, c, g, or t
  modified_base (673)..(673): a, c, t, g, unknown or other
  misc_feature (673)..(673): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcggtcaccatcctcctgcactggaaccagcagtgacattggncttanaactatgtctcctggtaccaacagcacccgaggaccaaacgtccccaaactcatgtattatgagtcaagtacgccggccctcgtcggggtccctggactccgtctttccgtctgggccttaccgaagttccncggaccaaaccgcccgggtccctcccctaggtacccgtcctcggttcgggcctcccgagggtcctaggaacgtagttcgacgggtacctagtaacgtttacttaacggtcgcgtaacggtccttagaagtttaacgtccggaccgtaccgggtaccccaacccccgtaagtaaactttccgggtaccgtttaacggggaaccggtttccgggggacccctaaccgggttcccgtacccggttacccgttacgggtcccaacccgggtacccccgaacgggacccccctaaaccccgngttacccggttacctaacccggttttcccc

SEQ ID NO: 239894 - DNA, 637 bp, Homo sapiens
  misc_feature: GYAE6OF01AZIIO.9.81.H04.1.454.CMB.1.raw
  modified_base (237)..(237): a, c, t, g, unknown or other
  misc_feature (237)..(237): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcggtcaccatctcctgcactggaaccagcagtgacattggntcttataactatcgtctctgtaccaacacgcaccaggcaaacgtcccaaactcatcgtatttactgtaggtacaataacggccggccctacgtcgggtcctgactcgcttctcgtcggctaccgaagtcgtacgactaaccgaccggtccctccgtcgaccgttcgtcgtcgggtctaccgagtcgtacggacgtagtcgagtctagttaacttacgtttacgtcgacgtacgtcttacacttagtcgtaccgtacggacctaacccgacgtaacgttcgttaccggtacggtaacgggtaccgggtacccgtaccggtaccgtaccgttaccgttacggtaccaccggtaccccgaacggacccctaaccccgtagttccgtaccttacccgttacccg

SEQ ID NO: 239895 - DNA, 672 bp, Homo sapiens
  misc_feature: GYAE6OF01BK59E.9.81.H04.1.454.CMB.1.raw
  modified_base (226)..(226): a, c, t, g, unknown or other
  misc_feature (226)..(226): n is a, c, g, or t
  modified_base (334)..(334): a, c, t, g, unknown or other
  misc_feature (334)..(334): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcggtcaccatctcctgcactggaaccngcagtgactagttggtgactttaataactatcgttccttccgtaggttaaccaaacacgccaacccgaggacctaaaaccgtcccccaaaactcaatagtattttaanaggtaggtacaaagtaacgccggtacccttcggtacgggtccctgactccgtcttctcgtcggacctccgaagtcgtcggaccaacgacccggtcctcccgtacggtacccgtctacggtcgggcctccgaggcctggaacgtagtcggacggtcttagtaactttactacgtcgacctagtcctataatacgtcgaccgtaccggacctaaccccgtaagttaagttcggttacgtacgggaaggtaccggaaccctaccggtaccgtaccggttaccgtaggacccgaccgacccgaaaccggtaccccaaaccctagtccgtacctccgttcccg

SEQ ID NO: 239896 - DNA, 749 bp, Homo sapiens
  misc_feature: GYAE6OF01CD5ET.9.81.H04.1.454.CMB.1.raw
tcagtgatacgtctcacgaccggtgctcgatttagtagtgtagattcgcggggagctctgggagaggagccccagccctgagattcccaggtgtttccattcagtgatcagcactgaacacagaggactcacatggagttggactgacctggattttctttgggtattttaaaaggtgtccagtgtgaagtgcagctggtggagtcgtgggggagcttggtgcagcctggcacctccctgacgactctcctgtcgccgcctcgtggtattcattgtttgattgtattatcgccctagtcgacctacgttggggtcccgagtaacggttcccgaagggggaacggtccgtagggaggttcggggtcctacggtaaggttacgtttacgtgggtaacgttacggaccctaaccgttaacccgacgacggggtaccttaagtcggtaccggtaacttcggttgggtacgggacggggtacccgttaacgtttaacccgacgttcccgttacccgaacggaaacgaaccgtaaacccgacccgaaaacgtaacccttaccccttaattaacgtactacgaacctaaagttacggtaagttacgggtaccgtaggtaaggttacggttacggaacgggtaaccgtaaccgggtaccgtttaggttaacgtttaaccgtaggttacggaaaccgtaaaaggtaccgttaaccgggaaaccccggtaagggtacggtaaccgcgtacggttacggg

SEQ ID NO: 239897 - DNA, 560 bp, Homo sapiens
  misc_feature: GYAE6OF01D7YZT.9.81.H04.1.454.CMB.1.raw
  modified_base (249)..(249): a, c, t, g, unknown or other
  misc_feature (249)..(249): n is a, c, g, or t
  modified_base (544)..(544): a, c, t, g, unknown or other
  misc_feature (544)..(544): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcaagtgacattggtgcttataactntgtctcctggtaccaacagcacccaggcaaagtccccaaactcatgatttatgaggtcaataagcggcctcgtgggtccctgactcgcttctctggctccaagtctggacctaacgacgtaccctccgtacgaccgttctacgtcgggctccgaggctaggaccgtatgaaggtctagtatttagttactgcagtctacatatcgacacggaccacccataacgttgtacgtttcggaagtcgggaaccacggtccgaccggtctaggtccaacggcccaacggccccaaacccncttacgccacttcccg

SEQ ID NO: 239898 - DNA, 629 bp, Homo sapiens
  misc_feature: GYAE6OF01D7H2E.9.81.H04.1.454.CMB.1.raw
  modified_base (240)..(240): a, c, t, g, unknown or other
  misc_feature (240)..(240): n is a, c, g, or t
  modified_base (312)..(312): a, c, t, g, unknown or other
  misc_feature (312)..(312): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcggtcaccatctctgcactggaaccagcagtgactattggtntactttaataactattgtctccgtggtaaccaacagccaaccaggacaaaacgtccccaaatcatgatttanggaggtcaaataagccggtccctcgtcggggtccctgatcgtcttctcgtggctccaagttcgtggaccaacgccggtccctccgtgacccgtctcgtcgggtctccgaggcgtaggacgatggaggtcgtggtaatttattacgtcacgagtctanattntgacgtacggaccaacccctataagttcggttaccgttacgggaaacggttcgggaacccgtaacgggtcccgtacccggtttaccgtaagggtcccaacggtacccccgaaaccgggaccccaacccccgtacgttccgtacctcccgttacccg

SEQ ID NO: 239899 - DNA, 719 bp, Homo sapiens
  misc_feature: GYAE6OF01BTO68.9.81.H04.1.454.CMB.1.raw
  modified_base (245)..(245): a, c, t, g, unknown or other
  misc_feature (245)..(245): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcggtcaccatcctcctgcacgtggaaccagtcagtgactattgggtntctttaataactatcgtcctccgtaggtaaccaacagccacccgaggaccaaaacgtccccaaaactcactagtactttagtaggtaggtacaaagttaacggccggtcccgttacgtcggggtccctagtacgttccgtctttccgtcgtggtacctaccgtaaggttccgtacggaacctaaccggacccggtccccttaccccgtacggtacccgttccgtcggttcgggaccttcccggaggtccgtacggacgtagtcggaggtcttagtaactttacttacgtgacctacgtctactaagtcgtcgacgaccgtacccaacctaacgtacgttcggttacgttacgggtaacggttccgggaaccgtaccgggtaccgtaccccggttagtaacgggtcccaaccgtaacccggaaacccgggtaccccaaaccccggttacttaccgttacccgtaactttccccgg

SEQ ID NO: 239900 - DNA, 687 bp, Homo sapiens
  misc_feature: GYAE6OF01BPKAO.9.81.H04.1.454.CMB.1.raw
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccggtctccgtggacagtcggtcaccatctcctgcacgtggaaccngcagtgactagttggntacttaataactatgtcctcgtgtaaccaacacgacaccgaggacaaacgtaccccaaactcatagtatttacgtgtacgtacaagtaacgccggccttcgtcgggtcctgacgtctcttcgtcgtggtcctacgaagtcgtcggacaacgtaccggtccctaccgtcggtacccgtcgtcgtcgggtcctaccggtacggtccgtaggtaaccgagttagggacggttaccgttaaggttaacttttaacgtaacgttccggtacgtaacggttaccctaagttaacgtttacggaacgtaccgaaccgggtaccctaacccgtaaacgttacggtttaccgtacggttaacgggaacggttaccggacccgtacggtaccgtaccgtacgtacggtccgaccggtacccaccggtacccaacccgtagtccgtcctacgtcccg

SEQ ID NO: 239901 - DNA, 857 bp, Homo sapiens
  misc_feature: GYAE6OF01EI8K3.9.81.H04.1.454.CMB.1.raw
  modified_base (194)..(194): a, c, t, g, unknown or other
  misc_feature (194)..(194): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacngtcgtcacatctctgcactggaaccagcagttcgactagtttggtgtacttttaataaaccgttagttcggttccttacccgttacggtaaacccaaaccgacgacccaaaccccgaacgggaaccaaaaccgttaccccctaaaactcctaagttagtaactttttagacggtaacggttacaaaacgttaacggcccggtcccgtttacgttcggggttcccctagtaacgttccgttcctttccgtcgttccggaccttaccggtaagttcgttacggacctaaaccggcccggtccctcccgttaacggtcccgtttcccgttcggttccgggtccttacccggaggttccgtttacggaacggttacgtagggaacggttccgttaagtttaccgttttaacggttaccttgaaccgtacgttaccttactaagttagcggacccgtaaccggtacccctaaacccgtaacgtttaacgttccggtttaacccgggttaacgggttaaacggggtcccgggttaacccgaccggtttaacccggtaaaccccgggttccggtttaacgggacccgaaaccgggttaaaccccccaaacccggggttacccccctaaaccccggttccgttaaccgtccccgttaaccgtttacccccg

SEQ ID NO: 239902 - DNA, 743 bp, Homo sapiens
  misc_feature: GYAE6OF01D7XKO.9.81.H04.1.454.CMB.1.raw
  modified_base (194)..(194): a, c, t, g, unknown or other
  misc_feature (194)..(194): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacngtcgtcaccatcctcctgcactggaaccagcagtgactatttggtgctttaataacttatcgtcttccgtacggtaaccaacagccaacccaggaccaaacgtccccaaactcattgtaatttataggaggtacaagtaacgccggtaccttcgtcgggtccctgtactccgtcttactcgtcggtcctacgtaacgttcgtcggaaccaaccgtacccggtcccttacccgtacggtaccccgttcgtccggttacgggccttcccgacggtccgtaggaaccggtagtagggacggtacgttagttaacgttttacgttaacgtcgtacgtacggtccttagaactttaagtccggaacgtacgggaccctaacccgtaagtaacgtttcggttaaccggttaaccgggtaaggttacccggggaacccgttaaccgggttacccgtaaccccggttaccgtaacgggttacccgaaccggtaacccccgaaaccgggtaaccccctaaaccccggttagtacccgttaccctccgtttacccccgg

SEQ ID NO: 239903 - DNA, 648 bp, Homo sapiens
  misc_feature: GYAE6OF01E20Z7.9.81.H04.1.454.CMB.1.raw
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgactattggtgctttaataactatgtctccgtcggtaccaacagccacccaggacaaacgtccccaaactcatagtatttatgtaggtacaagtaacgccgtccctcgtcgggtccctgactcgtcttctcgtcggtcctccgaagtcgtacggacaaccgtaccggccctacccgtcgaccgttcctacgtcggggtcctacccgaggtcgtacggaaccgtagtcgggtacggtccttaggtaactttacgttacgtacgcacgtctacatagtcgaccgacgcctaacccaataacttcgtacgttacggaacggtccgggaaccgtaccggtaccgtacccggttaccgtaacggtcccgaaccgaccccgaaacggtacccccaaacccgtacttccgtccgtaccgtttcccg

SEQ ID NO: 239904 - DNA, 771 bp, Homo sapiens
  misc_feature: GYAE6OF01DMUZ8.9.81.H04.1.454.CMB.1.raw
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacgagggtcctgggcccagtctgccctgactcagcctccctccgcgtccggtctcctggactagtcgtcactatctctgcactggaaccagcagtnactgttggtntcttaataactatntctcctaggtaccaacacgaccaccgagacaaacgtaccccaaactcagtactaatttagaggacgtacaacgtaacggccggacccttcggtcgggtccctgtactccgtcttctcgtcgtcctacacgtcgtacggaccaacgccggtccctccgtacgaactacgttccgtacggtccggtacctacggtacgggtacgtagggaaccggacgggaaggttcgtacggttaatttacgtttacgcgttccgtaggttactacgtaattacgtacggacctaaggttacggttacgggtaacctaacccggtttaccccggttaccggggttacgggtttaacccgggtttaccggggggaaccggggttaaacggggaaaaccccggggtaacggggtttaccccgggttaaccccggttaaacgggttacccggtaccggaaaacccccggggtaccccgtaaacgggttccccccgtaccccgggtttaccccccggttccggttaaccccccg

SEQ ID NO: 239905 - DNA, 731 bp, Homo sapiens
  misc_feature: GYAE6OF01DZEWQ.9.81.H04.1.454.CMB.1.raw
  modified_base (238)..(238): a, c, t, g, unknown or other
  misc_feature (238)..(238): n is a, c, g, or t
  modified_base (266)..(266): a, c, t, g, unknown or other
  misc_feature (266)..(266): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcgtcaccatctcctgcactggaaccagcagtgacattggncttaataactatgtctctgtaccaacanacacccagacaaacgtaccccaaactcatgtatttatagaggtacaataacggccggtccctcgtcggggtccctagtactcgtcttctcgtcggtcctactaagtcgtcgtacaaccgaccggtccctccccgtcgtacccgtcgttccgtcggggaccttcccggagggtcctaggtaaccggtagttacgggacgttcgttacggttaacttttaacgtttaaccgtcggtacctacggtaccttactacgttaacgtacggaccgaaccgggtaccctaacccgtaaaccgtaagtttaccggttaccggttaccggggtaaacggttccggggaacccgttaaccgggttacccgtaacccggttacccggttaacgggtcccgtaaaccccggaacccccgaaaccgggtaaccccccaaaccccgttacgttccgtacccgttaccgtttacccccgg

SEQ ID NO: 239906 - DNA, 762 bp, Homo sapiens
  misc_feature: GYAE6OF01CQ6QO.9.81.H04.1.454.CMB.1.raw
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacgagggtcctgggcccagtctgccctgactcagcctccctcgcgtccgggtctcctggacagtcgtcaccattcctcctgccacgtacggaaacccagccaagttgacctagtttggtgtccttaataactattggttcctccgttacggtaacccaactacggcccaacccgaaggaccaaaaccgttcccccaaaacgtcaagtttcggtaaactttttagcggaaacggtttacaaacgttaacgggcccgtaccccgtttggtcggggttacccctaggtaaccgttcccgtctttcgtccggtacggtacctaccggtaagtcgtacggacctaaaccggccggttccctacccggtgtaccccgttcgtacggtcgaccgtccgacggttccgtagacggtacgtcggacggtcttagttactttacgttacgacgtaccgtactctacgtaattacgacgtccgaaccggtaccctaaccgtaacgtaacgttcggttaccggtaacgggttacgccggggtaaccctcgggtacccttacccggtacggttaccggtaccaaccggtacccggaaaccgtccccgtaaacccctgttaacccgttcctacccgttccccg

SEQ ID NO: 239907 - DNA, 821 bp, Homo sapiens
  misc_feature: GYAE6OF01BENJI.9.81.H04.1.454.CMB.1.raw
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
tcagtgatacgtctcacgaccggtgctcgatttagtagtgtagattcgcggggggggtctcaggaggcagcgctctcaggacgtcaccaccatggcctggctctgctcctcctcaccctcctcactcagggcacagggtcctgggcccagtctgccctgactcagccctccctccgcgtccgggtctcctggacagtcggtcaccatctcctgcactggaaccagcagtgactagtttgggntctttaanaaacttntgtcctcctaggtaaccaaacacgccaacccgaggacctaaacgtccccaaactcatgatttatggacggtacaaagtaacgccggtacccttcggtcggggttacccctggtactccggtctttccgtcgttacgggccttaccgaagttcgtacggacctaaacgacccgggtccccttcccgtcggtacccgttcgtacggttcgggccttaccgacggttcctacgggtacgacggtacgggtaggtacccttaggttaactttaccgtttacggtttacggtttcggtacctttaacgttaagtttaaccgtaaagggtttaaccggggtttaaggttaaacggggttttacggggtttttacgggggggtttaaccggtttaccgggggggaaccggggttaaccggggtaaacccgtaaacgggttcccgtttacgggtaacccccgtttacgggtaccgggttacccgaaccggttaaccccccggaaacggtaccccccaaacccggttcgttacttaccccgtaacgtttccccgttcccgttaaccccccccg

SEQ ID NO: 239908 - DNA, 756 bp, Homo sapiens
  misc_feature: GYAE6OF01CFV3R.9.81.H04.1.454.CMB.1.raw
  modified_base (194)..(194): a, c, t, g, unknown or other
  misc_feature (194)..(194): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacngtcggtcaccatctcctgcacgtggaaccagccagtgactagttggtgtacttaagtaactattcgttccttccgtcggttaaccaacacgtacccaacccgaggaacctaaaccgtacccccaaactcaagttacgtatttagtcgtaacggtactaaagtaacggtccggtaccctcggtcgggttcccgtgtacgttaccgtctttaccgtcgttcggtacctaccgtaagtcgtacggaccgtaaccggtacccggccccttcccgttacggtacccgtccgttcggtcgggtcctccgaacgggtcgtgtaaccggagtcggacggtcgtacgttattactttacgcgtactacgtactactagtctacgtacgaccggaccctaaccgacgttaacttccgggttaccgttaaccggggttacggtacccggggtacccgtaacccgggtttaccgacccggtttaccgtaacggggtacccctaccggggaaccccgaaaccccgtaccccaacccccggttaacgtcccttaaccgtccccgttttacccccgg

SEQ ID NO: 239909 - DNA, 760 bp, Homo sapiens
  misc_feature: GYAE6OF01B2FRB.9.81.H04.1.454.CMB.1.raw
  modified_base (223)..(223): a, c, t, g, unknown or other
  misc_feature (223)..(223): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcgtcaccatctctgcactggaaccngcagtgactagtttggtgtactttaataacgttattcgttccttccgtggtaaccaacacgccacccgaggaccaaacgtccccaaactcactgtatttatgacggtacaatagcggccctcgtcgggtcctgactcgtcttctcgtcgtcctaccgtaacgtcgtacggaccaaccgaccgggtccctacccgtcgtacccgttctcggtcgggtcctccggaggtcgtacgacggtagtcggaggtcttagtaactttacgtttaacgtcgtacctacgttaccttactaacgttacgttaccggaccgtaaccgggaaccctaaacccccgtaaagttaacgtttccggtttaccgggtttaccggggtaaacggggtttaccccggggaaccggttaacccccggggtaccctttaaccccggggttacccggttaaccgggtaccccgaacccggtaacccccggtaaacccggaccccccgtaaaccccccgttaccgttacccggtccccgttaaccgtttaccccccgg

SEQ ID NO: 239910 - DNA, 663 bp, Homo sapiens
  misc_feature: GYAE6OF01BS0U0.9.81.H04.1.454.CMB.1.raw
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (244)..(244): a, c, t, g, unknown or other
  misc_feature (244)..(244): n is a, c, g, or t
  modified_base (481)..(481): a, c, t, g, unknown or other
  misc_feature (481)..(481): n is a, c, g, or t
  modified_base (502)..(502): a, c, t, g, unknown or other
  misc_feature (502)..(502): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacgagggtcctgggcccagtctcgccctgactcacgcctccctccgcgtccggtctcngacngtcgtcaccatctctgctacgtacggaaccagcagtgactagttggtntacttaatactatcgtctcgtacgtaaccacacgccaccaggaccaaaccgtaccccaaatccagtgttatttagaggtacgtataaacgtacggccggtaccctggtccgggtccctgtactcgtacttcgtacgtcgtactacgtagtctacggactaccgccgtccctcgtcgtaccgtctcggtcgtcctcgaggtctaggactagtaggacgtcttagttactttataccgngacgtctacgttctaacgttnaccgacgtaccggaccctaaccgtattacgtcggttacgggtaacggtagggtaccccggtaccgtacccggtacgtacccggttacgtaccggaccgacccggtaaaccccgacccggtaacccctacccgttgtacccgttaccgtcccgtttaccccg

SEQ ID NO: 239911 - DNA, 823 bp, Homo sapiens
  misc_feature: GYAE6OF01EZFPK.9.81.H04.1.454.CMB.1.raw
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcacgcctccctccgcgttccgggtctcctggacagtcgatcaccatctccngcactggaaccngcagtgagtgttgggattatgaccttgtctcctggtaccaacagcaccaggacaaacgcccccaaatcatctatttactaggacggtacacgtaaacgccggtccctagtacggggttttctattcgtctttctcgtcggcctacgtaacgttctacggtaaccaaacccggtaccgtccccgttaccccgtacgtaaacctaacgttcccgttacgtcgggggtaccttacccgtaacgggtccgtagggaaccggggtaaccgggtaagggaccgtttagggtaaacttttaacgtttaccgttaacggtccttacggttccttaccgtaaagttaccgttacggaccgtaaacggtacgggtttacgggtaccggttaaacccgttcccgggttttaacccgggtaccggggtttaaccggtttccgggggaaccggggggtaaccgggtaaaccccgggttaacgggttaccgggttaacccccggtttacccgttaacccggggtaaccgaaccccgggttaaccccgtaacggggttacccccgttacccgggttacccccccccgggttcgggttcccgttaacccccgg

SEQ ID NO: 239912 - DNA, 714 bp, Homo sapiens
  misc_feature: GYAE6OF01EJ12N.9.81.H04.1.454.CMB.1.raw
  modified_base (208)..(208): a, c, t, g, unknown or other
  misc_feature (208)..(208): n is a, c, g, or t
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
  modified_base (542)..(542): a, c, t, g, unknown or other
  misc_feature (542)..(542): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcggtcaccntcctcctgcacgtggaaccagcagtcgactagttggtgactttataaacctntcgttacctccgtacggtaccaacncgtccaacccgaggaccaaacgtccccaaaacgtcatacgtatttacgtaggtaggtacaaagtaacggtcccggtacccttccggtcggggttccctagtacgttccgtcttcgtccgtcggtctaccgtaacgtcgacggtaccaaccggtccggtccctccgttaccggaccgttccgtcggtcggggtaccctcggtacggtcgtacggacgtagtagggaacggtcttaagtatttacgtcgttagccgtanctacgtactaggtcacggtcgacctaaccgtattaacggttcgttaaccggtacgggtaacgggtcggtaaacccctagggttacccgtacccggttacgtaaccggggttaccaacccggggtaccccgaacgtacccccgtaacctccgggtactcccgtaccgttcccg

SEQ ID NO: 239913 - DNA, 787 bp, Homo sapiens
  misc_feature: GYAE6OF01BS64M.9.81.H04.1.454.CMB.1.raw
  modified_base (243)..(243): a, c, t, g, unknown or other
  misc_feature (243)..(243): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgctactagggaaccagcagtgacatttggngtcttaataacctattgtccttctacggtaaccaacagccaacccaggaccaaacgtccccaaactcacttagtatttagtgaggtacaagtaaggaccggtcccttcgtcgggtcctagtacgttcgtcttccgtcgtcgtaccgtactaaggttcgtacggacaaccgacccgtcccttacccgtccggtaacccggttccgttccgtcggggtaccctaccggtacgggtaccgttacggacgttaggtacgggtaacggtcgttaaggtttaacgtttacttacggttacgacctacggtaaccgttcgtaaacgttacgtccggtaaccgtaaccgggtacccctaaaacccacggtttaaacttccgggtttaccggttaaacccggggtaagggttacccggggaaaccccgttaccgggtacccgttaaccccgggttaccgtaaccgggttccgaaacccccggaccccggtaaacccggaacccccgttaacccccgtaacgggttcccttaaccgtaacccgtttcccccggg

SEQ ID NO: 239914 - DNA, 726 bp, Homo sapiens
  misc_feature: GYAE6OF01ECP67.9.81.H04.1.454.CMB.1.raw
  modified_base (237)..(237): a, c, t, g, unknown or other
  misc_feature (237)..(237): n is a, c, g, or t
tcagtgatacgtctcacgaccggtgctcgatttagtagtgtagattcgcggggggggtctcaggaggcagcgctctcaggacgtcaccacatggcctgggctctgctcctcctcaccctcctcactcagggccacgacggtccgtgggcccagtctcgccctgactcacgcctccctcggccgtccggtctccgtaggacagtcggtccaccacttcctcctgcacgtacggaaccnggcagttgactagttggctctttaactaacgtagttcgttacctcgtacgtaccaaagcgaccctaaccgacggtaccaaaaccggtaccccttaaacacgtacttagttaattttaagcgtaacggtactaaagtaaccggcccgtcccgttacggtcggggtttacccctaggtacgtcccgttctttcgcgttccgggtacccgttacccgaagtttcccgtccggaacgtaaccccgtaccggttccccgtacccgttacggtcccgtgttccggtcggtacccgtcgtaacggtcgtacggacgtacgtaggtacgtacttagttacttacttagacgtcgacgtctacgtatcgtacgaccgacgaccaaccgtactgtacgttaccggtagggaacgtccggtaccgaaccgttccgtaccggtccgtacgtcgaacccgtaccgaacccggtaccctacccgagttcccgtctcgtacccg

SEQ ID NO: 239915 - DNA, 633 bp, Homo sapiens
  misc_feature: GYAE6OF01BIL0N.9.81.H04.1.454.CMB.1.raw
  modified_base (194)..(194): a, c, t, g, unknown or other
  misc_feature (194)..(194): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (302)..(302): a, c, t, g, unknown or other
  misc_feature (302)..(302): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacngtcggtcacctatctcctgcactggaaccagcagtgactagttggncttataactntgtctctggtaccacacgcaccgagacaacgtccccaaatcatgtatttagngagtacaagtaacgcggtaccctcgtcgggtccctgactcgcttctcgtcggcctaccgtaagtcgtcggaccaaccgtaccggcccttacccgtcgacccgttctcgtcgggaccttccgaggtctacgggactagtggacggtctagtactttatcgngtacgcgtctntagtatcgactacggaccctaaccctaagtacgttcgttaccgtacgggtaaggttaccgggacccgtacggttacccgtaccgttaccgtacggtacccacccgaacccgtaaccggtaacccctaacccctacgtaccgttcccttacccgttcccgg

SEQ ID NO: 239916 - DNA, 748 bp, Homo sapiens
  misc_feature: GYAE6OF01AXVGY.9.81.H04.1.454.CMB.1.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaagtgcagctgggtggaggtcgtggggggaggcgttggtgcagcctggcacctccctgagacctctcctgtcgccgcctctggtacttcattgtttagatgtatttatgccagtcgcctacgttcggggtcccggacgtaacggtttcccgaagggggacgggtcctggggtaggtggggttcctacggtaggttaacgtttacgttcgggaagttacgtaccaccgtacccacgtaacggtctacgtcggtacggtacctcggtgtcgggacggggtcccgtaacttccgtacccagttccgtaccgacgtaagaacctaaacgacccaaacgtaacccttaacccgtaacttactccgtaacgacttaaacgtaggtaaacgtgggttaccgttaggtaacggttaagggtttaggacggtaaccggttaccgggttacccgttttaggtttaacgttttacggtacgggtttaagaaaccggtaaaaacgtaaacggttaacccggggtaaaaaccccggtaggggttaccgggaaccgggtccgtaaaacgggg

SEQ ID NO: 239917 - DNA, 876 bp, Homo sapiens
  misc_feature: GYAE6OF01E3ZD9.9.81.H04.1.454.CMB.1.raw
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcacgtcctccctccgcgtccgggtctcctggacagtcggtcaccatctctgcactacggaaccagcagtgactagtttgggtcgtactttaataaacttatcgttcctaccgttacggtaaccctaaacacgtcccaacccgaacgggacctaaaaacggtaccccccaaaactcctaagttagtaacttttaagaggtaacggtaacgtaaacgtaaacggtcccgggtaccccttcggttaccggggttcccgtaggtacgtccgtctttccgtccggttcggtacccgttacctaaacggttccgttacgggaacctaaaccggtacccggtccccgttacccgttaccggtacccgttccgttccggtacggggtcccctccggaacgggtcctacggaacggtaagttacgggtaacggtcgttaacgtttaacgtttaacgtttaccggacgtacccgtacggtcccttaacgtaacgtttacggtacggaaccgtacccggggaaacccctaacccttaaacgtaaccggtttaccggttaccgggtttacggggaaaccgggttccgggaaaccccgtaaccgggttaccccgtaacccgggtttacccgtaacggggtccccaaacccggggtaccccgaaaccccgggttaaacccccaccccggtaacggttcccgtaacccgttacccgtttccccccggg

SEQ ID NO: 239918 - DNA, 703 bp, Homo sapiens
  misc_feature: GYAE6OF01BZOX1.9.81.H04.1.454.CMB.1.raw
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
  modified_base (539)..(539): a, c, t, g, unknown or other
  misc_feature (539)..(539): n is a, c, g, or t
tcagtgatacgtctcacgaccggtgctcgatttagtagtgtagattcgcgggggggggtctcaggaggcagcgctctcaggacgtcaccaccatggcctggctctgctcctcctcaccctcctcactcagggcacgagggtcctgggcccagtctcgccctgactcacgccctccctccgcggtccgggtctccgtaggactaggtccggtacacctattccgtcctgcacgtcggaacccngcagtnactagttggtgtacttataactntcgttctccgtacgtaccaacncgaccaccgagaccaaaccgtacccctaaactctagtagttactttaagtcggaacggtaacaaagtaaccggccggtacccgttggttccgggtcctacgtactccgttcttcgtcgtcgtcctacgtacgttcgacgaccaacgtcccgtcccttaccgtcgtacccgtcgtccggtcggtcctaccgacggtccgtagacgtgtaggacgtcttagtatttaactcgactcgatctatacgtntccggtacgacccaccgtaacctggtaccgtttacgttacggtacggaaccggttccggaccgttacccggtaccgttacccggttacgtaaccgtcccgaacccggtaaccccgaacccggtacccctaccgtaaccgtttccgaccccgttccttaccccgg

SEQ ID NO: 239919 - DNA, 761 bp, Homo sapiens
  misc_feature: GYAE6OF01BNBNI.9.81.H04.1.454.CMB.1.raw
  modified_base (195)..(195): a, c, t, g, unknown or other
  misc_feature (195)..(195): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacngtcggtcaccatctctgcactggaaccagcagtgactagttggtgtacctttaataacttagttcggttcctacccgttacgggtaaccaacgacgaccaaccccgaaggaacctaaaaccgtacccccaaaactccaattgtaacttttagtggtaacggtactaaagtaacggccggtaccccgtcggttccggggtccccgttaggacttccgtcctttcgtcgtcggtacccttaccgtaacgttcgtacggaacctaaccgacccggtccctcccgtacgtacccgttcgtcgtcgggtacctaccgacggtcgtacggacgtagtaggtacggtaccgtagttaactttacgtttaccgtcgtacgtagtccttagtaactgtccgaccgtaccgacccctaaccgtacgtaacggttcgttaccggttaaccgggtaacgggttaccgggtacccgttaacccgggttacccgtacccggttaccgtaccggtccgaacccggtaccccgtaacccggacccctaaccccgtacttacccgtccgtaccgttaccccgg

SEQ ID NO: 239920 - DNA, 789 bp, Homo sapiens
  misc_feature: GYAE6OF01BA5F8.9.81.H04.1.454.CMB.1.raw
tcagtgatacgtctcacgaccggtgctcgatttagtagtgtagattcgcggggggggtctcaggaggcagcgctctcaggacgtcaaccaccatggcctgggctctgctcctcctccaccctcctcactcgagggcacgagggtcctcgggccctaggtctcgccctgactcacgccctcccgtccgcggtccgggtctccgtggacgtacgtcggtccacctatcctccgtcgacgtacgtacggaacctgcaagtacgactagttcggtctacttaacgtaactacgttcgtccgttaccgtacggtaaccgaacgacgacccgaaccgacggtaacctaaaccgtaccccaaacgtctagtacgttaattacgtacggtacgttaacgaagtaaccggtccggtccccgtttacgggtcccggggttacccttacggtaccgttcgttacctttccggtacgttccggtaactcccggttaacggtccgtaacggaccctaacggtccccggtacccttaccggttacgtcccggttacgtccgggtaccggtcgtaccggtcggtcgtacggtaacgtgtacggcgttcgttaagttactttacggtagtccgtactcgtacttactaggttcgccgtaaccgaccggtactaaccgtacgttacggttcggtaacggttacggggaacgtccggtaacccgtacgtacccgtaccggtacgtacgacccggtaccgaacccggacccgtaccccaaccgttggtaacccctgtaacccttcccg

SEQ ID NO: 239921 - DNA, 672 bp, Homo sapiens
  misc_feature: GYAE6OF01ENIDQ.9.81.H04.1.454.CMB.1.raw
  modified_base (310)..(310): a, c, t, g, unknown or other
  misc_feature (310)..(310): n is a, c, g, or t
  modified_base (492)..(492): a, c, t, g, unknown or other
  misc_feature (492)..(492): n is a, c, g, or t
  modified_base (506)..(506): a, c, t, g, unknown or other
  misc_feature (506)..(506): n is a, c, g, or t
tcagtgatacgtctcacgaccggtgctcgatttagtagtgtagattcgcgggggggtctcaggaggcagcgctctcaggacgtcaccaccatggcctgggctctgctcctacctcaccctcctcactcgaggcacagggtcctgggcccagtctgccctgactcagccctcctccgcgtccggtctccgtggacaggtcgtcaccagttcctacctgcctaacgtggaacccaggacctaaggttgaacctagtttgggctacttttaaataaccgttaagtcgttcctaccgttacgtacccaacgacnccacccgaagacctaaacgtacccctaaactctagtactatttagtaggagtacaagtaacgccgtacctcgtacgggtcctagtctcgtctctacgcgactacgacgtcgagacaaccgaccggtccctaccgtacggtacctcgtcgtacgcctacgagccgtagtacgagtagacggtntacgtattatcganacactacgaaagaaacgtgtaaccgccttggttcccgggttagggttaccgggacgggttacgacggtccctacggttacctagtaccgaccgtaccgacggtcctccccgttacccgtccggtacctaccgttccctaaccctttccccctccgtccctaaacgg

SEQ ID NO: 239922 - DNA, 502 bp, Homo sapiens
  misc_feature: GYAE6OF02IVZO0.9.81.H04.1.454.CMB.1.raw
  modified_base (430)..(430): a, c, t, g, unknown or other
  misc_feature (430)..(430): n is a, c, g, or t
  modified_base (488)..(488): a, c, t, g, unknown or other
  misc_feature (488)..(488): n is a, c, g, or t
tcagtgatacgtctcacgaccggtgctcgatttagtagtgtagattcgcgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcaccaggcaaagtccccaaactcatgatttatgaggtcaataagcggccctctggggtccctgatcgctctctgctcagtctggtaacacggcctcctgaccgtctctgggctccaggctgacgatgaggctgattattactgcagctcatatgcaggcacccanaatgtcttcggaagtgggaccacggtcaccgtctacggtcagcccaaggcccaacccnctcgtcactctccg

SEQ ID NO: 239923 - DNA, 499 bp, Homo sapiens
  misc_feature: GYAE6OF02HBOZV.9.81.H04.1.454.CMB.1.raw
  modified_base (487)..(487): a, c, t, g, unknown or other
  misc_feature (487)..(487): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcaccaggcaaagtccccaaactcatgatttatgaggtcaataagcggccctctggggtccctgatcgcttctctggctcaagtctggcaacacgcctccctgaccgtctctgggctccgaggctgacgatgaggctgattattactgcagctcatatgcagccaccacaatgtctggagtggaccacgtcaccgtctaggtcacgcccaagcccaacccnctcgtacactcg

SEQ ID NO: 239924 - DNA, 524 bp, Homo sapiens
  misc_feature: GYAE6OF02GHXMM.9.81.H04.1.454.CMB.1.raw
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctcgtggggtccctgatcgcttctctggctccaagtctggcaacacggcctccctgaccgtctcgtgggctccgaggctgacgatgaggctgattattactgcagctcattatgcaggccacccactaatgtacttacgggaagtcgggaccacggtcaccggtcctaggtccacgcccaacggcccaaccccactcgtcactccg

SEQ ID NO: 239925 - DNA, 511 bp, Homo sapiens
  misc_feature: GYAE6OF02F97P7.9.81.H04.1.454.CMB.1.raw
  modified_base (439)..(439): a, c, t, g, unknown or other
  misc_feature (439)..(439): n is a, c, g, or t
  modified_base (501)..(501): a, c, t, g, unknown or other
  misc_feature (501)..(501): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgacccgtctctgggctccaggctgacgatgaggctgattattactgcagctcatatgcaggccaccanaatgtcttcggaagtgagaccgtacggtcaccgtcctaggtccagacccaaggcccaacccnctcgctaccg

SEQ ID NO: 239926 - DNA, 518 bp, Homo sapiens
  misc_feature: GYAE6OF02F9JH8.9.81.H04.1.454.CMB.1.raw
  modified_base (239)..(239): a, c, t, g, unknown or other
  misc_feature (239)..(239): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctcctggtaccaacagcacccaggcaaagtccccaaactcatgatttatgaggtcaataagcggccctctggggtccctgatcgcttctctgctccagtctggcaacacggcctccctgaccgtctctgggctccaggctgacgatgagctgattattactgcagctcatatgcaggccacccataatcgtcttcggaagtcgggaccacggtccaccggtccttagggtccagcccaaggcccaaaccccgactcgtcacttccg

SEQ ID NO: 239927 - DNA, 522 bp, Homo sapiens
  misc_feature: GYAE6OF02FV3UA.9.81.H04.1.454.CMB.1.raw
  modified_base (427)..(427): a, c, t, g, unknown or other
  misc_feature (427)..(427): n is a, c, g, or t
  modified_base (507)..(507): a, c, t, g, unknown or other
  misc_feature (507)..(507): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccgaggctggacgatgagctgattattactgcagctcatngcaggccacccacaatcgtcgttaggaagtcggaccacggtccaccgtcctaggtccacgcccgaacggcccaaaccccnctcgtaccacttccg

SEQ ID NO: 239928 - DNA, 605 bp, Homo sapiens
  misc_feature: GYAE6OF02GIAI5.9.81.H04.1.454.CMB.1.raw
  modified_base (232)..(232): a, c, t, g, unknown or other
  misc_feature (232)..(232): n is a, c, g, or t
  modified_base (309)..(309): a, c, t, g, unknown or other
  misc_feature (309)..(309): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgacgtcgacgtcgtccctacggccgtccggtactccgtggacagtcggtcaccatctcctgcactggaaccngcagtgacattggtgcttataactatgtctcctggtaccaacagcacccaggccaaagtccccaaatcatgatttangaggtcaagtaagcggccctgtcggggtccctgactcgcttctctggctccaagtctggacaacgccggtccctcccgtgacccgttctcgtgggctccgaggctgacgtagtgacggctgtattattacgtgacagtctctatacgtcgacgacggacccaacccgaactaacgttcgtacgtttacgggaacggtccgggtaccgtaccggtaccgtaccggttacccgttagggtcccgaaccgacccgaaccggcccctaaaccccgacgttaccgtacctacccgttcccg

SEQ ID NO: 239929 - DNA, 618 bp, Homo sapiens
  misc_feature: GYAE6OF02J2INR.9.81.H04.1.454.CMB.1.raw
  modified_base (240)..(240): a, c, t, g, unknown or other
  misc_feature (240)..(240): n is a, c, g, or t
  modified_base (301)..(301): a, c, t, g, unknown or other
  misc_feature (301)..(301): n is a, c, g, or t
  modified_base (433)..(433): a, c, t, g, unknown or other
  misc_feature (433)..(433): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctcctggtaccaacagcacccaggcaaacgtccccaaatcatgattangagtcaatacgcgcctgtcggggtcctgactcgcttctcgtcggtctaccgaagtcgtcggaccaaacgccggtcccttacctcgaccgtcgtcgtcgggcctccgaggtcctaggacgtagtggtacggtnttagtaattacttacgtacgctacgctacattagtcgaccgtacgtacccaacccgaacgttaacttcggtaccgttacgggaaaggttccggacccgttacggtacccgtaaccggttcctacggtacccgaacgaccccgtaaccgtcccgaaacccctagttaccgtaccgtacccttcccg

SEQ ID NO: 239930 - DNA, 539 bp, Homo sapiens
  misc_feature: GYAE6OF02I7RPF.9.81.H04.1.454.CMB.1.raw
  modified_base (524)..(524): a, c, t, g, unknown or other
  misc_feature (524)..(524): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggccaaagtccccaaactcatgatttatgaggtcaataagccggccctcgtcggggtccctgactcgcttctctggctcaagtctggacaacacggcctccctgacccgtctcgtgggcctccgaggctgacgatgagctagtattattactgcagctcatatgctacggaccacccacaacttgtcgttacggaagtcggaccgacggtcgacccgtccttaggtccacgcccaacggcccaaccccnctacgtccacttccg

SEQ ID NO: 239931 - DNA, 525 bp, Homo sapiens
  misc_feature: GYAE6OF02H64UX.9.81.H04.1.454.CMB.1.raw
  modified_base (240)..(240): a, c, t, g, unknown or other
  misc_feature (240)..(240): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctcctggtaccaacagcacccaggcaaacgtccccaaactcatgatttatgagtcaataagcgcctgtgggtccctgatcgcttctctgctcaagtctgcaacacggcctccctgacccgtctcgtggctcgagctgacgatgagctgattattactgcagctcatatgcaggccaccactaatgtcttacggaacgtcgggacctacggtaccgaccgtccgtacggtacacgacccgaacggacccaaccccgactcgtaccacttcccg

SEQ ID NO: 239932 - DNA, 533 bp, Homo sapiens
  misc_feature: GYAE6OF02GIF39.9.81.H04.1.454.CMB.1.raw
  modified_base (196)..(196): a, c, t, g, unknown or other
  misc_feature (196)..(196): n is a, c, g, or t
  modified_base (361)..(361): a, c, t, g, unknown or other
  misc_feature (361)..(361): n is a, c, g, or t
  modified_base (421)..(421): a, c, t, g, unknown or other
  misc_feature (421)..(421): n is a, c, g, or t
  modified_base (431)..(431): a, c, t, g, unknown or other
  misc_feature (431)..(431): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcggtcaccatctcctgcactggaaccagcagtgacattggtgcttataactatgtctcctggtaccaacagcacccaggcaaacgtccccaaactcatgatttatgaggtcaataagcgccctgtcggggtccctgatcgcttctctgctcagtctggcaacncggcctcctcgaccgtctcgtcgggctccgaggtctgacgatgaggtctgtattattacngcagctcatntgcaggcaccatatcgtcgtggaacgtcgggacctacggtccaccggtacctacggtccacgaccccgaacggccccaacccgctacgtaccaccgttcccg

SEQ ID NO: 239933 - DNA, 609 bp, Homo sapiens
  misc_feature: GYAE6OF02I73MB.9.81.H04.1.454.CMB.1.raw
  modified_base (245)..(245): a, c, t, g, unknown or other
  misc_feature (245)..(245): n is a, c, g, or t
  modified_base (303)..(303): a, c, t, g, unknown or other
  misc_feature (303)..(303): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttanaactatgtctcctggtaccaacagccacccaggcaaagtccccaaactcatgatttangaggtcaataagcggccctcgtcggggtccctgatcgcttctctggctccaagtctggcaacgacggcctcccgtgacccgttctcgtgggcctccgaggctgacgatggaggcttgagggtttacttactcgactagcctacattagtgccacggaccaacccgtactaacgttcgtaccgttacgggaacggttcgggacccgtaccgggtaccgtaaccccggttacctacgggttaccaaccgggacccccgtaacgggaccccctaaacccccgacgttccggttacccacccgtttcccg

SEQ ID NO: 239934 - DNA, 519 bp, Homo sapiens
  misc_feature: GYAE6OF02G4WRJ.9.81.H04.1.454.CMB.1.raw
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctcggggtccctgatcgcttctctggctccaagtctggcaacacgcctccctgaccgtctcgtgggctccgaggctgacgatgaggctagattattactgcagctcatatgcaggccacccataatgtcttcggaagtcgggaccacggtccaccgtccgtaggtcacgcccaaggcccaacccgactcgtccacttccg

SEQ ID NO: 239935 - DNA, 536 bp, Homo sapiens
  misc_feature: GYAE6OF02HB6ZQ.9.81.H04.1.454.CMB.1.raw
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
  modified_base (303)..(303): a, c, t, g, unknown or other
  misc_feature (303)..(303): n is a, c, g, or t
  modified_base (386)..(386): a, c, t, g, unknown or other
  misc_feature (386)..(386): n is a, c, g, or t
  modified_base (415)..(415): a, c, t, g, unknown or other
  misc_feature (415)..(415): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggtncttataactatgtctcctggtaccaacagcaccaggcaaacgtccccaaactcatgtatttangaggtcaataagcgcctgtcggggtcctgatcgcttctctgctcatctggacacgacgcctcctcgaccgtctcgtggctcgngctgacgagtgaggtctgtattagttacngcagctcatagtcgacacgccaacccatactcgtacgttacggacgtcggaccgacgtaccgacccgtcgtacggtcaccggcccgtaacggccctaacccgactcgtacctaccgttccg

SEQ ID NO: 239936 - DNA, 578 bp, Homo sapiens
  misc_feature: GYAE6OF02IL3YC.9.81.H04.1.454.CMB.1.raw
  modified_base (162)..(162): a, c, t, g, unknown or other
  misc_feature (162)..(162): n is a, c, g, or t
  modified_base (210)..(210): a, c, t, g, unknown or other
  misc_feature (210)..(210): n is a, c, g, or t
  modified_base (369)..(369): a, c, t, g, unknown or other
  misc_feature (369)..(369): n is a, c, g, or t
tcagtgatacgtctcacgaccggtgctcgatttagtagtgtagattcgcgggcagcaagatggtgttgcagacccaggtcttcatttctctgttgctctggatctctggtgcctacggggacagtgtgatgacccagtctccagactccctggctgtgtctntgggcgagagggccacatcaactgcaagtccagccagagttgttttanacggtctccgacaacaagaactacttagctttggatcagcaagaaaccaggacagcctactaaactgactcattactggcatctaccggctaagtcccggggtcctcggaccgaattcgagtggcacggcgggtctaggggaccaggtatttcgactcnctaaccagttccaagcaatcctgctaggctagagaatgaggctagtttacttacgtagtctaaacctgttttctacgggggtcttccggacgtaacggaccgtaaggtacggaaatacgaaaccgtaaagtacgtagacgtcgacaacccgtgtacctggttccttacgaattcccgttccaccgtacttaccgtagtacgaacttacg

SEQ ID NO: 239937 - DNA, 537 bp, Homo sapiens
  misc_feature: GYAE6OF02GEWZO.9.81.H04.1.454.CMB.1.raw
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
  modified_base (302)..(302): a, c, t, g, unknown or other
  misc_feature (302)..(302): n is a, c, g, or t
  modified_base (374)..(374): a, c, t, g, unknown or other
  misc_feature (374)..(374): n is a, c, g, or t
  modified_base (403)..(403): a, c, t, g, unknown or other
  misc_feature (403)..(403): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (523)..(523): a, c, t, g, unknown or other
  misc_feature (523)..(523): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggncttataactatgtctctggtaccaacagcaccaggcaaacgtccccaaactcatgtactttangaggtcaataacgcgccctgtcggggtccctggactcgcttctctggctcagtctggacaacgcgcctccgngaccgtctcgtggcctcgaggtctgacgntggagctagtattattcgncagtctnagttacgcgacgagacctaccaatagtcgttcgttacggagtccggacctcggtaccaccgttcagtccgacgtaccgaaccgcccaacccgtntcgtaccacttccg

SEQ ID NO: 239938 - DNA, 531 bp, Homo sapiens
  misc_feature: GYAE6OF02HJ7CK.9.81.H04.1.454.CMB.1.raw
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctcaagtctggacaacacggcctccctgacccgtctcgtcgggcctccgaggctgacgatgaggctgtattattacngcagctnatangacagccaccanatcgtcttacggagtcgggacctacggtccgaccgttcctaggtccacgcccgaacggacccaacccctactcgtaccacgttccg

SEQ ID NO: 239939 - DNA, 571 bp, Homo sapiens
  misc_feature: GYAE6OF02GUHQE.9.81.H04.1.454.CMB.1.raw
  modified_base (225)..(225): a, c, t, g, unknown or other
  misc_feature (225)..(225): n is a, c, g, or t
  modified_base (302)..(302): a, c, t, g, unknown or other
  misc_feature (302)..(302): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggtgcttataactatgtctcctggtaccaacagcaccaggcaaacgtccccaaactcatgatttangagtcaataagcgcctcgtcgggtcctgatcgcttctctggctcaagtctggacaacgcgcctcctgaccgtctcgtcgggctccgaggctgacgagtcgaggtctagtatttagttactgcagtctacatagtcgacacggacccaacccaactaacgttcgttacgttacgggaagtacgggaccgtacggtaccgaacccggttcgtacgggtccaaccggacccgaacggaccccaaaccccgtcgtacgtacctaccttacccg

SEQ ID NO: 239940 - DNA, 515 bp, Homo sapiens
  misc_feature: GYAE6OF02G5B9S.9.81.H04.1.454.CMB.1.raw
  modified_base (237)..(237): a, c, t, g, unknown or other
  misc_feature (237)..(237): n is a, c, g, or t
  modified_base (396)..(396): a, c, t, g, unknown or other
  misc_feature (396)..(396): n is a, c, g, or t
  modified_base (436)..(436): a, c, t, g, unknown or other
  misc_feature (436)..(436): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggngcttataactatgtctcctggtaccaacagcaccaggcaaagtccccaaactcatgatttatgaggtcaataagcggaccctgtggggtccctgatcgcttctctggctcaagtctggcaacacggcctccctgaccgtctctgggctcgagctgacgntgagctgattattactgcagctcatatgacagccaccaanaactgtacttcggaagtcgggacctacggtcaccgtcctaggtcacgcccaacggcccaacccactcgtaccactcccg

SEQ ID NO: 239941 - DNA, 652 bp, Homo sapiens
  misc_feature: GYAE6OF02J1COU.9.81.H04.1.454.CMB.1.raw
  modified_base (119)..(119): a, c, t, g, unknown or other
  misc_feature (119)..(119): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
tcagtgatacgtctcacgaccggtgctcgatttagtagtgtagattcgcgggagctctgggagaggagccccagccctgagattcccaggtgtttccattcagtgatcagcactgaacnagagactcacatggagtggactgacctggtatttccgtttagggtaattttaaaaggtgtaccgagtgtgaacgtgacagtgtggtggacgtcgtgggggtacgtcgttggcgcgacgtcccgtggtacccnccccgttccgngaacgtccgttccgtccgtggttccgcccgttacctgtaaggtntcgtgttgttgactgtatcncgactgcgctggtcggcgtagtcctagggaaaggggtctcgtgggtacgtggtactacggtaggttacttagggtagtacggaacctnaaccccttaaggnggtactgtacgcggtccgtatcggttaggcgggtacgtcgtacgtaccactaccgtacgtacgaacgacgtaaccgaaccgtaaccgaactaccgtactatacgtacacgtaactaagtacgtagtcgtagtacgtaagtcgtagtacgtacgtacgttcgttacgtcgttaagtacgtaacgtaagaaggtaccgtaacgaccggtacggacgtacgagtacgg

SEQ ID NO: 239942 - DNA, 743 bp, Homo sapiens
  misc_feature: GYAE6OF02JXB4K.9.81.H04.1.454.CMB.1.raw
  modified_base (230)..(230): a, c, t, g, unknown or other
  misc_feature (230)..(230): n is a, c, g, or t
  modified_base (265)..(265): a, c, t, g, unknown or other
  misc_feature (265)..(265): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtnacattggtgtctataactatgtctcctgtaccaanactacccggacaaacgccccaaactcttaggtttactgtatcgtactaatcgttccggccctcgtaacggtacgtttcgtacgtactccgtcttctcgtcggccgtaccgtaacgttcgtcggtacctaccgtaccggtcccttccgtacgacccgtacgttccgttcgtcgggtacctccgacggtcgttacggaacggtacggacggtacgtagttaactttacgttcgtacggtactacggtactaaacgaaaactaaggtaccgtcgttccgttacgttaccgggtttacggggttttaccggggaccggggttaaccgaaacggttccggttaaccggtacccgttaccggttaccggtaccgtaaccgggtacccgtaaacgggttcccgtcccggtacccccggttaccggttaccgttacccgtcccggtttacccgtttaccccgtaccccgtttacccgttaacccgg

SEQ ID NO: 239943 - DNA, 642 bp, Homo sapiens
  misc_feature: GYAE6OF02JDHY0.9.81.H04.1.454.CMB.1.raw
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaaccngctagtgactgttggtntacttaataacttntcgttcctaccgtacggtaaccaacgacgaccaacccgaggacctaaaccgtaccccaaactcatagtatttagtagtagtacaaagtaacggccgtccctcgtcgggtccctagtactcgtcttcctcgtcgcctacgtacgtcgtacgacaaccgtccgtccctccgtacgtacccgtctcgtcggcctaccgacggtctacggacgtagtggacggtctagtaactttactacgtcgactagtcctactactagtcggaccacgaccctaacccaagtacgttcggttacgttacggaacggtccggacctaccggtaccgtaaccgtaccgtacggaccaccgacccgaaccgacccaacccgtcgtaccgtacctacctcg

SEQ ID NO: 239944 - DNA, 577 bp, Homo sapiens
  misc_feature: GYAE6OF02GU4TH.9.81.H04.1.454.CMB.1.raw
  modified_base (224)..(224): a, c, t, g, unknown or other
  misc_feature (224)..(224): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctctgcactggaaccngcagtgacattggtgcttataactatgtctcctggtaccaacagcacccaggcaaagtccccaaactcatgatttatgaggtcaataagcggccctcgtcggggtccctgatcgcttctctggctccaagtctggcaacacggcctccctcgaccgtctcgtgggcctccgaggctgacgatgacggctgattattactgcagctctatagtcgacgacggaccaacccaacgaattggtccttacgggaacgttcgggtacccgacggtccgtaacccggtaccgttacgggtaccacggaccccgtaacgggaccctaaacccccgaccgttacggtccctaccgttcccg

SEQ ID NO: 239945 - DNA, 524 bp, Homo sapiens
  misc_feature: GYAE6OF02FIMKU.9.81.H04.1.454.CMB.1.raw
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
  modified_base (385)..(385): a, c, t, g, unknown or other
  misc_feature (385)..(385): n is a, c, g, or t
  modified_base (447)..(447): a, c, t, g, unknown or other
  misc_feature (447)..(447): n is a, c, g, or t
  modified_base (466)..(466): a, c, t, g, unknown or other
  misc_feature (466)..(466): n is a, c, g, or t
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacaaggtcctgggcccagtctgccctgactcagcctccctccgcgtccgggtctcctggacagtcagtcaccatctcctgcgctggagccaccaatgacttttggtggtttttaattctgtgtcctggtaccaaaaacncccaaagcaaaagccccccaaaatccctcatttancagtccactaagcggccctcaggggtccctggtcgcttctctggctctaagtctgacgacacggcctccctgaccgtcnctgggctccaggctgaggatggaggctgattattactgccacctcatatgacaggctacggnagtcatgtgatagttcggngaggcaagctgaccgtctaagcagcccaaggctcgcccctggtccactctcgtccccg

SEQ ID NO: 239946 - DNA, 613 bp, Homo sapiens
  misc_feature: GYAE6OF02IEINU.9.81.H04.1.454.CMB.1.raw
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcgtcaccatctcctgcactggaaccngcagtgacagttggtntcttaataactatcgtctcctggtaccaacagcaccaggacaaacgtcccaaactcatgtatttatgaggtacaagtaacgccggtccctcgtcgggtccctagactcgtcttctcgtcgctcaagtctggacacgacgcctcctcgaccgtctcgtcggcctacgtacggcctaggacgtagtaggacggtcgtagtaactttacgtacttcgactacgtactacgaattagcgtcgtaacggaccctaacccgaacttaacgtttcgtcgttaacgggtaacggtcggaacccgtacggtcccgtaccggttaccgtacggtaccaccgaccgtaaccgaccccaaaccgtcgtacgtacccgcttacccg

SEQ ID NO: 239947 - DNA, 613 bp, Homo sapiens
  misc_feature: GYAE6OF02H17DD.9.81.H04.1.454.CMB.1.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
tcagtgatacgtctcacgaccggtgctcgatttagtagtgtagattcgcggggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcggtcaccatctcctgcactggaaccngcagtgacattggtgcttataactntgtctcctggtaccaacngcacccaggcaaacgtccccaaactcatgtatttatgagtcaataagccggccctcgtcggggtccctgactccgtcttctcgtgcctaccaagtcgtcggacaaccgaccggcccttcccgtacgacccgtctcgtcgggctccgaggctgacgatgagctgtatttattacgtcgcagctcattatcgacacggccaacccgagtaacttcggttaccgttacgggaacggttcgggtacccgtaccgggttccctaacccggttccgttacgggtaccgtaccggaccccgtaaccggaccccaaacccccgttagtacccgttaccgaccctttacccgg

SEQ ID NO: 239948 - DNA, 712 bp, Homo sapiens
  misc_feature: GYAE6OF02GOJ20.9.81.H04.1.454.CMB.1.raw
  modified_base (118)..(118): a, c, t, g, unknown or other
  misc_feature (118)..(118): n is a, c, g, or t
  modified_base (123)..(123): a, c, t, g, unknown or other
  misc_feature (123)..(123): n is a, c, g, or t
  modified_base (125)..(125): a, c, t, g, unknown or other
  misc_feature (125)..(125): n is a, c, g, or t
  modified_base (129)..(129): a, c, t, g, unknown or other
  misc_feature (129)..(129): n is a, c, g, or t
  modified_base (142)..(142): a, c, t, g, unknown or other
  misc_feature (142)..(142): n is a, c, g, or t
  modified_base (145)..(145): a, c, t, g, unknown or other
  misc_feature (145)..(145): n is a, c, g, or t
  modified_base (147)..(147): a, c, t, g, unknown or other
  misc_feature (147)..(147): n is a, c, g, or t
  modified_base (149)..(150): a, c, t, g, unknown or other
  misc_feature (149)..(150): n is a, c, g, or t
  modified_base (152)..(153): a, c, t, g, unknown or other
  misc_feature (152)..(153): n is a, c, g, or t
  modified_base (155)..(155): a, c, t, g, unknown or other
  misc_feature (155)..(155): n is a, c, g, or t
  modified_base (175)..(175): a, c, t, g, unknown or other
  misc_feature (175)..(175): n is a, c, g, or t
  modified_base (219)..(219): a, c, t, g, unknown or other
  misc_feature (219)..(219): n is a, c, g, or t
tcagtgatacgtctcacgaccggtgctcgatttagtagtgtagattcgcgggggggggtctcaggaggcagcgctctcaggacgtcaccaccatggcctgggctctgctccctctccncctcncnctgngcagcgtcgcgcngtncncnncnncncctccgcgcggtcgtctcgngactcggtcgtaccaactctcctcgcgacctacggtaccgaacngaccgtaggtacaacttggttgggtacttaacttaaactaaacgttggttccttcctacggttaaccgaaccaaacgcgaccccaacggacgaaaccgtaaacccctaaccctaactctagttaagtttaattttaggacggtaacgtaactaaaacggtaccgggccccgttcccgttggggttacccggttcctagtccgtccttccttcgttcggcgtcctaacgtacgttcggacggaacctaaccggcccgttccctacgaccgtaccttcgtaggccgtcctacgtcgcgacgacgtgacggacgttcgtagttaactttacgttcgacacgtaccgtctaacttaggtactcggacgaccgtacccaaacctaattagttccgttacggtaagacgggtaccgaccggtacgtaccgtacccggttagtaccgaccgaaccgtaacccgacccgtacccctaacgtcgtaccgtactccttcccgg

SEQ ID NO: 239949 - DNA, 596 bp, Homo sapiens
  misc_feature: GYAE6OF02HKPWJ.9.81.H04.1.454.CMB.1.raw
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatcctcctgcactggaaccagcagtgactagttggtgcttaataactatcgtctcctggtaccaacagccacccaggacaaacgtaccccaaactcactctatttatgaggtcaacgtaacgccggccctcgtacggggtttctacttccgtcttctcgtggtcctccgtaagtctagaacaacgaccggtccctccctcgaactaactcctcgtcgggcctaccgaggtctaggacggacgaggtctagtatttacttactgctgtctactatatgactagtcgtggtacacgtaccgtccgtggttacgttcgggcgggacggaccgtaacggtcgaccgtcgttagaccgacgaccgacggccgtaccggccccgttcgtacctccg

SEQ ID NO: 239950 - DNA, 653 bp, Homo sapiens
  misc_feature: GYAE6OF02GMTAK.9.81.H04.1.454.CMB.1.raw
  modified_base (326)..(326): a, c, t, g, unknown or other
  misc_feature (326)..(326): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcggtcaccatctcctgccactggaaccagcaagtcgaactagttggtgtactttaataactatcgtctccgtaggtaaccaacagaccaacccgaggacaaacgtccccaaactcattagtattttagnggacggtacaaagtaacggccggccctggttaccggggtccctagtacttccgtctttcgtctcggtacctacgtaagtccgtgaccaacgaccggtccctcccgtgaccgtctcgtcgggcctccggagtcgtaggacgtagtgtacgggtctagttaactttacgttaacgtcgtacgtaacgtcctactagttacgtcgacgtaccggacccacccgtaacagttctacgttacgggtaagtccgggtaccgtaacgtccgtacccgtaccgtacggtccaacggacccgacggacccctaccgaccgtcgtccgtacttcccg

SEQ ID NO: 239951 - DNA, 680 bp, Homo sapiens
  misc_feature: GYAE6OF02J1NZR.9.81.H04.1.454.CMB.1.raw
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (246)..(246): a, c, t, g, unknown or other
  misc_feature (246)..(246): n is a, c, g, or t
  modified_base (317)..(317): a, c, t, g, unknown or other
  misc_feature (317)..(317): n is a, c, g, or t
tcagtgatacgtctcacgaccggtgctcgatttagtagtgtagattcgcgggggggggtcgtcgaggaggcagcgctctcaggacgtcaccaccatggcctgggctctgctcctcctcaccctcctcactcaggcacagggtcctgggcccaggtctgccctgacctcagcctccctccgcgtccgggtctccgtggacngtcggtcaccatctccngcactggaaccagcagtgactagttggtncctttaataacctattcgtcttcctggtaccaacacgccaccaggacaaacgtcccaaactcatcgattangagtacaataacgcggccctagtcgggtcccttgacttcgcttctcgtagccgttacacgtcgtcgacaaaccgccggcctacccgtcgacctccgtacgtcggcctccgacggtcgtcggaccgtatccgggaagttcgtcgtatttaacgttactacggacgtacgcctttacacttagtcgtaaccggtacgggacctaacccgaacgttacgttaccgtttaccggttacgggaaacgggttaccggggacccgttacgggtaaccccgttaccggtaccgttacgggacccttaaccggtacccccgaacgggtaccccctaaaacccctggttaacccgtcgtaccccgtttacccg

SEQ ID NO: 239952 - DNA, 633 bp, Homo sapiens
  misc_feature: GYAE6OF02IZV9Y.9.81.H04.1.454.CMB.1.raw
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (499)..(499): a, c, t, g, unknown or other
  misc_feature (499)..(499): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcggtcaccatctcctgcactggaaccngcagtgactattggtncttaataactatgtctcctggtaccaacagccaccgaggacaaacgtacccccaaactcatgtatttatgaggtacaaagtaacgccggccctcgtcggggtccctgactcgtacttctcgtcgtctacctaagtcgtaggaccaacgtaccggtcccttccctcggtacccgttcgtcgtcgggtcctcccgaggcgtggaacgtagtaggacggtctagtaatttacgttacgtcgactacgtcttacagttacncgacgacgaccaccctactacgttcgttacgttacggaaggtaccggaccgtacggtaccgtacccggttccgtacggtaccgaccggacccgaaccgaccccgtaacccctacgtccgtacctaccgttcccg

SEQ ID NO: 239953 - DNA, 628 bp, Homo sapiens
  misc_feature: GYAE6OF02F7M6W.9.81.H04.1.454.CMB.1.raw
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
  modified_base (364)..(364): a, c, t, g, unknown or other
  misc_feature (364)..(364): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaaccngcagtgacattggtncttaataactatgtctcctggtaccaacagccaccaggacaaacgtccccaaactcatgtatttatggaggtcaataacgcggccctcgtcgggtccctgatcgtcttctctggctcaagtcngcaacgcgcctccgtgaccgtctcgtcgggcctcccgagggtcctggaccgtagtggacggtctaggtatttacgttactgacacgtctactattacgtcgacgacggacccaacccgtactaacgttcggtaccgtttaacggggaacggttccgggacccgtaccgggtacccgttaacccgggttacccgttaagggtcccaaccgggtacccctaacgggaccccctaaaccccgtacgtccgtaccgtacccgttcccg

SEQ ID NO: 239954 - DNA, 590 bp, Homo sapiens
  misc_feature: GYAE6OF02GVZ56.9.81.H04.1.454.CMB.1.raw
  modified_base (236)..(236): a, c, t, g, unknown or other
  misc_feature (236)..(236): n is a, c, g, or t
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggngcttaataactatgtctcctggtaccaacagcaccaggcaaacgtccccaaactcatgatttatgaggtcaataagcggccctcgtcggggtcctgatcgcttctcgtgtctcagtctcggacaacacgcctccctgaccgtctcgtcggctccgaggctcgacgactggacggctagtatttaacttactgctagctctacgtatcgtaccacggaccaacccgtaacgaacgttcgtaccgtttacggaacggttacgggaccgtaccgggttccgaacccggttaccgtaacgggtccaacggaccccgaaacggtccccaaaccccgtaccgtcggtacctaccttcccg

SEQ ID NO: 239955 - DNA, 530 bp, Homo sapiens
  misc_feature: GYAE6OF02GTQIO.9.81.H04.1.454.CMB.1.raw
  modified_base (224)..(224): a, c, t, g, unknown or other
  misc_feature (224)..(224): n is a, c, g, or t
  modified_base (293)..(293): a, c, t, g, unknown or other
  misc_feature (293)..(293): n is a, c, g, or t
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggtgcttaataactatgtctcctggtaccaacagcacccaggcaaagtccccaaactnacccctgatttatgaggtcaataagcggccctcgtggggtccctgatcgcttctctggctcaagtctggcaacacggcctccctgaccgtctctggggctccaggctgacgatgaggctgattattactgcagctcatgtgcgtaggccacccacaactgtacgttcggaagtcgggaccgacggtcaccggtcctagggtccacgacccacggcccaaccccagtcgtcactcccg

SEQ ID NO: 239956 - DNA, 732 bp, Homo sapiens
  misc_feature: GYAE6OF02JKIDS.9.81.H04.1.454.CMB.1.raw
  modified_base (441)..(441): a, c, t, g, unknown or other
  misc_feature (441)..(441): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcgagggcacgagggtcctgggcccaggtctcgccctgactcacgccctccctccgcggtccgggtctccgtggacaggtcggtcacatccgtcctcgcactacggaaccaggcaggtgaactgttggtcgtacttaagtaactagttcgtcttccgtaggtaaccaacgacgaccaacccgaggtaaccaaaccgtaccccaaaacgttccgaagttggtaattttacgaggtaacgggtaacaaagtacggccggttccgtacggttccggggtcctaggtactcggtcttcgtcgtcgctacgtacgtcgngacaactccggcctccgtacggtacctcgtcggtacgggtacgtccgtacggcgtaacggacggtacgttacggacgtacgttagtacgtttaacgttaacgtcggtactacgtctacgagttacgacgactaccggacctaaccgtacgttaacgttcgttaccggtaacgggtaacgggttaccggaccggtaccggttaacccgtaaccgggttaccgttaacggtaaccgaccgtaacccggacgtaccccgtaaccctaccggtacgttaccctaccggttacccg

SEQ ID NO: 239957 - DNA, 519 bp, Homo sapiens
  misc_feature: GYAE6OF02GFNIF.9.81.H04.1.454.CMB.1.raw
  modified_base (421)..(421): a, c, t, g, unknown or other
  misc_feature (421)..(421): n is a, c, g, or t
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcaccaggcaaagtccccaaactcatgatttatgaggtcaataagcggccctctggggtccctgaatcgcttctctggctccaagtctggcaacacggccctaccctgacccgtctcgtgggactccgaggtctgacgatgaggctgattattacngcagctcatatgcaggccaaccacaatgtcgttacgagtcggacacggtccgacgtcctaggtcacgtcccgaaggcccaacccgctcgtccactccg

SEQ ID NO: 239958 - DNA, 650 bp, Homo sapiens
  misc_feature: GYAE6OF02FYWRJ.9.81.H04.1.454.CMB.1.raw
  modified_base (226)..(226): a, c, t, g, unknown or other
  misc_feature (226)..(226): n is a, c, g, or t
tcagtgatacgtctcacgaccggtgctcgatttagtagtgtagattcgcggggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggtgcttataactatgtctcctggtaccaacagcaccgaggacaaacgtccccaaactcatgtatttatgagtcaataagcggcctcgtcgggtccctgactcgcttctcgtggctaccaagtctggacaacgaccggccctccctcggacccgttctcgtcggggtcctaccgagggccttaggaaccgtagttacgggacgggtcctttaggtaacttttacgtttaaccgtggtacctacggtccttacgaacttagttacggacgtaacggtacccaaccccaagttaaacgttcgttaccgtttaacgggaacggttacggggaccctacgggtacctacccggttacgtacggtaccgaccgtacccgaacggtaccccaaacccgtctacggtcctaaccttcccg

SEQ ID NO: 239959 - DNA, 722 bp, Homo sapiens
  misc_feature: GYAE6OF02FOBUC.9.81.H04.1.454.CMB.1.raw
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (314)..(314): a, c, t, g, unknown or other
  misc_feature (314)..(314): n is a, c, g, or t
tcagtgatacgtctcacgaccggtgctcgatttagtagtgtagattcgcggggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacaggtcggtcaccatcctcctgcactcggaaccngcagtgacagttggncttaataactatgtctcctggtaccaacagccacccgaggaccaaacgtccccaaactcatgtatttagngtaggtacaaagtacggccgtccctcgtcggggtccctggacttcgcttctcgtcggtctaccgtaacgtcgtacggactaaaccgccggtcccttcccgtacggtacccgtttcctcggtcggggtccttacccggacggtccgtaacgtacggtaagtcggtacggtcgttaggtaactttacgttacgcgtactacgtctaacgtattacgtacggaccgtacgggtaccccaaacccgtaacgttaacggtttccggttacggtttaaaccggggacgggttaccggggtacccgaccgggttacccgtaaccccgggttcggtaacgggtacccgtaccggaaccccggtaaccgggacccctaaaccccgttacggtaccgttacccctaccgtttccccgg

SEQ ID NO: 239960 - DNA, 564 bp, Homo sapiens
  misc_feature: GYAE6OF02GPU2E.9.81.H04.1.454.CMB.1.raw
  modified_base (241)..(241): a, c, t, g, unknown or other
  misc_feature (241)..(241): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacatttggtncttataactatgtctcctggtaccaacagcaccaggacaaacgtcccaaactcatgatttatgaggtacaataagccgcctcgtcggggtccctgactcgcttctctggctcaagtctggcaacacgcctcccgtcgaccgtctcgtcgggcctccgaggcgtcgacgagtggacggctgtattattacgtgctagctcattagtgccgagccacccaataacgttcgttacgttacggaaggtacggaccgacggtccgtaacccgttcgtacggtacaccggaccgaacggccccaacccgtacgtacgtccacgttcccg

SEQ ID NO: 239961 - DNA, 708 bp, Homo sapiens
  misc_feature: GYAE6OF02F7ADH.9.81.H04.1.454.CMB.1.raw
  modified_base (295)..(295): a, c, t, g, unknown or other
  misc_feature (295)..(295): n is a, c, g, or t
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttccttttgggtattttaaaggtgtccagtgtgaagtgcagctggtggagtcgtggggggagcttggtgcagcctggccaccctcccgtgacgactctcctgtcgccgcctctggtattcattgttgatgtatttangaccagtcgcacgttcggggtaccgacgtaacggttccggaagggggtaacgggtccgtaggggtacgggttcggggtacctcggtaagggtttactttaacggttggggaacgttacggacctaaccgtaacccgagtaacggtcttaaggtcggacggtacctttgtagggtacggacgggggtccgtacgttccgaacctacgttcctaccgaacgtacgaacaaccgacgaaaccgtaaccgtaccctaatactactacgaactaaagtgtaaacgttgggtcttaacggtaggtaagttacgggagtaaccgtcggttaccgtttagttaactttacgttaggtaacgtaacgtaaaacggtacggtaacccggaaacccggtagggtaccgggtacgtacgtacggg

SEQ ID NO: 239962 - DNA, 710 bp, Homo sapiens
  misc_feature: GYAE6OF02HLJGZ.9.81.H04.1.454.CMB.1.raw
  modified_base (308)..(308): a, c, t, g, unknown or other
  misc_feature (308)..(308): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtcctccgtggtaccaacagccacccaggacaaacgtccccaaactcatgtaattanaggagtacaagtacgccggtcctcgtcggggtccctgacttcgcttctctcggcctacgaagttccgtacggacaaccgtacccggtcccttacccgtcggtacccgtcttaccggtcgggtcctaccggtaggtccgtacggaacgtacgtggacggttctagttaactttaacttacgttgacctaggtccttacaacttcggacgtacgaccgtacccaaaccgtaaccgttacgttcggttacggttaacggggtaacgggttccgggaaccgttacccggttacccggttaacccgggttaccggttaacgggttacccaaccccgggtaacccgtaaccccgggtaaccccaaaccccggttaccgtttcccggttacccgtacccgtttccccgg

SEQ ID NO: 239963 - DNA, 621 bp, Homo sapiens
  misc_feature: GYAE6OF02HLJPS.9.81.H04.1.454.CMB.1.raw
  modified_base (225)..(225): a, c, t, g, unknown or other
  misc_feature (225)..(225): n is a, c, g, or t
  modified_base (482)..(482): a, c, t, g, unknown or other
  misc_feature (482)..(482): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctgcctccgtgtctgggtctcctggacagtcgatcaccatctcctgcactggaaccngcagtgacgttggtggttctgactctgtctcctggtaccaacagcacccaggacaaacgacccccaaaactcatactatttactgacggtcaactaagccggccctgtaggggtttctattcgtcttctctggtctccaacgttctacgacaacgacgcctccctagaacaatccttcgtcgggctccaggcgtaggacgacggaggctagtatttatttacgtgtctgcctatatagtacacgagaggttaggtanaccgtccgtacccgttagggtaacggttccgggacgggtacggggaacccgtaaggggttaccggaacccggttaccggtacggttaccgaaccgggacccgtaacgggtcccgttacccggtccccccggttaccggg

SEQ ID NO: 239964 - DNA, 615 bp, Homo sapiens
  misc_feature: GYAE6OF02HZ3GE.9.81.H04.1.454.CMB.1.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtctgggggagcttggtgcagcctggcacctccctgagactctcctgcgccgcctcgtggattcatgtttgatgattatgccatgctagtcgggtccggataaggttccgaaggggaacggccgtagggaggtgggtctgaaggttattacgttggagtaagcctaactaccaacgaggctaagtcggacggacttcgtggtggacggggaccgtaacgttcaacccgtacttccacctaaggacgtaaacgaaccgacccgaaacgaaccttacccgtaataactacctacgactaaaatgaaacgttaggtactaggacgtaagttgaaggacgacggtcttaggtattacgtagtacgaacgtaaaagtacgtaacggaaacccgtaggtacggacgcgtaacgg

SEQ ID NO: 239965 - DNA, 621 bp, Homo sapiens
  misc_feature: GYAE6OF02GR6VW.9.81.H04.1.454.CMB.1.raw
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (318)..(318): a, c, t, g, unknown or other
  misc_feature (318)..(318): n is a, c, g, or t
  modified_base (474)..(474): a, c, t, g, unknown or other
  misc_feature (474)..(474): n is a, c, g, or t
tcagtgatacgtctcacgaccggtgctcgatttagtagtgtagattcgcggggggggggtctcaggaggcagcgctctcaggacgtcaccaccatggcctgggctctgctcctcctcaccctcctcactcagggcacagggtcctgggcccagtctgccctgactcacgcctccctccgcggtccgggtctccgtggacaggtcggtcaccatcctcctgcactggaaccngcagtgactagttggtnactttaanaactnttcgtctccgtcggtaaccaacacgccacccgagacaaacgtaccccaaactcagtntaagttatgtacgtacaataacggccggcctcgtcgggtcctgactcgtctcgtctgctacagtctcgacacgcgtcctccgtcgtaccgtctcggtcggcctaccgaggtctcgagtagtggacgtctagttaacttagttacgtacgcagtctnaacgttcgcgacgtacggaccctaacctaacgtaacgttcgttaacggtacgggtacgtaccgggtaccgtaccgtccgtaccggtcctaacggacctaccgaccgaacccggtacccaacccgttacgtcctacgcccttacccgg

SEQ ID NO: 239966 - DNA, 759 bp, Homo sapiens
  misc_feature: GYAE6OF02FFQBU.9.81.H04.1.454.CMB.1.raw
  modified_base (209)..(209): a, c, t, g, unknown or other
  misc_feature (209)..(209): n is a, c, g, or t
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (339)..(339): a, c, t, g, unknown or other
  misc_feature (339)..(339): n is a, c, g, or t
tcagtgatacgtctcacgaccggtgctcgatttagtagtgtagattcgcgggggggggtctcaggaggcagcgctctcaggacgtcaccaccatggcctggctctgctcctcctcaccctcctcactcgagggcacgagggtcctgggcccagtctgccctgactcacgccctccctcgcgtccgggtctcctggacaggtcgtcaccntcctcctgcactcggaaccngcagtgactagttgggtcncttaataccttatcggtcctccgtaggtaaccaacgtcggaccaacccgaggaccaaaccggtcccccaaactcagttacgtattttacgnggtagttacaaacgttacggccggtccccgttaggtcggggttaccccaggtaacttccggtacctttcgcgttacgggccttaccgtaacggttccgtacgggacctaaccgaccggtcccttacccggtacggtacccgttctcgggttacggggtcccttcggacggttccgtaacggacgtaaggtcgggaacggttccgttaagttactttaacgttaccgtcgaccgtacgttacctagtacgtacggtacgaccggtaccggaacccttaaccgaacgttacggtcgtttaccggttacgggaccgggtaccgggtacccgtaccggtccgtaaccggttcccggtaacggtaccgaccgtaacccgtaccggtacccctaaaccgtccgtaccttaccgtaccgtttacccg

SEQ ID NO: 239967 - DNA, 644 bp, Homo sapiens
  misc_feature: GYAE6OF02IIPG6.9.81.H04.1.454.CMB.1.raw
  modified_base (402)..(402): a, c, t, g, unknown or other
  misc_feature (402)..(402): n is a, c, g, or t
  modified_base (465)..(465): a, c, t, g, unknown or other
  misc_feature (465)..(465): n is a, c, g, or t
tcagtgatacgtctcacgaccggtgctcgatttagtagtgtagattcgcggggggggggtctcaggaggcagcgctctcaggacgtcaccaccatggcctgggctctgctcctcctcaccctcctcactcagggcacgagggtcctgggcccagtctgccctgactcagcctccctccgcgtccgggtctcctggacagtcggtcaccatctcctgcactggaaccagcagtgactagttcggtgctttaataacgttatgtctcctggtaaccaacagccacccaggacaaacgtacccccaaactcaatcgtaatttagtgaggtcaaagtaaacgccggaccctcgtcggggtcccttgactcgcttctctggctcaagtctgactaacgacgcctccncgacgtctcgtggcctcgaggctagacgatcgagctagtattacttacgtagctacgtcctanaattacgcggactacgggaccctaacccgaacttaaacgtcggttacgttaccggggtaaaggttccggggaaccctaccgggtaccctaacccggttaccggttacggtaaccgacccgtaacccggaaccggtaccccaaacccccgtcggtaaccgttccctaaccgttaccccgg

SEQ ID NO: 239968 - DNA, 541 bp, Homo sapiens
  misc_feature: GYAE6OF02FMY7N.9.81.H04.1.454.CMB.1.raw
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (305)..(305): a, c, t, g, unknown or other
  misc_feature (305)..(305): n is a, c, g, or t
  modified_base (444)..(444): a, c, t, g, unknown or other
  misc_feature (444)..(444): n is a, c, g, or t
  modified_base (483)..(483): a, c, t, g, unknown or other
  misc_feature (483)..(483): n is a, c, g, or t
  modified_base (526)..(526): a, c, t, g, unknown or other
  misc_feature (526)..(526): n is a, c, g, or t
tcagtgatacgtctcacgaccggtgctcgatttagtagtgtagattcgcgggggggggtctcaggaggcagcgctctcaggacgtccaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgtcttataactntnttctcctggtaccaacagcacccaggcaaacgtcccaaactcatgatttangagtcaataagcgccctctggggtccctagatcgcttctctgctccaagtctggacaacacggtcctccctgacccgttctcgtcgggcctccgaggctagaccgatgacggcttgatttattactgacagctcattangacagccaacccactatcgttcgtaggaagtcggaccgnggtcaccgtaccgtaacggtcacgcccgaaggcccaacccctntacgtccacttcccg

SEQ ID NO: 239969 - DNA, 723 bp, Homo sapiens
  misc_feature: GYAE6OF02GD9L0.9.81.H04.1.454.CMB.1.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaggtgtccagtgtgaagtgcagctggtggagtcgtgggggagcttgggtgcaggcctggccacctccctgacgactctcctgtcgcccgcctctggattcattgttgatgtattagtgcctatgcacgtcggggtcccgataaggttccgaaggggaacgggtcctagggacggtgggtcctacgaggttattacggttggaagtacggacctaacgttaacccgaacgaggtaccttaagtcgggtaccggtaacctttcgtaggtacgggaacgggggtcccgtaacgtttaccgaaccctacgttccgtacccgaaggtaaccggaacccgtaaaccggaaccctaaacggtaacccttaccccttaaatacgttaccgtacgtaaccaaaacgttggtaaacgttgggtacctaggtaaggtaggttcggaaacgggtacctaccgggttcctttaggttaacgttaccgttaggtaccgtaaacgtaaaacggtagtaacccgggaaaccccggtagggtaccggtaccgtacgtaaccggg

SEQ ID NO: 239970 - DNA, 558 bp, Homo sapiens
  misc_feature: GYAE6OF02G140S.9.81.H04.1.454.CMB.1.raw
  modified_base (225)..(225): a, c, t, g, unknown or other
  misc_feature (225)..(225): n is a, c, g, or t
  modified_base (301)..(301): a, c, t, g, unknown or other
  misc_feature (301)..(301): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggtgcttataactatgtctctggtaccaacagccaccaggcaaacgtccccaaactcatgattangagtcaatagcgcctgtcgggtcctgatcgcttctctgctcagtctggcaacgacgcctccgtgacctctcgtggctcgagctgacgatgagctagtattattactgcagctacatacgtgacgacggaccacccaagtaacttcggttacgttaacgggaaggttccgggacccgtacggtaccgtacccgttaccgtacggtaccaccggacccgaaccggaccccaacccgtaccgtacgtcctaccgttcccg

SEQ ID NO: 239971 - DNA, 744 bp, Homo sapiens
  misc_feature: GYAE6OF02G61CS.9.81.H04.1.454.CMB.1.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaggtgtccagtgtgaagtgcagctggtggagtcgtgggggagcgttggtgcagcctggcacctcctgacgactctcctgtcgccgcctctggacttcattgtttgattgtatttagtcgtacctagtcggacctaccggttggggtcccggacgtaaacggttcccgaaggggggaacgggtcccggttggggaacgggttcgggggttacccttacgggtaagggttttaacgtttaccggtttggggtaacgttacggacctaacccgttaacccgaacgtacgggtccttaagtcgggtacccggactttcggtggtacgggacgggggtaccctaacgtttcccgaccgtaactcccgtacccgaacggacgaacccgaaccgtaacccgaaacgtaccccttacccttaatacctacctgtaaacaacgttacgtacgttcggtactaggtaaggtagttaacggaacggtaccgacgggttcctttaggtaactttacgtaggtaacgaacgtaaaacggacgtaaacccggaacccggttagggacggtaccggatacggg

SEQ ID NO: 239972 - DNA, 770 bp, Homo sapiens
  misc_feature: GYAE6OF02HHWUX.9.81.H04.1.454.CMB.1.raw
  modified_base (212)..(212): a, c, t, g, unknown or other
  misc_feature (212)..(212): n is a, c, g, or t
  modified_base (265)..(265): a, c, t, g, unknown or other
  misc_feature (265)..(265): n is a, c, g, or t
  modified_base (283)..(283): a, c, t, g, unknown or other
  misc_feature (283)..(283): n is a, c, g, or t
  modified_base (299)..(299): a, c, t, g, unknown or other
  misc_feature (299)..(299): n is a, c, g, or t
  modified_base (322)..(322): a, c, t, g, unknown or other
  misc_feature (322)..(322): n is a, c, g, or t
tcagtgatacgtctcacgaccggtgctcgatttagtagtgtagattcgcgggcagcaagatggtgttgcagacccaggtcttcatttctctgttgctctggatctctggtgcctacggggacatcgtgatgacccagtcgtccagactccctggctgtgtctctgggcgagagggccacatcaactgactaagtccagccagagttgtttanacggctaccggacaacaagacttactagtcttggtactcgagcaagaaaccgngacagcctactaaacgtnactactacgttaacgngggtaccacttccgtacccgggntaacgggtccccgggtacctggtacccgtagtttccgaggtcggtaccacgggttccggggtactccggggacctacggttaactttccgaactttccgtacaacccgtataccgacggtacctaccggtccgtaggaccgtaacgggtctaacgggtaaacgtcggttacggtacgtaacgtttacgttttaacgttaccgtacgggttacctttaaacggtttaccggttttccgggtaaccgggttaccgtttaccgggtaaaccgggttaaccgggtaaccggtttaaacggggtacgtaaaaccggtttaacgaaaccggttacgttcgggtacgtccgtacggaccgttaaccgttacgttcggttacccgttcgtaaccgtttaccgtacccggtttacccacggtttaccgtacggtaacggtaccgttacgttaaccgg

SEQ ID NO: 239973 - DNA, 774 bp, Homo sapiens
  misc_feature: GYAE6OF02JZ9V6.9.81.H04.1.454.CMB.1.raw
  modified_base (224)..(224): a, c, t, g, unknown or other
  misc_feature (224)..(224): n is a, c, g, or t
  modified_base (712)..(712): a, c, t, g, unknown or other
  misc_feature (712)..(712): n is a, c, g, or t
tcagtgatacgtctcacgaccggtgctcgatttagtagtgtagattcgcgggggggggtcgtcgaggaggcagcgctctcaggacgtcaccaccatggcctgggctctgctcctcctcaccctcctcactcaggcacagggtcctgggcccagtctgccctgactcagcctccctccgcgtccgggtctcctggacagtcgtcaccatctctgcactggaaccngcagtgacagttggtacgctttaataactatggtcccttccgtacggtaaccaacgacgtaccaacccggaggaacctaaaccggttaccccccaaaacttcgaattcgtaaattttcgaggtaacggttataaaaggttaacggcccgtccccgttaccggttacgggggtaccccttagacgttccgtccttccgttccgtcgggtacctttcgaaacggtttcacgggtacctaaccgtaccgggtcccttccgtacgtaccccgtcgttccggtaggggtccttaccgggaacgttacgtcggaaccggtagtagggacgtccgttagtaaagtttaccttagttaacccggcttcgccttacgtactaagggttccgaacgaccggtacccaaaccgtaacgtttacgtttacccggtaaggtaccgggaggtttaaccccgggccttaaccgggtcctaaacccgggttcgtaaccgggtanaaccccggacccggtaaccaaccccgaacccgtttacggacgtttacacccccgttttaccg

SEQ ID NO: 239974 - DNA, 782 bp, Homo sapiens
  misc_feature: GYAE6OF02HG52W.9.81.H04.1.454.CMB.1.raw
  modified_base (197)..(197): a, c, t, g, unknown or other
  misc_feature (197)..(197): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggctacagggtcctgggcccagtctgccctgactcagcctccctcgcgtccgggtctccgtggacngtcgtcaccatcctcgtgcactgggaaccagcgagtgacctagttggtagtcttaataacttatgtacctaccgttaggtaacccaaacgtacgacctaacccacggtacgaaaaccgtaccccctaaaactactaattacggtaattttagagggtaacgtactaaaggtaaccggtcccgggaccctttacggttaccgggggttacccctaacggggtaacttcccggttacgtttccctacggttcgggtacctttaacccggtacggtttcccgtacggtaacccgttaacccgacccggtccccttacccgttacggttaaccccggttcgttccggtacggggtcctcccggaacggtacgtacggacgtaggtcgacggtacctagttaattacgttacgtacgactacgactactacgtagttacgaccgtacgggtacccaaccgtaacgtaacgttcgttacggttacgggtaccgggtacgggacccgtacggtaccgtaccggttacctaccggtactaccggacccgtaacggaccccgtaacccgtacgtccggtacttcccgtacccgg

SEQ ID NO: 239975 - DNA, 834 bp, Homo sapiens
  misc_feature: GYAE6OF02IBD1R.9.81.H04.1.454.CMB.1.raw
  modified_base (219)..(219): a, c, t, g, unknown or other
  misc_feature (219)..(219): n is a, c, g, or t
  modified_base (261)..(261): a, c, t, g, unknown or other
  misc_feature (261)..(261): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacgacgggtcctcgggcccagtctcgccctgactcacgtccctccctccgcgtcccgggtctccgtggacacgtcgtaccaaccnctcctcctgacacgtacggaaccagcgagtgactagttggtntacttaataactagtcgtccttccgtacggtaaacctaacgacgacccgaacccgaacggaacctaaaaccccggtaaccccctaaaacttcccgtaaattcgtaagttttacgtaacggttaacggtaacctaaaacgtaaccggtaccggtaccccgttcgggtaccggggttccccttggtaccgttccggttcctttccgtccgtacggtcccgttaaccaacggttccggtaacgacctaacccggacccggttcccccttacccgttacggtacccgttccgttcggttacccgggtcccgtccggtacggttaccgtacggtaacggtcgtgggttaaccggtcgttaacttacggttacttaacgtcgtccgtacggtcctagtcgttaacgtcgaaccggaaccgtaccaacccgtaacgttaacgttcggtttaccggtaacgggtaccgggttaccgggaccgttacccgtacccgtacccggttaacgtaccgttaccggaccccgaaccggaaccccgtaacccgtacccgtaacgtttcccgtaacctccccgttcccg

SEQ ID NO: 239976 - DNA, 757 bp, Homo sapiens
  misc_feature: GYAE6OF02FZO3X.9.81.H04.1.454.CMB.1.raw
  modified_base (245)..(245): a, c, t, g, unknown or other
  misc_feature (245)..(245): n is a, c, g, or t
tcagtgatacgtctcacgaccggtgctcgatttagtagtgtagattcgcggggggggggtctcaggaggcagcgctctcaggacgtcaccaccatggcctgggctctgctcctcctcaccctcctcactcagggcacgagggtcctgggcccagtctgccctgactcagcctccctccgcgtccgggtctccgtggacagtcggtcaccatctcctgcactggaaccagcagtgactagtttggngtctttaataaactattcgttccttccgttacggtaacccaaacacgaccaaccccgaaggaaccaaaaccgtaccccccaaaactcaacttagtaattttagtaggtaacggtacaaagtaaacggccggtccccgttcggttcggggttccccttaggacttccgtctttcctcgttcggcctaccaagttcgtacggaccaacgaccgtccctcccgttacgtacccgttcctacggtcgggcctaccgacgggtctacggacgtacgtaggacggtcttaggtaacttttaacgttacgtcgacgtaacgtcttactagttacgtcgaccgaccggacccaacccgtaagtaaattccggttacgttaacggggtaacggtaccgggtacccgtaaccggttcccgtaacccgggttaccgttaacgggtcccgtaacccggtaacccggtaacccggtaacccccgtaaacccccgttacggtaccgtacccgtaccctttccccgg

SEQ ID NO: 239977 - DNA, 661 bp, Homo sapiens
  misc_feature: GYAE6OF02FZED7.9.81.H04.1.454.CMB.1.raw
  modified_base (226)..(226): a, c, t, g, unknown or other
  misc_feature (226)..(226): n is a, c, g, or t
tcagtgatacgtctcacgaccggtgctcgatttagtagtgtagattcgcggggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgactattggtgactttaataaactatgtcctcctacggtaccaacagccaacccaggaccaaacgtcccccaaactcaatagtatttatggaaggtacaaagtaacggccggtccctcgtcggggtccctagtactcgtcttcgtctcggccttaccaagttcgtacggacctaaaccgaccgggtcccttccccgtaggtaccccgttctcggtcgggcctccgacggtctacggacgtagtggaggtcttagtaagtttaacttaccgtagtcgtacgtcctatacttagtcggacgaccggtacccaacccgaattaacgtgttaccgttacggaacggtcggacccgtacggtaccaccggttactacggtaccaccggaccctaaccggacccctaacccgtacgtaccgtacctaccgttcccg

SEQ ID NO: 239978 - DNA, 654 bp, Homo sapiens
  misc_feature: GYAE6OF02GJIII.9.81.H04.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagccctccctccgcggtccggtctcctggacngtcgtcaccatctcctgcactggaaccngcagtgactagttggtctacttaataactagtgtcctcctaggtaccaacacgaccaccgaggaccaaacgtacccccaaactcatagtatttagagtaggtacaagtaacgccggtccctcgtcgggtcctgtactcgtcttctcgtgctacacgtcgtgacacgcgcctccgtacgcccgttcgtcgtcggcctccgacggtctaggacgtgtacggagtcttagttaatttacttaacgtcgactacgtcttactaagttagtcgtaccgtttacggttttccgtttcccttacgtttacgtaaagttacgtttacggttccggggacgggaacggttaccgtacgggttaccttaccggtacccggttcgtaggtaccgtaccgaccgtaacccggtacggtcccgtccccggtccccgttccgg

SEQ ID NO: 239979 - DNA, 665 bp, Homo sapiens
  misc_feature: GYAE6OF02GFHUX.9.81.H04.1.454.CMB.1.raw
tcagtgatacgtctcacgaccggtgctcgatttagtagtgtagattcgcggggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttaataactatgtctcctcggtaaccaacagccaacccgaggacaaacgtaccccaaactcatagtatttatagaggtacaagtaacgccggcctcgtcgggtcctgactcgtcttctcgtcggacctaccgaagttcgtacggacaacgaccggtcccttccgtacgacccgttcgtcgtcgggtccctccgaggtccgtaggaaccgtagtggacgtacgttagtaattttacgtacgtcgactacgccttactaagttacgtacggtaccgaaccggtcccaacccgtaactaagtttccggtacggttaacggtaacgggtaccgggacccgtacgggttaccctaaccggttaccgtacggtacccgaaccggacccgtaaccggaccctaacccgtactcgtacctaccgttccccg

SEQ ID NO: 239980 - DNA, 682 bp, Homo sapiens
  misc_feature: GYAE6OF02HQG87.9.81.H04.1.454.CMB.1.raw
  modified_base (226)..(226): a, c, t, g, unknown or other
  misc_feature (226)..(226): n is a, c, g, or t
tcagtgatacgtctcacgaccggtgctcgatttagtagtgtagattcgcggggggggggtctcaggaggcagcgctctcaggacgtcaccaccatggcctggactctgctcctcctcaccctcctcactcagggcacagggtcctgggcccagtctgccctgactcagcctccctccgcgtccgggtctcctggacagtcggtcaccatctcctgcactggaaccngcagtgacattggtgcttaataactatgtctccgtggtaaccaacagaccacccgaggacaaaacgtcccccaaactcatatatttaatggaaggtactaaataacggccggtacccctcgtcggggtaccctgtactcgtacttctctcggcctaccaacgtcgtcggtacaacgtaccggtcccttccgtcgtacccgtctcgtcgggcctacccgacggtcgtcgacgagttgaacgggtcttagtaactttacttacgtacgaccgtagtcctaaccagttaacgtggacccgtacggacccaaccctaataacgttcggtaccgttaccgggtaacggtacgggtaacccgtccggtaacccgtacccggttaccgttacggtacccgaacggtaccccgaaccggtaaccccgaaccccgttaccgtaccgttacctacccgtttcccgg

SEQ ID NO: 239981 - DNA, 840 bp, Homo sapiens
  misc_feature: GYAE6OF02JQJQO.9.81.H04.1.454.CMB.1.raw
  modified_base (273)..(273): a, c, t, g, unknown or other
  misc_feature (273)..(273): n is a, c, g, or t
  modified_base (680)..(680): a, c, t, g, unknown or other
  misc_feature (680)..(680): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcgagggcacgacgggtcctcgggcccagtctcgtccctgacctcacgtccctcccgtccggccggttccggggtcctaccgtaggacctacggttccggtacccaaccgtcttcccgtccttcggacctaacgtacgggaaaccncggtacgtacggttacgactagttcgggtctacctttaagtaacttcgtccgtcttccgacggtaaccaacaccggccacccgaagtacctaaacccgtacccaactctaagttcgttaatttagcggtacgaacttaacggtacggtccccggtccgttacgggttcccgggttacctaggtacggttcctccgttttacgccgtttacggtcccgtttaaaccggacggttccggtaacgaaccgaaaccccgttccgggttacccgaccggtttccgggtaaccgttcccgtttacgggtccgggtcccgtacggtaacggtacccggtacggtacccgtaacgtacggtaccggtacgttacggtactttaacgttacgtcgtaacgttctccgtatcgttanacggtacctaccgtaccaccgtacgttaactccggttaggtaaaccggcgggttaccggacccgtacggtacccgtacccggttacggtaaacccggtccgtaaccgacccgtaacgaacccggtaccctacgggttacctacccgttacgttaccccgg

SEQ ID NO: 239982 - DNA, 754 bp, Homo sapiens
  misc_feature: GYAE6OF02F6JWA.9.81.H04.1.454.CMB.1.raw
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgactattggtncttaataactagtcgtctccgtacggtaccaaccgtagccacccgtaggaccaaacggtcccccaaacgtccatcgtatttagtggtaggtactaagtaacggccggtaccgtcggggtactttccgtgtacgttccgtctttctcgtcggtaccgtaccgtacgtccgtacgaacctccggtaccctcccttcgaactaaactccgtcgtaggccctaccgtacggtacctacggaagggacggtacgtactacgtaacgtttaacttaagttgttacgtcttacgtacttaacgtacgtaacggttacggtaaaggtttaggggtttacggggttcgggttaccggggtacggggtaaacgggtacccgtaaacggtcgttaacccgggtacccggttaccggtacggttcccggaaccgtacccgggtaaacgggttcccgtacccggttacccccgtccggggttacccgtaaccgtttcccggttacccggttccccccggttacccc

SEQ ID NO: 239983 - DNA, 856 bp, Homo sapiens
  misc_feature: GYAE6OF02GN9WC.9.81.H04.1.454.CMB.1.raw
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcagggcacgagggtccctgggcccagttctgccctgacctcagccctccctccgcggtccgggtctccgtggacaggtcgtccaccatcctcctgccacgtggaaccngcagtcgactagttggtntacttaataactntcgttccttcctcggtaaccaacacgccaacccgacggacaaaaccgtacccccaaaacctctactagtacttttaagtcggtaacggtaactaaagtaacggcccggtaccccgttccggttaccgggggttccccttaggtcttacccggtcttccgttacgtcgggtacctaccgtaacgttccgtacggaaccgtaacccgtacccgggtaccccgttccccgtaccggtaccccgttccgttccggttaccgggggtccctacccggtacgggtacctacggggtaaccgtacggtacgggtaccgggttattacgggttaaacttttaacggttaccttaccggaccgtaccggttacccttaacgaacgtttacggacgtaacccgtaccggtaacccgaaacccctaacgttaacgtttacgggttaccgttaaaccggggtaacgggtaccggtacccgggtacccgggttacccgtaccccggttaaccggtttaaccggaccgtaacccggtaaccccgaacccggtaaccccccgaacccgttaccggttacccgtaccgttacccgttacccccgg

SEQ ID NO: 239984 - DNA, 856 bp, Homo sapiens
  misc_feature: GYAE6OF02HM2TX.9.81.H04.1.454.CMB.1.raw
tcagtgatacgtctcacgaccggtgctcgatttagtagtgtagattcgcggggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtagactagtgtgtcttaataactattgtctccgtaggtaaccaacgacgccaacccgaggacctaaaaccgtcccccaaaagtccgtaatacgttaactttatacggtaacggtaacaaacgttaacgcccggtacccttccggtacggggttacccctagtaacgttccgtcgttttaccctaccgtacggtcccttaaccgaaacggtttccgtaacggggacccctaaaaccggtcccggttaccccgttacccccgttagggtaacccccgttcggtttaccgtccggggtaccttaccggacgggtaccgtagggaaccgttaggtaacggtagggttaccttaaggttaacgtttaaccgtttaaccggtcgtaaccggtaacttaccgttaactaacggttacgtccggaccgtaaacgtaacccaaccgtaacttaacgttccgtttaccggttaaagggaaaccggtttaccggggaaaccccgttaccgggttacccgtaaacccggtttcccggtaacgggttaacccaacccggttacccccggtaaacccggtaacccccgtaaaacccccgttacgggtttaaccgttaccccgttaaacgtttcccccggg

SEQ ID NO: 239985 - DNA, 843 bp, Homo sapiens
  misc_feature: GYAE6OF02GXUCK.9.81.H04.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
tcagtgatacgtctcacgaccggtgctcgatttagtagtgtagattcgcggggggggggtctcaggaggcagcgctctcaggacgtcaccaccatggcctgggctctgctcctcctcaccctctcactcaggcacagggtcctgggcccagtctcgccctgactcacgcctccctcgcgtccggtctccgtgacngtcgtcacatctctgcactcggaaaccngaccagtcgactagttggtntaccttaagtaacttagttcgttccgttccgttaacggtaaccaaaccgacgacccaaccccgtaagggaaccctaaaacccggtaaccccccaaaaccgttactaacgttacggtaactttttaacgtacgggtaacggttaacgaaaaggttaaaccgggtcccgggtaccccggtttaccggttacccggggggttaccccgttacggtacgtacccgtttccgtttaccgtttccggtcgggttaccctaaccgttaacgggttcctaacgggtacccgaaacccggtaccccgggtacccccttaacccggtacccggttacccggtttccgttcgggtaccggggtcctacccggacggttcgtaacggaacggtacgtacgggacggtacttagtaaaccgtttattccggtaccggtacgtacgtaccctagttactacgtcggtaaccgtaacgtccccgtaaactcgtaacgttccggttacgtacggtaacgggtaccgtacggaccgttacgggtaccccttacggttaaccgaccggtaccgtaccgaaccgaccccgtaaccgtaccgtctaccgtacgttccccg

SEQ ID NO: 239986 - DNA, 851 bp, Homo sapiens
  misc_feature: GYAE6OF02FH1TH.9.81.H04.1.454.CMB.1.raw
  modified_base (221)..(221): a, c, t, g, unknown or other
  misc_feature (221)..(221): n is a, c, g, or t
  modified_base (643)..(643): a, c, t, g, unknown or other
  misc_feature (643)..(643): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctcctcactcaggcacagggtcctggcccagtctgccctgactcagcctcctccgcgtccggtctcctggacagtcgtcaccatctcctgcactcggaaccngccagtcgaacctgttcggtcgactttaactaaacttacgttcggtcctcccgttacggttaacccaaaccgacgtccaaacccccgtagggacccaaaaaccggttcccccccaaaaaccttccaaacgtttcggtaaactttttaacgacggtaacgggttacctaaaaacgttaaaccggtcccgggtaacccccttaccggttcggggggttacccccttagggtaacccgttccggtaaccttttccgttccgttaccggggtacccttacccgtaaacggtttccgtacgggtaccaaacccgtacccggtccccgtttaccccgtcgggtaaccccgtttccgtaccggtcggggtacccttaccgacgggtcctacggaccgtatcgggtacgtactagtaactttacttacgngactacgtactacgattacgtcgaccgtaccggaccaacccgtaacgttacgtccgttacggttacgggtaaccggtaccgggtaccctaccgggttacccgtaacccggttaccgtaacgggtaacccaacccggtaacccccgtaaacgggtacccccctaaaccccggttaccgtttaccgttaacccgtaccgtttaacccccg

SEQ ID NO: 239987 - DNA, 809 bp, Homo sapiens
  misc_feature: GYAE6OF02GQ2OR.9.81.H04.1.454.CMB.1.raw
  modified_base (139)..(139): a, c, t, g, unknown or other
  misc_feature (139)..(139): n is a, c, g, or t
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (320)..(320): a, c, t, g, unknown or other
  misc_feature (320)..(320): n is a, c, g, or t
tcagtgatacgtctcacgaccggtgctcgatttagtagtgtagattcgcggggggggggtctcagggaggcagcgctctcaggacgtcaccaccatggcctgggctctgctcctcctcaccctcctcactcagggcacngggtcctgggcccagtctgccctgactcagcctccctccggcgtccgggtctccgtggacaggtcgtcaccatctcctgcactcggaaccngcagtacgactagtttgggnacttaatactatcgtcctcgtggtaccaacagccaccgaggaccaacgtccccaaatcatcgtaattagngaggtacaagtacgccggtacccttcggtacgggtccctagtacgtccgtcttcgtacgtcggtaaccttaccgtacgttccgtacggactaaacccggtacggtacccctcccgtcgggttacccgtcccgttcgggtcgggtacccgttaccgcggggtaccgttacgggaaaccgtacgttacgggtaacgggtaccgtttaacggttaaatttttaaccgtttaacggttcggaacccttacggtacccgttaacgttaacgttacgggttaccggaaccgacccgggtaaccctaaccccggtaagtttaaacgttcccggtttaagggttaaccgggtaaccgggggttaccggtaaccccggttacggtaaccccggttaacccggtttacccggttacgggtaccccgtaaccggaacccggtaaccccggtaaccccgtacccgtaccggtttcggtacccttaacccgttttcccccgg

SEQ ID NO: 239988 - DNA, 839 bp, Homo sapiens
  misc_feature: GYAE6OF02I2BFL.9.81.H04.1.454.CMB.1.raw
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
  modified_base (306)..(306): a, c, t, g, unknown or other
  misc_feature (306)..(306): n is a, c, g, or t
tcagtgatacgtctcacgaccggtgctcgatttagtagtgtagattcgcggggggggggtctcaggaggcagcgctctcaggacgtcaccaccatgcctgggctctgctcctcctcaccctcctcactcagggcacgagggtcctgggcccagtctgccctgactcgacgcctccctccgcggtccgggtctccgtcggacaggtcggtcacctatctccgtcgctacgtcggaaccngcgtagtacgactcggtttggngtccttaaataaacttcgtcggttcctaccgttacggaacctaacncgaccctaacccgaagggaacctaaaccgttaaccccccgaaaacgtacctagttagtaactttggaggtacggtacgtaaagtaacggccgtcccgttacggtcggggttccctgtacgtccttcgttacctccgtacggctaccgtacggtcacggaaccaaccggtaccgtccctacccgtacgtaccggttccgtcggtacccggggtccttaccggtccgggtaccggttaccggaaccgggttacgttgggacccgggttcttaacgtaacgttttaacgttactaacggacccttacgtaccgtactaacgttaccggcggtaacccgaccggtaaacccgtaaccgtaaacgttaaccgttcggtttacccgggttaaccgtaacggggtccgggtaccgtaaaccccgggtccgttaacccgggttacccgttaacccggtacggaaccccggttaaaccccggtaccccgtaaacccggtaaacccttcccggtacgttaccccgtttacccggttaccccgg

SEQ ID NO: 239989 - DNA, 829 bp, Homo sapiens
  misc_feature: GYAE6OF02JC6Z5.9.81.H04.1.454.CMB.1.raw
  modified_base (120)..(120): a, c, t, g, unknown or other
  misc_feature (120)..(120): n is a, c, g, or t
  modified_base (162)..(162): a, c, t, g, unknown or other
  misc_feature (162)..(162): n is a, c, g, or t
  modified_base (187)..(187): a, c, t, g, unknown or other
  misc_feature (187)..(187): n is a, c, g, or t
  modified_base (222)..(222): a, c, t, g, unknown or other
  misc_feature (222)..(222): n is a, c, g, or t
  modified_base (629)..(629): a, c, t, g, unknown or other
  misc_feature (629)..(629): n is a, c, g, or t
tcagtgatacgtctcacgaccggtgctcgattttagtagtgtagattcgcggggggggtctcaggaggcagcgctctcaggacgtcaccaccatggactgggctctgctctctcacctcncactcaggcacgagggtcctggccctagtctcgcctgactcncgcctcctccgtgtccggtcttccnggactgtcgtcactattctctgcacttcggaaccngcctagtcaacgtatttcggtcacgttttaacaactgttacggttccttccgttacggttaacccaacgtaacgcccacccgtaaggtaccctaaacggtacccccctaaaatccgttaattggttaactttagtacggagttaaccgtaagtaacggcccgtacccgtttcgggttacccgggttccaagttccttccgttacttccgtcgttccgtcgttaccccgtaagttcttcggaaccctacgaccggtttcccacccttaagggtccccgttacgtttacgggaacccggtccgtaaccgttaccggtacgtaccgtaacggtacgttacgggtcgttacgtacgtttaacgtttaacttaccggtagtaccgttacgtaccgttaagtaccgttttacncgggttaacccgtacgggacccctttaaccgaacgttaacgtttaccgggtaacgtttaaccgggtacggtaaacccgggttacctacccggggttaacccggtacccggtttaccggaacggttacccgttaacccgaacggttaccccggaacccgtaaacccgttcggttaccgtaccgttacggtttaaccccccg

SEQ ID NO: 239990 - DNA, 794 bp, Homo sapiens
  misc_feature: GYAE6OF02HZATC.9.81.H04.1.454.CMB.1.raw
  modified_base (241)..(241): a, c, t, g, unknown or other
  misc_feature (241)..(241): n is a, c, g, or t
tcagtgatacgtctcacgaccggtgctcgatttagtagtgtagattcgcggggggggggtctcaggaggcagcgctctcaggacgtcaccaccatggcctgggctctgctcctcctcaccctcctcactcgagggcacgtacgggtcctggggccctaggtcctcgccctgactcacgccctccctccgcggttcggtcctccgtgactagtcggtcacatctctgcactacggaccagcngtagactagttggtatacttaaactaacgttagttcgttacctaccgtacggtaaccctaacgaccgaaccgaccgaagggaacctaaaacccggttacccctaaaagtacctaacgttaagttaattttaacggacggtaacggtactaaaagttaacggaccggttcccgtacggttaccgggggttacctacgtacgttaccggttcttaccgtacgtacgtaccgttaccgtaaggttaccgtacggaaccctaacggtacccggtacctttacccgtacggtacccgttcgttacggtaccggtcctaccggtacggcgtaaccggaagttacgtcgggaaccgtacgttaacggttaacgttacttaaccggtcgaacggtacgtaccttagaaacgttcggtaacctacggtacccgaacctaaccgtaagtaaccgttacggttaccgtaacgggtacgtacggtaccgtacggtcccgtaacggttaccgaccggtaccaacggaacccaccggtacccaccgtacgtcgtaccgtacgttccg

SEQ ID NO: 239991 - DNA, 723 bp, Homo sapiens
  misc_feature: GYAE6OF02IGUXF.9.81.H04.1.454.CMB.1.raw
  modified_base (223)..(223): a, c, t, g, unknown or other
  misc_feature (223)..(223): n is a, c, g, or t
  modified_base (257)..(257): a, c, t, g, unknown or other
  misc_feature (257)..(257): n is a, c, g, or t
  modified_base (295)..(295): a, c, t, g, unknown or other
  misc_feature (295)..(295): n is a, c, g, or t
tcagtgatacgtctcacgaccggtgctcgatttagtagtgtagattcgcggggggggggtctcaggaggcagtgctctcaggacgtcaccaccatggcctgggctctgctcctcctccaccctcctcactcaggcacgagggtcctcgggacccagtctcgccctgacctcacgcccttccctccgcggtccggtctccgtgacagtcggtacaccatctccngccacgtaggaccacgcagtcgactagtttcggnttacttagtaactgtacgttctccgtacgtaaccaacncgaccaccgaacggaccaacgaaccctaatcatctaatttcgacggtagtacaagtaacgcgcccttggtcggtctcacgttccgtcttcgtcgtcgtcctacgacgttcgacgacttaacccggacgtcccttccgacgggtacccttgcccggttagccctacggacgcgtacgagtcgacggtacggtactagttaactttaccgtatcggttaacacgtcgttacaagtcgtacgtacggacccgtaacctaccctaacgacgtttaccgttaacggttacggggtaacggtacccgggtaccgttaacccggtccgtttaaacccccgggtacggttacgaaccccgtaaaccgggtcccctaaaacccgggacccccctttaaaccgtaccctttaccgggtacctttaccccgttaccccg

SEQ ID NO: 239992 - DNA, 718 bp, Homo sapiens
  misc_feature: GYAE6OF02IRMJ9.9.81.H04.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
  modified_base (274)..(274): a, c, t, g, unknown or other
  misc_feature (274)..(274): n is a, c, g, or t
  modified_base (441)..(441): a, c, t, g, unknown or other
  misc_feature (441)..(441): n is a, c, g, or t
  modified_base (456)..(456): a, c, t, g, unknown or other
  misc_feature (456)..(456): n is a, c, g, or t
tcagtgatacgtctcacgaccggtgctcgatttagtagtgtagattcgcggggggggggtctcaggaggcagcgctctcaggacgtcaccaccatggcctgggctctgctcctcctcaccctcctcactcagggcacgagggtcctcgggcccagtctgccctgactcacgcctccctccgcgtccggtcctccgtggacngtcggtcaacngtctccagcactaggaaccnggtacaggtcgaactagttgggtcgtcctttaataaccgttnttcggttccttccgttacgggttaacccaacgacggtaccaccgtaacggcctaaaaccggttcccccaaattccgatacgtattagtagacgtacaataacggccgtccgtcgtcggtccctgtagtccgtcgttctcgtcggcctacctagtctacggcgtaacnccgtcccgttacccncgtaacccgttcgtacgttcggaccttcccgaggttccacgacggtatacggtagacgttactaagtttaccttaagcgtacgtagtcccgttataggtacgtaccgtacggtaacccgccgaacctaaccgttaaacgtccggtttaccggttaacgggtacgttaacccgggtccgttaccggtacctccggtaccgtaaccgggtctaccgaacccggtaccgtaaccaccccgttagtaccgttacgtaccgttcccg

SEQ ID NO: 239993 - DNA, 670 bp, Homo sapiens
  misc_feature: GYAE6OF02HWDOB.9.81.H04.1.454.CMB.1.raw
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (278)..(278): a, c, t, g, unknown or other
  misc_feature (278)..(278): n is a, c, g, or t
  modified_base (329)..(329): a, c, t, g, unknown or other
  misc_feature (329)..(329): n is a, c, g, or t
  modified_base (377)..(377): a, c, t, g, unknown or other
  misc_feature (377)..(377): n is a, c, g, or t
  modified_base (397)..(397): a, c, t, g, unknown or other
  misc_feature (397)..(397): n is a, c, g, or t
  modified_base (495)..(495): a, c, t, g, unknown or other
  misc_feature (495)..(495): n is a, c, g, or t
  modified_base (528)..(528): a, c, t, g, unknown or other
  misc_feature (528)..(528): n is a, c, g, or t
tcagtgatacgtctcacgaccggtgctcgatttagtagtgtagattcgcgggggggggtctcaggaggcagcgctctcaggacgtcaccaccatggcctgggctctgctcctcctcaccctctcactcgagggcacgagggtcctcgggcccagtctgccctgactcacgccctcctccgcggtccggtctccgtggactgtcggtccacatctctgctacgnggaacctgcagtnacgtgttggtnacttaanaactgtcgtctcgtgaacccaagngacctaccggaggacctaaaccgtcccctaaatcgagtacgttatttacgnggtaacgtactaaaggtaccgccggttcccctaggttcggggtacccngggtaccttccggtcttccncggttaggacctacgagtctcggaacgaacctcccggtacccttccgtcgtacccggtctcggtcgggtacctacccgtagggtaactcggtaaccgnggttacggacgttctacgttatttaaccgttcngggtacctaggtaaccctgtaaccgttagccgacgaccgtacaacccgtagttacgttcgtacggtaggacgttccgaaccgtcgtacctcgtacgtacgcggaccgtaccgaacgtccctaccgcgtactccgtacgtacc

SEQ ID NO: 239994 - DNA, 545 bp, Homo sapiens
  misc_feature: GYAE6OF01AEKB2.26.58.F03.1.454.CMB.1.raw
  modified_base (301)..(301): a, c, t, g, unknown or other
  misc_feature (301)..(301): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggctcccagatatcactggagaaatagtgatgacgcagtctccagccaccctgtctgtgtctcccggggaaagacgccaccctctcctgcagggccagtcagagtgttggcagcaacttagcctggtaccaacagaacctgggcaggctcccgaggctcttcatctacggtncactcccaccgagggccacgtggtactccccgcaggttcagtggcaggtgggtctggggacggtagttcactctcaccatcagcagcctgcagtctgagtatttgctagtttattacgtgtctagtctagtaataaacgtcggtcctccggtcggtacgttccggaccgaacgggaccgtaaggtaggaacgtacgaaacgacgtaggtcggctagcacatctcgtcttactcttcctccgtcc

SEQ ID NO: 239995 - DNA, 625 bp, Homo sapiens
  misc_feature: GYAE6OF01DKLX9.26.58.F03.1.454.CMB.1.raw
  modified_base (204)..(204): a, c, t, g, unknown or other
  misc_feature (204)..(204): n is a, c, g, or t
  modified_base (312)..(312): a, c, t, g, unknown or other
  misc_feature (312)..(312): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggctcccagatatcactggagaaatagtgatgacgcagtctccagccaccctgtctgtgtcctcccggggaaaangcccaccctctcctgcagggccagtcagagtgttggcggcaacttagcctaggtaaccaacaagaaacctgggacaggcctcccgaggcctcttacattcgtacggtnacactccaccgagggccacgtcggtactccccgacaggttcaggtggctaggtgggtctaggggacgtagtttcactctaccaccatcagcagtcctgcagtctagaagtatttgacttagtttacttactgtccagtctagttatcgtccttaacctcttacgtttcccgtagttacgtttcggaccgtaacggggtacctaaggtccgttaggacttaacgtaaccgtaaaaccggtaacgttgggttacggaccgttacgacccgtaacccgtaacgttccgtttccgttacccgtttccgttaaccccg

SEQ ID NO: 239996 - DNA, 583 bp, Homo sapiens
  misc_feature: GYAE6OF01BPRWZ.26.58.F03.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggctcccagatatcactggagaaatagtgatgacgcagtctccagccaccctgtctgtgtctcccggggaaancgccaccctctcctgcagggccagtcagagtgtggcagcaacttagcctggtaccaacagaaacctgggcaggctcccgaggctcttcatctacggtncactccaccgagggccactggtactccccgctaggttcagtggcaggtgggtctgggacgtagttcactctcaccatcagcagcctgcagtctgtaagtatttgacttagtttattactgtcagtactaagttaataaaacgtcggtacccgtaccggtacggtaccgttacgggaccgtaacgggaccgaagggtacggaaacgtaccgaaacgtaacgtaggtcggtactacggccgacctacgttcgttacgttaccttactacttccgttccccgtacc

SEQ ID NO: 239997 - DNA, 767 bp, Homo sapiens
  misc_feature: GYAE6OF01A6I6N.26.58.F03.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggctcccagatatcactggagaaatagtgatgacgcagtctccagccaccctgtctgtgtcgtcccggggaaanacgccaccctctcctgcagggccagtcagagtgtggcagcaacttacgcctaggtaccaacagaaaccgtgggcaggcctccgaggcctcttcatcgtacggtnacactcccacgacgggccacgtcggtactccccgctaggttcaggtcggacgtagggttcggggtcgtacgggggtacggtacgtttaccgacgtttcccgtaccgaaccccgtaagttcccgaacggtccctaacggtcccgtacggaccgtacggttaccgttagggtaaacgtttagtttttacggaccgtttaaggtttttaacgtttaccgttaggttaccgtaacgtacgtaaacggtttaaacgtaaaaaccggttcgggtaccccgtttaccgggttacggtaacccgggtttaccgggaacccggttaaacggggaacccggtaacgggttaaccgggtaaaacgtaaccgtaaaaccggtaaacgttacgggttacggtaccgttacggacccgtaaccgtacgttaccgttacgttaccttaccgtacgttccccgttccccgtacccg

SEQ ID NO: 239998 - DNA, 767 bp, Homo sapiens
  misc_feature: GYAE6OF01B89QX.26.58.F03.1.454.CMB.1.raw
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggctcccagatatcactggagaaatagtgatgacgcagtctccagccaccctgtctgtgtcgtacccggggaaancgccaccctctcctgcacgggccagtcagagtgtggcagcaacttgcctaggtaaccaanagaaacctgggcaggcctcccgaggtctctcatccgtacggtgccactccacgacgggccacgtggtactccccgacgtaggttcaggtcggcgtagggtcggggtacgtaggggaacggtagttccacgttcctaccgaaccgtaatccgaacgtccgaaccggtcccgttacggaccgtaggttaccgttaacgggttaaacggtttaacgtttttcggtaacgtttaaacgggtttttaacttttaaaccggttacggttaacccggtaacggtaacgttaaacggtttaaaacgttaaaaaacccgtttcgggtaccccgtttaacccgggttacgggtaaccggtttacccggggaaacccggtaaacggggtaacccggtaaagggttaacgggtaaaacttaaccggaaaaccgtaacgtcggtacggtaccgttacggaccgtaaccgtagttaccgttacgttaccttacctaccgttcccgttccccgtaccg

SEQ ID NO: 239999 - DNA, 591 bp, Homo sapiens
  misc_feature: GYAE6OF01A124V.26.58.F03.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggctcccagatatcactggagaaatagtgatgacgcagtctccagccaccctgtctgtgtcgtcccggggaaanacgccaccctctcctgcgagggccagtcagagtgttgcagcaacttgcctggtaccaacagaacctggcaggctcccgaggctctcatcgtacggtncactcccaccgacgggccctactcggtacctcccccgactaggttccagtcggactaggtcggggtcgtcggggacggtacgttccaccgttcgaccaccgtatccgacgccacgtccgtgcctagtcgtagtaagtagttttcgacttaactttattactgtcagcgagtcgtagactaacgtcgtcctctcgtacgtttcgggacggtacgggaccgtagggtcgacgtagtacgacggtacgaacgttggtacggtctacgacctaccgtatcgttcgttccttaccg

SEQ ID NO: 240000 - DNA, 623 bp, Homo sapiens
  misc_feature: GYAE6OF01C29F3.26.58.F03.1.454.CMB.1.raw
  modified_base (205)..(205): a, c, t, g, unknown or other
  misc_feature (205)..(205): n is a, c, g, or t
  modified_base (405)..(405): a, c, t, g, unknown or other
  misc_feature (405)..(405): n is a, c, g, or t
  modified_base (440)..(440): a, c, t, g, unknown or other
  misc_feature (440)..(440): n is a, c, g, or t
  modified_base (451)..(451): a, c, t, g, unknown or other
  misc_feature (451)..(451): n is a, c, g, or t
  modified_base (607)..(607): a, c, t, g, unknown or other
  misc_feature (607)..(607): n is a, c, g, or t
tcagagactatactcacgaccggtgctcgatttagtctgatcgagaagggaaaggggaggaactgctcagttaggacccagacggaaccatggaacgccccagcgcagcttctcttcctcctgctactctggcctccagatatcactggagaaatagtgatgacgcagtctccagcccacctgtctgtcgtcgtaccggggaaanacgcctaccctctccgtgcgaagggcctaggtcaggtacgtggttcggaccagtaccgtaaacgtttacggccgttacggtaaccaaaacgaacggtaaaacccgtgggaccacggtcctaccgagtcctagtcaataccgtggtacgcaacgtcccacggacggcctacgtccgtacctcccgcgtaagttcgagtcgnacggtgggtctagggacgtattccactcgacacgntcgagctgctncgagtctaagtattacgttagactttaagttacttaagtcgtacagtataagtaaacttaacgcgtacgttccggacgtacggtcgacggtaagacgagtacgaagtaacgaaccgagttacggcgtcgtaactcgactaacttcgtagtaccctntacttccgcgtaaccg

SEQ ID NO: 240001 - DNA, 1011 bp, Homo sapiens
  misc_feature: GYAE6OF01AIV4O.26.58.F03.1.454.CMB.1.raw
  modified_base (152)..(152): a, c, t, g, unknown or other
  misc_feature (152)..(152): n is a, c, g, or t
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggcctccagatatcacgtggaanaaatgtgatgacgacagtctccacgcctaccgtgtctgtcgtccgtaccgggaaancgcccacctctccgngcgacgggccagtcagtgtggtcgcagactaacgttcgccgtacggtaaccaacgtaaccggaaccgtcgggacgaccgggacctccccgtaagggtccctttacttaccgtacgttccggttaccggtcgtaccctaaccgttacccggaacccgggtaccggtaccctaaccggttccgggttaaccccctcccccgggtaaccggttaacgggttcccgtaagggtaccgggaccggttaccggggtttacggggttacggtacccggggggaaaccgggtttactttacccggtaacctttacccggaccctaaaaccggtcgtaaccccggtaagtaccccggtaccggtaccggttaccggtaaccgtttagggttaaccggtttaacgggttaaaaccgtttttcgtttaccgggttaaccgttttttaacggtttttaaaccgtttaccggttaccggggttaaaccctaacggggttaaccccgtttaaaacgtttaaaaacccgggtttaaaccccgggttacccgggtaacccggtttaaccggggttaacccggggtaccccgttaaccggggtaaacccggttaaacggggtaaaccggttaacggggtaaaacccgtaaaaccggttaaccgggttaaaaccgggtacggtttaccgggtaaaccggggttcccaaaacccggttaaacccgtacccgggtttacgtttacccgttaaaccggtttcccttaaaaccgggtttcccccgttacgggtaacccccgtttaaacgg

SEQ ID NO: 240002 - DNA, 242 bp, Homo sapiens
  misc_feature: GYAE6OF01B0375.26.58.F03.1.454.CMB.1.raw
  modified_base (235)..(242): a, c, t, g, unknown or other
  misc_feature (235)..(242): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggctcccagatatcactggagattaaacgaactgtggctgcaccatctgtcttcatcttcccgcatctgaagtatagtctctgagcgggctggcaaggcgcatagnnnnnnnn

SEQ ID NO: 240003 - DNA, 804 bp, Homo sapiens
  misc_feature: GYAE6OF01CAJZC.26.58.F03.1.454.CMB.1.raw
  modified_base (68)..(68): a, c, t, g, unknown or other
  misc_feature (68)..(68): n is a, c, g, or t
  modified_base (152)..(152): a, c, t, g, unknown or other
  misc_feature (152)..(152): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (226)..(226): a, c, t, g, unknown or other
  misc_feature (226)..(226): n is a, c, g, or t
  modified_base (292)..(292): a, c, t, g, unknown or other
  misc_feature (292)..(292): n is a, c, g, or t
  modified_base (370)..(370): a, c, t, g, unknown or other
  misc_feature (370)..(370): n is a, c, g, or t
tcagagactatactcacgaccggtgctcgatttagtctgatcgagaagggaaaggggaggaactgctnagttaggacccagacggaacatggaagccccagcgcagctttctcttcctcctgctactctggcctccagatatcacgtggaanaaatagtgatgacgcagtctaccagcccaccctgtctgtgtaccgtaccggggaaancgacctaccctntccgngcacgggccaaggtcaggtagtgtggacagactaaacttggcctaggtaaccaagaacgtaaacgnggacgacgcctaccgagtccttacttacacttaccgtacgtcgacctactacccgacgacggtccacgttcggtaccnccccggtacgtaggttacgtacggtaggaccgtagggttcgggtaccgtaggggaccggttatttaaccaccttcgtaaccacgtaataccgaagccgtacgccgtagtaccagttcgtaagtaaagttacgttttagaaacgttttaggttttaactccggttagaccgtaaacgtaacgtttaaacgtaaaaacggttaaaccgttccggggttaaacccgttcggggttaaaccgggtaaccgggtaacccggtaaaccggggtaaaaccgggttaaacggtaacgggttaaaacggggaaaacctttaaaacccggtaaaaacgggtaacggtttacggccgggtaaaccttaaccggacctaaaaccccggttatttacggtttaccgttactttaacccctacccgtttccccgttaaccgtaacccg

SEQ ID NO: 240004 - DNA, 873 bp, Homo sapiens
  misc_feature: GYAE6OF01AKUI7.26.58.F03.1.454.CMB.1.raw
  modified_base (147)..(147): a, c, t, g, unknown or other
  misc_feature (147)..(147): n is a, c, g, or t
tcagagactatactcacgaccggtgctcgatttagtctgatcgagaagggaaaggggaggaactgctcagttaggacccagacggaaccatggaacgccccagcgcagtccttcctcttcctccctgcttactcgtcggcctaccanattactcgacgttggaagaattagtgactcgacgactacgttcgccacgtccctacctggtcgtcgttacggtcccggtaaccggggaagccctaccgtacccttcgccgtaacggccggaccggacctagtcaagggtcgttacggtcgaaccacgacttaccgttacggtaccgtaaccggtaacctaacgaacgtaccggtggacgtaaccggtcgtcccggtagtcctaccgttacgtaacgtaccggtaggtccgactaccgttaccggaccggcgggtaccctacggtaccggtaccgtaccccgggtcgtaccggttacggccggttacgtaccggtacggggttccggtacgggtcggtaccgtaccggtactcgtacgtaaccctcgttacgtaccgcgttccgagtaccgtcgacgtccgtaatacgttaaacgtttgtaacgttacgttacgttacgttaaccgtacggtacgtaacggttaactaacggttaacccgttaacgtccgggtaacccggtttcggaaccggtttaacccgggtaacccggaacgggttaaaccgggtaacccggttaaggtaaacccggtaaaccggtaacttaaaccgggttcccggttaaaggaccgtttaccggaacttaccccggtagtttacccgttaacccgttgttaaccccggttacctttacccgtaccccggttcccgttaaaccg

SEQ ID NO: 240005 - DNA, 578 bp, Homo sapiens
  misc_feature: GYAE6OF02HE9U2.26.58.F03.1.454.CMB.1.raw
  modified_base (261)..(261): a, c, t, g, unknown or other
  misc_feature (261)..(261): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggctcccagatatcactggagaaatagtgatgacgcagtctccagccaccctgtctgtgtctcccggggaaagagccaccctctcctgcagggccagtcagagtgttggcagcaacttagcctggtaccaanagaaacctgggcaggctcccaggctcttcatctacggtgcatccacagggccactggtactccccgcaggttcagtggctagtgggtctgggacggagttcactctcaccatacagtcagcctgcagtcgtagtaagtattttgctagtagtattactgtacagtactagttatgtccttacctctacgtttcccgtagttaccgttttcggccgtaaggggtacctaaggtccgttagggtacgtaacgtaccgtaaaacggtaacgttacggtacggtacgttacggactaaccctaagttccttacggtttacc

SEQ ID NO: 240006 - DNA, 539 bp, Homo sapiens
  misc_feature: GYAE6OF02GWQ7U.26.58.F03.1.454.CMB.1.raw
tcagagactatactcacgaccggtgctcgatttagtctgatcgagaagggaaaggggaggaactgctcagttaggacccagacggaaccatggaagccccagcgcagcttctcttcctcctgctactctggctcccagatatcactggagaaatagtgatgacgcagtctccagccaccctgtctgtgtctcccggggaaagagccaccctctcctgcagggccagtcagagtgttggcagcaacttagcctggtaccaacagaaacctgggcaggctcccaggctcttcatctacggtgcatccaccagggccactggtactccccgcctaggttcagtcggcagtgggtctggggacgagttcactctcaccatcagcacgcctgctagtctgaagtatttgctagtttattacttgtcagctaagtaataaaactcggacctcggtacggtaccgttcggaccgtaagggaccgaaggtagaactacgaacgactaggtggactgcactagtctcgtcttcacttccttccgtacc

SEQ ID NO: 240007 - DNA, 591 bp, Homo sapiens
  misc_feature: GYAE6OF02GWL36.26.58.F03.1.454.CMB.1.raw
  modified_base (376)..(376): a, c, t, g, unknown or other
  misc_feature (376)..(376): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggctcccagatatcactggagaaatagtgatgacgcagtctccagccaccctgtctgtgtctcccggggaaagagccaccctctcctgcagggccagtcagagtgttggcagcaacttagcctggtaccaacagaaacctgggcaggctcccaggctcttcatctacggtgcactcccaccgagggccacgtcggtactccccgccaggttcagtggcaggtggggtctggggacgtagttcactcncaccatcagcagcctgcagtctagaagtatttgacttagtttattacttgttcagactagttaataaaacgtcgtaccgttaccggtacggtacgttccgtaccgaaacgggtaccgtaaagggtacgaaacgtacgaaacgtaacgtaggtacggcgtacgacctaaccgtagttccgtacgttacctttaccgtacttcccgttacccgtacc

SEQ ID NO: 240008 - DNA, 538 bp, Homo sapiens
  misc_feature: GYAE6OF02IWRB4.26.58.F03.1.454.CMB.1.raw
  modified_base (525)..(525): a, c, t, g, unknown or other
  misc_feature (525)..(525): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggctcccagatatcactggagaaatagtgatgacgcagtctccagccaccctgtctgtgtctcccggggaaagagccaccctctcctgcagggccagtcagagtgttggcagcaacttagcctggtaccaacagaaacctgggcaggctcccaggctcctcatctctggtgcatccaccgacgggccacgtggtactcccggcagacttcagtggcgagggggtctgggacaggtaattcactctcaccatccaccacgcctgctacgtctagtaagtatttcgactagttacttaatttactgttacagtacaattaataattactgtcttcgttcgttcgggcggggtacaaggtcgtaggagtacgtacgaacgtacgtggtcgcgtgcactntcgtcttctctac

SEQ ID NO: 240009 - DNA, 601 bp, Homo sapiens
  misc_feature: GYAE6OF02JX1NU.26.58.F03.1.454.CMB.1.raw
  modified_base (305)..(305): a, c, t, g, unknown or other
  misc_feature (305)..(305): n is a, c, g, or t
  modified_base (387)..(387): a, c, t, g, unknown or other
  misc_feature (387)..(387): n is a, c, g, or t
  modified_base (414)..(414): a, c, t, g, unknown or other
  misc_feature (414)..(414): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggctcccagatatcactggagaaatgtgatgacgcagtctcagccacctgtctagtcgtccgtacccgggggaaatcgcccacccttctcctgcagggccagtcagtagtgtggcagctaacttgcctggtaccaacagaacctggcacggctcccgaggtctctcatcgacggtnccatccacgcggccactcggtactccccggactagttcaggtgctaggtcgggtctaggggacgacgttcactcgtcaccgntccaggtcacgctgactgtcagtaatntttcgacttagtttatccgttgactagtactagtaaactaacgtcgtacccttccggtagtaaccggttcggaaccgtaagggaaccgtaacggacgtaaagtaccgtaaacgtaagttacggtacggcgttaaccgaccgtacctagttcgttacgtaccgtttacctacggttcctaccccgtcg

SEQ ID NO: 240010 - DNA, 646 bp, Homo sapiens
  misc_feature: GYAE6OF02IPG9H.26.58.F03.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggctcccagatatcactggagaaatagtgatgacgcagtctccagccacctgtctgtgtcgtcccggggaaagngcccaccctctcctgcgagggccagtcagagtgttggcagctaacttacgcctaggtaaccaacacgaaacctgggacaggcctcccgaggctctcatcgtacggngcactccaaccgacgggtacccacgttcgggtaccctccccggtacgtaggttccgaaggtcggcgtagggttcgggttacggtcggggtacggtacgttcctaccgttccgtacgaccctataccacggccacgtcccgtgacgtacggttactaggtaaagtagtttgagttaacgttaaattttagttaacctgtactagcttaagtactcgatacgaccgtcggaccttcgtccgtaccgttacggaccgtaaggacctacggaacggtaggaacgttaaacgttaacggtaccgtaggttcggacgtctaccgaactcgttacgtcgttacc

SEQ ID NO: 240011 - DNA, 646 bp, Homo sapiens
  misc_feature: GYAE6OF02FOERX.26.58.F03.1.454.CMB.1.raw
  modified_base (204)..(204): a, c, t, g, unknown or other
  misc_feature (204)..(204): n is a, c, g, or t
  modified_base (473)..(473): a, c, t, g, unknown or other
  misc_feature (473)..(473): n is a, c, g, or t
tcagagactatactcacgaccggtgctcgatttagtctgatcgagaaggggaaaggggagggaactgctcagttaggacccagacggaaccatggaagccccagcgcagcttctcttcctcctgctactctggctcccagatatcactggagaaatagtgatgacgcagtctccagccacctgtctgtgtctcccggggaaagngccaccctctcctgcagggccagtcagagtgttggcagccaactttagcctggtaccagcaacgaaacctcggccacggcctcccgacggcctcctccactcttcgtggtcggctactcccaccgacggggcccacgtcgggtacgtccccggccagtacttcgaggtgggcggtaggggggtctacggggacaaggtaacttccgaaccttcccgtactaacccgtactaccacccgacggccctcgcgtacggtacttgaaacgttnttttacggctaacggttactacgtttacgtcgttacgacgtaactaattaagttaaacttcgtggtccttccgttacgtttccggggaccggggtacgtacgtgtaggacgtaacgtaccgaaccggtagttcggtacgtccgtcgcctaccgtagtcgttacgttcttaccg

SEQ ID NO: 240012 - DNA, 825 bp, Homo sapiens
  misc_feature: GYAE6OF02JL0MW.26.58.F03.1.454.CMB.1.raw
tcagagactatactcacgaccggtgctcgatttagtctgatcgagaagggaaaggggagggaactgctcagttaggacccagccggaaccatggaagccccagcgcagcttctcttcctcctgctactctggctcccagactaccactggagaaatagtgatgactcgagtctccaggccacccttgtctgtcgtctccgaaggggaaacgtgtccacccgttctcctgcgagggcccagtcaggagttgttaacgtaactacgttagccttacggtaccagacacgtaaacctcgaccaggtcctaccgagcctcctcacttctcgtggtcaccactccacggtacggacctacgttacggtacctccaacggtcgtacggttcaggtggtaaccgtggtacgggttcggacgggtactaacggtacggtttacccacgtttaccccgataacccccggttataccggtaacgtacccgagggtttaaccccgtggttccccggtaaaggttcccgttaaaagtaacgttcggtttacggtacgttaccggtttaaatttttaaccggttactagggttaaccctaggttaacgtaaccttaaacggtttaacccaccggttttcccggggcccttttaaccggaccttacccggtttacccggttaaccggggggtcgtaaaacccgggggtttccgaaacggggtttttaacgaacgggtttaaaacccgtccgggtaaaaaaccgtttacgggttacccgggtttacgggaacttcccggggtaaaaccccctcgggttttaacctccccgggtttaaccg

SEQ ID NO: 240013 - DNA, 738 bp, Homo sapiens
  misc_feature: GYAE6OF02HKOTC.26.58.F03.1.454.CMB.1.raw
  modified_base (391)..(391): a, c, t, g, unknown or other
  misc_feature (391)..(391): n is a, c, g, or t
  modified_base (462)..(462): a, c, t, g, unknown or other
  misc_feature (462)..(462): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggctcccagatatcactggagaaatagtgatgacgcagtcctcagcccaccctgtctgtgtccgtacccgggaagcgaccctaccctctcctgcgacgggccaggtcagagttgttggctagacaacgtttacgcctacggtaaccaacgaacgtaaaccgtgggaccacggtccctaccgaggtccttcttccacgttcgtacggtcgacactcccgaccgacgggcctacgtacggtacctcccccggactacggttcgnggtcggacgtagggtcgggtacgtgggggaaccgtaggttccaccgttaccgtaccaacctataccgtacnccgtacggcctacgacgttacgtacgtagtaagtttagtttacgtacgtttagtttaacgtttacgttagtactaagtacctaaaggttaaactaaacggttccggtaccttaccgggtacgtaccgttaccggaaccggtaaaccggtaaccggaaaggtaaccgtaaacgtaaccggaaacgtacggttacggtaccggaccgttaacggaacctaccgtacgtttaccttccgggttacttacccgttaccgtttaccccggtcctaaccccg

SEQ ID NO: 240014 - DNA, 723 bp, Homo sapiens
  misc_feature: GYAE6OF02FVL5T.26.58.F03.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
tcagagactatactcacgaccggtgctcgatttagtctgatcgagaagggaaaggggaggaactgctcagttaggacccagacggaaccatggaacgccccagcgcagcttctcttcctcctgctactctggctcccagattccaccggagacatttgttttgacacagtctccagcccacctgtctttgtctccaaggggaangcccaccctctcctgcagggccagtcagngtgttggcagctacgttgccgtaggtaacccaacgtacgaaacccgtggacccaaggtccctaccccgaggccttccctactaatccgttagtcgaactcgacctactacccgaaacggacgggcccaacgtcggaccaccttccccgagtcccgtaggttcaggtcggactaggtcggtacgtcggtagggactagtacctttacaccttccactaaccctgacgacgtaccacgtacctaaggaccgttaccgtaggtaaacgtttacgttttcgaaccttttaacttttacgtacgttcgtacctacgggtactaacgggtaccgttacgaacgttacccggttccggtaccctttccgtaccgtttacccgggttcggggaaccggtaacggggtacccgtaggggtaccgaacgttcgtaaccggtaacgtaaccggtaggtcggttacggaccttacggacccttacgtacgttccggttaccg

SEQ ID NO: 240015 - DNA, 705 bp, Homo sapiens
  misc_feature: GYAE6OF02HGESK.26.58.F03.1.454.CMB.1.raw
  modified_base (209)..(209): a, c, t, g, unknown or other
  misc_feature (209)..(209): n is a, c, g, or t
  modified_base (458)..(458): a, c, t, g, unknown or other
  misc_feature (458)..(458): n is a, c, g, or t
tcagagactatactcacgaccggtgctcgatttagtctgatcgagaagggaaaggggaggaactgctcagttaggacccagacggaaccatggaagccccagcgcagcttctcttcctcctgctactctggcctcccagatatcactggaagaaatagtagatgacgcagtctccagcccaccctgtctgtgtccgtacccggggaaancgcccaccctctcctgcgagggccagtcagagtgttggcagactaacttacgccgtaggtaacccaaacgaacggtaaacccgtggggacacgggtcctcccgaggtccttcgttaccagttccggtacggttcacctaccgtcccaaccgacgggccctacgttacgtaccctccccgacgtcggttacaggtcgcgtaggtcgggtggtacgggacgtacgtacactcctccaacacgtcgacgccncgtccctagcctagtcgtagtagttagtttacgtacttaagtttacttacgtagttacagtactaacgtaaactaaacgtcgtaccggttaccggtcggtaacccggtacggtaaccgaaacgggtaaccggtaacggtaaacggtaaacgtaaccgtaaacggtacgttacgggtacggtaccgttacgaaccgtaccgtcgttactttacgttaccttaccgttacttccccggttccctaaccg

SEQ ID NO: 240016 - DNA, 754 bp, Homo sapiens
  misc_feature: GYAE6OF02I8PC4.26.58.F03.1.454.CMB.1.raw
  modified_base (96)..(96): a, c, t, g, unknown or other
  misc_feature (96)..(96): n is a, c, g, or t
  modified_base (426)..(426): a, c, t, g, unknown or other
  misc_feature (426)..(426): n is a, c, g, or t
tcagagactatactcacgaccggtgctcgatttagtctgatcgagaagggaaaggggaggaactgctcagttaggacccagacggaaccatggaanccccagcgcagcttctcttcctcctgctactctggcctcccagatatcactggaagaaatagtgatgacgcagtcctccacgccaccctgtctgtgtcgtacccggggaaagacgcccaaccctctcccgtgcacgggccaggtacagaggtcgttggacagactaacgttcgcctacggaaccaacgaagtaaaaccgtgggacaggcctacccgaggctctctaagttccgtacggtcacactacccgacgacggtccaacgtacggtactccccgacgtaggttcgagtcggacgtacggtcgggtagtcgggaacggtacgttacnccgttacgtccaacctacgtaccgacgtacacgtccgtcgactacgtacgtagtaaggttatttacgtacgttaagtttaagtttacgttagtacgtacgtacgtaaagttaaactaaacgttacggtaccgttacggttacgggaccggtttttttttaaccgggaaccggtaaacgggtaaacggtaaacgggttaaacggtaaaacgtaaacgaaaccggtaaccggttaacgggttacggtaccggttacgaacccgtaacgtaaccgtttaaccgttacgtttaccgttaccttaaccgtttacccgttaccccgttaacccg

SEQ ID NO: 240017 - DNA, 531 bp, Homo sapiens
  misc_feature: GYAE6OF01BAISF.13.77.G11.1.454.CMB.1.raw
  modified_base (358)..(358): a, c, t, g, unknown or other
  misc_feature (358)..(358): n is a, c, g, or t
  modified_base (522)..(522): a, c, t, g, unknown or other
  misc_feature (522)..(522): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggccctgtgctggtcgtctatgttgatagcgaccggccctcagggatccctgagcgattctcgggctccaactctgggaacncggccactctgaccatcagtaggtcgaagccgggatgaggccgactattactgtcaggtgtgggatagtagtcgtgagcagtgtggtattcgggcggagggaccaacgtcgaccgtccgtaggtcagcccgaaggctcgccccctcggtccactctcgttcccnccctcctcg

SEQ ID NO: 240018 - DNA, 524 bp, Homo sapiens
  misc_feature: GYAE6OF01BRPIC.13.77.G11.1.454.CMB.1.raw
  modified_base (444)..(444): a, c, t, g, unknown or other
  misc_feature (444)..(444): n is a, c, g, or t
  modified_base (513)..(513): a, c, t, g, unknown or other
  misc_feature (513)..(513): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggccctgtgctggtcgtctatgttgatagcgaccggccctcagggatccctgagcgattctctggctccaactctgggaactcagccactctgaccatcagccgggacccaggctagtggatgaggctgactattactgtcaggcgtgggacagcagcactcgcccgntatcgtcttacggacgtcgggaacctaggtccaccgtcctaagtccacgcccaacggccccaaaccccnctgtcctaccg

SEQ ID NO: 240019 - DNA, 417 bp, Homo sapiens
  misc_feature: GYAE6OF01DLP03.13.77.G11.1.454.CMB.1.raw
  modified_base (414)..(417): a, c, t, g, unknown or other
  misc_feature (414)..(417): n is a, c, g, or t
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactactggggccagggaccctggtcaccgtctcctcaccctccaccaagggcccatcggtcttccccctggcaccctctccaagagcacctctggggcacagcgccctgggctgcctgtcaaggctactcctagtacgtgactgagcgggctggcaaggcgcatagnnnn

SEQ ID NO: 240020 - DNA, 598 bp, Homo sapiens
  misc_feature: GYAE6OF01DAMW6.13.77.G11.1.454.CMB.1.raw
  modified_base (217)..(217): a, c, t, g, unknown or other
  misc_feature (217)..(217): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacgccaggattaccngtggggaaacaacattaggaagtaaaagtgtgcactggtaccagcagagccaggccaggccctgtgctggtcgtctatgttgatagcgaccggcctcagggatcccgtgacgcgattcgtcgggctccaactcgtacgggaacacggccactctacgaccatcaaggtacgggtacgaaggccggggatggacggccgactattacgtgtcagggtgtgggatagtagtcgtgagctaagtggtggttagttcgggcgggtagggaaccaaacgtggacccgtccgtagggtaccacggccccgaaaggtccctccggaccccccgtcgggtaccctacccgttccgttccggtttccccccgccccttcccgttacccgg

SEQ ID NO: 240021 - DNA, 425 bp, Homo sapiens
  misc_feature: GYAE6OF01BG55J.13.77.G11.1.454.CMB.1.raw
  modified_base (421)..(425): a, c, t, g, unknown or other
  misc_feature (421)..(425): n is a, c, g, or t
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactactggggccaggggaaccctggtcaccgtctcctcaccctccaccaagggcccatcggtcttccccctggcaccctcctccaagagcacctctggggcacagcggccctgggctgcctggtcaaggactacttcctagtacgtgactgagcgggctggcaaggcgcatagnnnnn

SEQ ID NO: 240022 - DNA, 495 bp, Homo sapiens
  misc_feature: GYAE6OF01DLYWB.13.77.G11.1.454.CMB.1.raw
  modified_base (434)..(434): a, c, t, g, unknown or other
  misc_feature (434)..(434): n is a, c, g, or t
  modified_base (492)..(492): a, c, t, g, unknown or other
  misc_feature (492)..(492): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaaggccagtccctgtgctggtcatctatcaagatgccaagcgcctcagggatccctgagcgattctctggctccaactctgggaactcagccatctgaccatcagcggacccaggctatgatgaggctgatatctgtcaggcgtgggacagcagcactgcccgntatcgtcttcggaactgggacaaggtcaccgtctaagtcacgcccaaggcccaacccntcg

SEQ ID NO: 240023 - DNA, 614 bp, Homo sapiens
  misc_feature: GYAE6OF01DTJFF.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcatctatcaagatgccaagccggccctcgaggggactcccgtgacgcgactttctcgtggttcccaactcgtgggaatacagccactctgaccatcgaacgggctcgaggtctagtggatgaggctgaacttattaccgtgtacgaggtgtagggacagaccaactcctagtggttaggtacgttcgggacgggtacgggaacctaaaggtccgttacggtaaccccggttaccgtaacgggttcccgaaacggaccccccgtaaaggggtcccttaaccccgggtcccccccgttccgggttccccgtaaccgtttccccgg

SEQ ID NO: 240024 - DNA, 426 bp, Homo sapiens
  misc_feature: GYAE6OF01CIL8D.13.77.G11.1.454.CMB.1.raw
  modified_base (345)..(345): a, c, t, g, unknown or other
  misc_feature (345)..(345): n is a, c, g, or t
  modified_base (421)..(426): a, c, t, g, unknown or other
  misc_feature (421)..(426): n is a, c, g, or t
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactactggggccaggggaaccctggtcaccgtctcctcaccctccaccaagggcccatcggtcttccccctcggcaccctcctccaagacgcacctcnggggcacagcggcctgggctgcctggtcaaggactactctagtacgtgactgagcgggctggcaaggcgcgatagnnnnnn

SEQ ID NO: 240025 - DNA, 653 bp, Homo sapiens
  misc_feature: GYAE6OF01AGJ6U.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtggggaaacaacattggaagtaaaagtgtgcactggtaccagcagaagcccaggccaggccctgtgctggtcgtctatgttgatagcgaccggcctcgagggactcccgtgacgcgattcgtcgggctccgaacttcgacgggaaccaccgggcctacgtctcgaaccctagtccgaggtacgggtacgaacgggccggggtatcgggacggcccgtacttaacgttaccgtggtacgagggtggtaggggactaggtacggtcgtagacgctaagtggttaggtagttcggggacgggtaacgggtaacccgtaacgtcggtaccggtaccgtaacgggtaccacggtaccccgaagggcccgttcccggaccccccgttcggtaccctacccgttccgttaccgtttacccccctccccgttccgttacccg

SEQ ID NO: 240026 - DNA, 523 bp, Homo sapiens
  misc_feature: GYAE6OF01AP9CN.13.77.G11.1.454.CMB.1.raw
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (495)..(523): a, c, t, g, unknown or other
  misc_feature (495)..(523): n is a, c, g, or t
tcagtcacgtactacacgaccggtgctcgatttagctagtcactcaagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgtacttttggagtggtgcgctcgaccccgtggggcccgggaaccctggtcaccgtctcctcacgccctccaccaagggcccatcggtccttccccccgtggccaccccgtccctcccaagacgccacccgtcgtgggggccacgacggccggcccgtggggcctcggccctgggtccaagggaccttaccttccctaaggtaccgtgacctggacggccggggtctcgggccaaacgggccgacagtacgngngnnnnnnnnnnnnnnnnnnnnnnnnnnnnn

SEQ ID NO: 240027 - DNA, 515 bp, Homo sapiens
  misc_feature: GYAE6OF01DM0A8.13.77.G11.1.454.CMB.1.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (476)..(515): a, c, t, g, unknown or other
  misc_feature (476)..(515): n is a, c, g, or t
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacgngactatcagctagtttgactacgngggccaggggtaaccctggtcaccgtctcctcaccctccacgaacggcccatcggtcccttccccgtggcccaccctcctaccaacgcgccaccgtcggtcggggaccacgaggcccggccgtggggcctcggaccttgggacgaaacggtaccttaccttccgtaaggttacgtgtaacgtggtacggcgggcgtacgggacgaacggcacaagtagcatnnnnnnnnnnnnnnnnnnnnnnnnnnnnnnnnnnnnnnnn

SEQ ID NO: 240028 - DNA, 694 bp, Homo sapiens
  misc_feature: GYAE6OF01EO1YI.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcacgccaccctcggtgtcagtcggcccaggacagacggccaggattaccgtggtaggggaaacaacgtagttaggaaagtaaagtgtgacacgtcggtaccagacaagaacgccacggccacggccctgtgcgtggtcgtctatgtgatcggcgaccggcctacgacgggtactccgtgacgcgtacttcctcgtcggtcctaccgaacgttcgtacgggtaacctcgacgtccctactccgtacgaacccacgtaccggacgggacccgggaacccgagggtaccttaggtagggatgggaacggtcgttacgtaacttatttaccgtcggtacggacgggtcgggtacgggacgacggacgacggacctacgtcccggcccgttacgttacgttcggttaccggtaccgggtaaccggtacgggaaaccgtaccgggtcccgtaacccggttaccgtaacggtacccgaacgaacccccggtaacgaccccctaaacccctcgtttaccgtcccgttaccccg

SEQ ID NO: 240029 - DNA, 582 bp, Homo sapiens
  misc_feature: GYAE6OF01CZVID.13.77.G11.1.454.CMB.1.raw
  modified_base (319)..(319): a, c, t, g, unknown or other
  misc_feature (319)..(319): n is a, c, g, or t
  modified_base (570)..(570): a, c, t, g, unknown or other
  misc_feature (570)..(570): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcaagaagccaggccaggccctgtgctggtcgtctatgttgatagcgacccggccctnaggtactcccgtgacgcgtattcgtcgggctaccgaacttcgtagggaaccacgggccaactcgtcgaccatcgagtagggtacgaaggccggggatcggacggccgacttattactgtcagggtgtagggataggtagtcgtgagcgtagtggtggtagttcgggacgggtacgggaaccaacgtcgaccgtccgtacggtcacggcccgaaggtcctcggcccccgtggcctaccgtcttcgtcccccncccgtcctaccg

SEQ ID NO: 240030 - DNA, 725 bp, Homo sapiens
  misc_feature: GYAE6OF01C7E1Z.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtcggcccaggacagacggccaggacttaccgtggtaggggaaacaacgattagggaaagttaaaaggtcgtagcacgtcggtacagcaagaacgccaaggccaacgggccctggcgtcgtcggtcgttctagtgttagacgtacggccggaccggccctacggacgggtacttccccgtaggacgaccgtacttccggtccgggtcctaccgaacttcggtacgggaaacctaccgggccacgttcgacgaacctagtacgtaaggtacggggtacgaacgggtccggggatacggacggaccgtagttacgttacgtgtacgtagggttcggtagggtattaggttacgttcggaggtacgtacgtagttacgggttacggttagttccgggacgggtaacgggtaaccctaaacggtcggtaaacccggttaccgtagggtaccgacggaccccgtaaggcccgttaacccggtcccccgttacgggtaccacccgtttccgtacccgtttacccccaccccgtttccgtaaccg

SEQ ID NO: 240031 - DNA, 682 bp, Homo sapiens
  misc_feature: GYAE6OF01CMOW7.13.77.G11.1.454.CMB.1.raw
  modified_base (353)..(353): a, c, t, g, unknown or other
  misc_feature (353)..(353): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacgaggctctgtgacctcctatgtgctgactcagcccaccctcggtgtcagtcggcccaggacacggacggccaggtacttaccgtggtagggggaaacaacgtagttaggaagtaaagtgtgacacgtgacagcagacgcgaggccacggccctgcgcgtggtcgtctagtgttgagtacgccgacccggccctacggacgggtacctcccgngacgcgtacgttcggtccggtcctacccgtaacgtcgtacggaacccgaccggccacgtcgtacgaaccagtacgtagggtacgggtaccggaacgggtccggggtagtacggggaccggtaccggtaacgttacgttacgttaggtacggtagggtgggtagggtagtaggtaggtacgtaggagtcgtagtggttagggtacgtcggggacgggtaggaaccgtagtaccggtacgtcggtacggtcgaccgtaccgtaacgggtctcccgcccccgttaggtaccctaccgttcgttaccccgttcccctccgttcccgttaccgg

SEQ ID NO: 240032 - DNA, 607 bp, Homo sapiens
  misc_feature: GYAE6OF01CJA0P.13.77.G11.1.454.CMB.1.raw
  modified_base (534)..(534): a, c, t, g, unknown or other
  misc_feature (534)..(534): n is a, c, g, or t
tcagtcacgtactacacgaccggtgctcgatttagctagtcactcaagggaaaggggtgtctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatatacttcctggtatcagcagaagtcaggccagtcccctgtgctggtcatctatcaagatcgaccaagccgccctacgacggactcccgtgacgcgtactttcctccgtggtcctaccctaacgtccgtacgggaacctcgacgccctactcgtccgaccactaccgacggaccgggacccgaggccgttacgaggtactacggtacggtctagtaaccgttacgtttaaccgtggtaccgtacggggtacggttcgggaacgacgccgacggccgtacgtaccgcccgtntagttcggttccgttaaccggtaacggttcgggaaccgttacggtaccctaccgttccgtaaccggtacccgg

SEQ ID NO: 240033 - DNA, 725 bp, Homo sapiens
  misc_feature: GYAE6OF01CA9UU.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagtccaccctggtgtcagtcggcccaggacagacggccaggattaccgtggtaggggaaacaactagttaggaaagtaaaagtgtgacacgtggtacagcgaagaacgccgacggccacggcccgtggtcgtccgtcggtccgtacttagttggttgacgtacggcccggacccggtccctaggacgggtacttcccgtagacgtccgtacgttccgtaccgggtctaccgaacgtcggtacggaactaccggaccctactcgtacgtaccacgttacgaagggtacgggtacgaacgggtccggggatacgggacgtacccgtaattacgttacgtgtacggacgggtggtagggaccaggacgacgaccgtacgtccgcccgtattacgtcggttaccgttacgggtaaccgtacgggaaccgtacggtacccgttaccgtaccgtaaaggtcccgacccgtaacccggaacccggaccccctaaacccccgtagttcccgtacctaaacccgtttcccgttacccggtttcccccgtcccctttaaccccgg

SEQ ID NO: 240034 - DNA, 442 bp, Homo sapiens
  misc_feature: GYAE6OF01D48TJ.13.77.G11.1.454.CMB.1.raw
  modified_base (431)..(442): a, c, t, g, unknown or other
  misc_feature (431)..(442): n is a, c, g, or t
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactactggggccagggaccctggtccgccgtctcctcaccctccaccaagggcccatcggtcctcccctggcacctcctcaagcgcacctcgtggggcacgagccgtccccgtgggcgtcgccgtggtcgaaaggacctactttcctaagtacgtgactggagcgggctggcaaggcacatagnnnnnnnnnnnn

SEQ ID NO: 240035 - DNA, 750 bp, Homo sapiens
  misc_feature: GYAE6OF01D6B1V.13.77.G11.1.454.CMB.1.raw
tcagtcacgtactacacgaccggtgctcgattttagctagtcactcaagggaaaggggtgtctgggcctaaggaagcagcactggtggtgcctcagccatggcctggaccgttctcctcctcggcctcctctctcactgcacaggctctgtcgacctcctatgtgctgactcagcccaccctcggtgtcagtcggccccaggacacggacggccgaaggtacttaccgtgggtacggggaaaacaacgtagttagggaaacgttaaaagtgtagactactggtaaccagcaagaacgcgacggccacggccctgtcgcgtggtcgtcttagtgttgtagtacggacgacccggtcctacggagggtacctcccgtggacgtacgtacgttccgacgggtccttaccgaacttcggtacggaaccgtccggacctacgtcgtacgacctagtaccgaggtaacgggtacgaacgggccggggtactagggacggaccgtaacgttacgttacgtagtacggtaggtgggttaggaacgttaggtaggttcgttaggacgtacgtagttcggtagttacgggttaccgggacggtaacgggtaacctaacgtaccggtaacccgttacgttacgggtaccgaacccgtaacccggtaaccggacccgttccccggtacccccgggttacgtaccccgttaccgtttccccggttccccgtttacccccctacccccgttccggttaaacccg

SEQ ID NO: 240036 - DNA, 512 bp, Homo sapiens
  misc_feature: GYAE6OF01AW5JI.13.77.G11.1.454.CMB.1.raw
  modified_base (482)..(482): a, c, t, g, unknown or other
  misc_feature (482)..(482): n is a, c, g, or t
  modified_base (485)..(512): a, c, t, g, unknown or other
  misc_feature (485)..(512): n is a, c, g, or t
tcagtcacgtactacacgaccggtgctcgatttagctagtcactcaagggaaagggcctggagtggattgggtacatccattacagtgggaccacctactacaaccccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactacgtggggccaggggaaccctggtcaccgtctcctcaccctccaccaacggcccatccggtccttccccctgggccacccctcctcccaacgacgccacccgtcgtgggggccacgacggcccggcccgtgggcctcggcccgttgggtaccaaagggaccttaacttcccgtaggttaaccgtgaccgtggacggccgggctgggacgaacgggtcgacgtacgtagcancgnnnnnnnnnnnnnnnnnnnnnnnnnnnn

SEQ ID NO: 240037 - DNA, 825 bp, Homo sapiens
  misc_feature: GYAE6OF01EF3VH.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcacgccaccctcggtgtcagtcggccccaggacagacggccaggattaccgtggtaggggaaacaacattaggaaagtaaagtgtgcactggtaccagcagaagccgaggccaggccctgtgcgtggtctctatgttgataggccggaccggccctggacgggactcccgtggacgtcgtacttccgtccgggcctacccgtaacgtcgtacggggaaccaccgggccctaaccgtcgtacgaacccgtataccggtaagggttacggggtaccgaaacgggcccgggggtaattacggggaacgggtaccccgttaaacgttaacgtttaaccggttcggttaccggaaggggttttcgggtaacgggggttaagtttaacgggttaggggttaccggttagggaacgtaccgttaagggtttcggggttacggggttttaacgggtttcccgggggaaccggggtaaccggggtaaccccaaaaccggttcccgggtaaaccccgttcccgggttaacggggtacccgaaaccgggtccccggtaaacgggtccccggttacccccggcccccccggtttacgggtaccccttacccgttaccccgtttaccccggttacccccccttaccccgtttccccggtttaacccggg

SEQ ID NO: 240038 - DNA, 782 bp, Homo sapiens
  misc_feature: GYAE6OF01CELYQ.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagcccaccctcggtgtcaggtcggccccaggacaggaccggccaggacttaccgtggtagggggaaaacaactagttaggaaagtaaaagtgtgcactggaccagcagaacgccaggccacggccctggtcgcttcgggtcgtcgtagttcggtagattacggccgtaccccggcccgtacggacgggtacctccccgtaggtacggaccgtacttccggtccggggccttacccgtaaactccggtaggggaaaccctaccggacctaaccgtcgtacgacccaatacggaaggttacggggtacgaacggggccggggtatggaaccgggccgtaacttagttacgtcggtacggtacgggttggtagggtaagttagggtcgttacggtagacggaactaggttagggttacggttaagggtttcccggggaacggggtaacggtaacccgtaacggttacccggtaaccccggtttaccggaacgggtttaaccccgaaccggtaccccgggtaaggtccccggtttccccggacccccccgttacgggtcccctaacggtttccccgtttacccggttcccccccgtcccgttcccgtttaacccgg

SEQ ID NO: 240039 - DNA, 462 bp, Homo sapiens
  misc_feature: GYAE6OF01CKN50.13.77.G11.1.454.CMB.1.raw
  modified_base (436)..(436): a, c, t, g, unknown or other
  misc_feature (436)..(436): n is a, c, g, or t
  modified_base (443)..(443): a, c, t, g, unknown or other
  misc_feature (443)..(443): n is a, c, g, or t
  modified_base (445)..(446): a, c, t, g, unknown or other
  misc_feature (445)..(446): n is a, c, g, or t
  modified_base (448)..(462): a, c, t, g, unknown or other
  misc_feature (448)..(462): n is a, c, g, or t
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggcgtatatactgtgcgagagtcggaggttacggtgactatcagctagtttgactacgtgggaccagggaccctgtcaccgtctcctcaccctccaccaacggcccagtccgtccttccccctcgccgaccctcctaccaacgacgccaccgtcgtcggggcacgacgccggcccgtgggctcgccgtggacaacggactacttctacggtacgtgacgtgaggcgggcgtggcgaaggcgngtactgngnnannnnnnnnnnnnnnn

SEQ ID NO: 240040 - DNA, 683 bp, Homo sapiens
  misc_feature: GYAE6OF01EZ5B5.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattaccgtggtggggaaacacattggaagtaaagtggtgcactggtaccagcagaacgccaggccaggccctgtgcgtggtcgtctatgttgatacgcgaccggccctacgagggactccccgtgacgcgtacttccgtcgggcctccaaactccgtaggggaaccacggtccctaactcgtaccgacctagtaccgaaggttacggggtacgaaacgggcccggggtatacgggacgggtacccgtaacttaacgtttacgtcggtacaggggttggtagggtagttacggttagtcggtagacgtcgtagtcgggtaggttagttccgggacgggtaacgggaacctaacgtcggtacccgtaccggttacggtaccgaccggtccccgtaagggtccccgtcccggacccccgttcggtaccctccgttaccggttccccgttcccccggtccccttccgttacccgg

SEQ ID NO: 240041 - DNA, 1004 bp, Homo sapiens
  misc_feature: GYAE6OF01DFEDO.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcacgcccacccgtcggtcgtcagtcggccccgaggacaggaccggccagggtacttaccgtgggtacgggggaaaaccaacgtagttaggaaaggttaaaagtggtagaccgtacgttacggtaccgagacgaaggaaccggccgaacgggacccgaaccgggtcccccgtttgggtccgtaccggttcgggttaccggtttacgttaacgtttggtttacgaaacgtttaccgggacccccggtaaccccgggtccccgtacgggaacggggttacccgttaccccgttagggaaccggtccggttaacgttttcccgggtacccggggggttacccctttaaccccggtaaacccgttacccggggtaaccgggggtaaacccgtaccccggggtacccctaaccgttacccggtaccggaaccctaacgttaccgggtaaaggggttaccggggtaacgggaaccggggtacccgggggtagttaccggggaacccggtaccggtaaccttagttacggttaggtaccgtagggttcggtaaggtacgtaggttaccggtaggagtacgtcgtaggttagggttacggttaaccgggttcggggaaccgggtaacccgggtaaaccctaacggggtttacccgggtaaaccccggtttccggtaaaccgggttacccgaacccggggtaacccccggtaaacgggggttcccccgtacccccgggttaccccccccgggtttaggtacccccctttaacccgggtttacccccgtttaccccccggtttaaccccccccgtaccccgtttaccccggtttttaaccccgggg

SEQ ID NO: 240042 - DNA, 944 bp, Homo sapiens
  misc_feature: GYAE6OF01DWCW8.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcgacgcccacccgtcggtgtccaggtccggcccccagggaccaggaccggccgaggtacttaccgtgggtacggggaaacaacgtagttaggaaagttaaagtgtgacgacgtcggaaccacgacgaagacgaccgacggacccgacggtcccctggtcgcgttcggtcgtacttacgttggttgagttaccggaccggccccggacccttcggacgggtacctcccgtaggacgcgtacgttccgccggggtcccttaaccgaaccgttacggtaccggaaacccgaccggtaccctacgttacccgtacgaaaccccttacgtacccgggtaaacgggttaacgggggtaccgggtaaaccgggggtaccccggggggtaaggttaaccgggggaaccgggttaccccggttaacccggtttttaagtttaacccgggtcggttaaccgggacgggggtaccgggttaccgggggaaacccgacgggttaacccgaaccggtacccgtaaccggtaccccgggtaccccggtttaacgttaacgggtttccgggtttaaccccggtttaaaccggggtaaccgggttacccggggaaaccccggttaacccggtttacccgtaaccccggtttaaacccggttaacccggttaccggaaacccccgggttaccccggaaacccgggaacccccctaaacccccggtacggttaccgtaccccgtaacccgtttccccgtttaacccccttaccccgttacccccgtttacccg

SEQ ID NO: 240043 - DNA, 662 bp, Homo sapiens
  misc_feature: GYAE6OF01A1BD2.13.77.G11.1.454.CMB.1.raw
  modified_base (645)..(645): a, c, t, g, unknown or other
  misc_feature (645)..(645): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattaccgtgtgggggaaacacattggaagtaaagtgtgcacgtggtaccagcagaacgccaggccaggcccctgtgctggtcgtctatgtgtatagcgaccggccctgagggctccctgacgtcgattcgtccgggctccgaacctcgtacgggaacacccggacccacgtccgtacgacctactaccggacggttacggggtacggaacgggacccggggtagtagggaaccgggacccgtaacttaaccgtttacgttagtaccggtaggggttcgggtagggtaacgttaggtaggtcggttaggagaccgtagttaggttggttacgttcgggcgggtacgggttacaaggtcgtaccggtccgtaggtacgtaccgccgtaggccctccggacccccgttcggtcctaaccttccgtaccgttcccccncccgttcccttaccggg

SEQ ID NO: 240044 - DNA, 786 bp, Homo sapiens
  misc_feature: GYAE6OF01E0OBP.13.77.G11.1.454.CMB.1.raw
  modified_base (321)..(321): a, c, t, g, unknown or other
  misc_feature (321)..(321): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacaggacggccaggattaccgtggtacgggggaaacaacattagggaaagtaaaaggtgtgacacgtcggtaccagcaagaacgccgaggcccacggccctgtcgctggtcgtctatggttnatacgccgtaccggccctgacgggtactcccgtagacgtcgtacttccgtccgggtcctacccgtaactcggtacggggaaacctaccgggaccctaacgttcgtacgacccgtactaccggtaagggttaaccgggggttaccggaaacgggtcccgggggtaagtacgggtacgggacccggttaacgttaacgtttacggtacggtaaccgttagggggttacgggttggggtaaacgttaacgggttacggtcggtacggtacggtactaaggttcgggttagggtacggtttccggggaacgggaccgggaaaaccctaacggtacggttaccccgtaccgtaacgggtacccgaacccgtacccggaagggttccccgtccccggtaccccccggttccggtaccctacccgttcccggttaccccgtttccccccggttcccctcccggtttaaccgg

SEQ ID NO: 240045 - DNA, 758 bp, Homo sapiens
  misc_feature: GYAE6OF01BYI7L.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctggtaggggaaacaacgagttaggaaagtaaaagtgtgacacgtggtaccagcaagaagccaggccacggccctgtgcgtggtcgtctagtcgttagagtagccgaccggccctagagggtactcccgtaggacgtacgtacgtttccggtaccggggtaccttacccgtaaacgttccggtacggggtaaacccgacccgggtaccctaaccgttcgtaccggaaacctacgtaccgtaagggtaacgggttaccggaaacgggaccgggggtaagtcgggaacggtacccgtaacgtttaacgtaacgtacggtacgtaggggttacggtagggtaacgttaggtacgtacggtaggaacgtacgtaagttggttacggttacggttaccgggacgggtaacggaaacccgtaacgtcggtaacccgttacggtaacgggtaccgacgtaccccggtaaggcccgttccccggaccccccgttagggtaccctaccggttccgttacccgttacccccggtcccttcccgttaaccgg

SEQ ID NO: 240046 - DNA, 732 bp, Homo sapiens
  misc_feature: GYAE6OF01AH39T.13.77.G11.1.454.CMB.1.raw
  modified_base (151)..(151): a, c, t, g, unknown or other
  misc_feature (151)..(151): n is a, c, g, or t
  modified_base (523)..(523): a, c, t, g, unknown or other
  misc_feature (523)..(523): n is a, c, g, or t
tcagtcacgtactacacgaccggtgctcgatttagctagtcactcaagggaaaggggtgtcgtgggccgtaaggaagcagcactggtggtgcctcagccagtcgccgtcggaccgttctcctcctcggccctcctctctcactcgacacgngctctgtacgacctctatgtcgctacgactcgacgccctcccgtcgtcgtcgtaggtccggacccagggaccacggtacccggacgacggtacttaccggtagggtaacggggtaaaccacgtaagttaggaaaacgttaaaggtcgtagacgttaacgtacggtaaccacggaccaaggaacgaccgacgccgtaccggtcccgtaggtcggtacgtctaacgtttacgaacgaaagtaccaacccgaacccggtccgtacggacggtactacccgtagacgtacgttattccgttacgttaccgtaccgttaccgtagtacggaaactaccgacgtccctaagtcacggtacacgtacgacgaccgtagngtcgtagaggtacgaggtacgacgtctaacgttgttacgtcgtcggtaggtcgtacgagtacgacacgtactaggtccgttagtacggtcggaggacgtaccgagtccgtacgtaccgtcgtaccgtacgccgggtaccagggtacccctcccgggtaccgacccgtttccgaccgttcccgttcccccttacccgtcccggttacccg

SEQ ID NO: 240047 - DNA, 800 bp, Homo sapiens
  misc_feature: GYAE6OF01B80QD.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctggtaggggaaacaacaagttaggaaagtaaaagtgtgacacgtaggtaccagcaagaacgccgaggcccgacggcccctggtcgcgtggtcgtctagttgttgataggccgaccggtccctgacgggactccctggacgtcgtacgttcgccggggtcctaccgaacgtcgtacgggaaccacccggccaaccgttctacgaacctatacgtaagggttacggggtaacggaacgggaccggggtagtagggaaccggggtacccgtaacgtttaacgttacgttacgggtaccggtaaggggttgggttagggtaaagtttacgggttacggttacgggtggtaacgcttaaggtttacgggttacggggttacggttaccggggacggggtaacgggaaacccggtaaccgtacgggtaaccccgggttacccgtaccgggttaacccgaccgggtaaccccggtaaaccgggtcccgttaccccggttcccccccggttacgggttacccccttaccggtttaccccggtttacccccgggtttcccccccggtcccccgtttcccggttaaccccgg

SEQ ID NO: 240048 - DNA, 786 bp, Homo sapiens
  misc_feature: GYAE6OF01EPLQX.13.77.G11.1.454.CMB.1.raw
tcagtcacgtactacacgaccggtgctcgattttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattaccgtggtagggggaaacaacattggaaagtaaaagtgtgacactggtaccagacagaagccaggccaggccctgtcgcgtggtacgtctatggttgatacgcggacccggccctcgagggtactcccgtagacgccgtactttccgtccggggactaccaacgttcgtagggaaccaccgggccctaacgtcctacggacctatacgtaggttacggggtacgtaaacgggccggggtatacgggacgggtcccgtaactttaacgttaccgtacggttaccgtaggggttagggttaggggtaatttaagggtacggtttccgggtaaggacggtaccgtaaggtttggggttacggtttaaggttttacccgggggaccggggtaaacggggtaaccctaaaaccggttcgggtaaacccccggttccggttaaacgggttcccgaaccgggtacccccgtaaaggggttccccttacccgggcccccccgtttaccgggtaccccttacccggttaccccttttccccgggttacccccctaaccccgtttccccgttaaacccggg

SEQ ID NO: 240049 - DNA, 424 bp, Homo sapiens
  misc_feature: GYAE6OF02I4KKL.13.77.G11.1.454.CMB.1.raw
  modified_base (420)..(424): a, c, t, g, unknown or other
  misc_feature (420)..(424): n is a, c, g, or t
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactactggggccagggaaccctggtcaccgtctcctcaccctccaccaagggcccatcggtcttccccctggcaccctcctccaagagcacctctgggggcacagcggccctgggctgcctggtcaaggctacttcctagtacgtgactgagcgggctggcaaggcgcatagnnnnn

SEQ ID NO: 240050 - DNA, 529 bp, Homo sapiens
  misc_feature: GYAE6OF02GRJKN.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggcctcagggatccctgagcgattctcgggctccaactctgggaacacggccactctgaccatcagtaggtcgaagccgggatgagcgactattactgtcaggtgtggatagtagtcgtgagcatgtggtattcggcggagggaccaaacgtgaccgtcctaggtccaggcccaaggcctcgccccctggtccacgtctcgttcccaccctcctaccg

SEQ ID NO: 240051 - DNA, 442 bp, Homo sapiens
  misc_feature: GYAE6OF02HZAI1.13.77.G11.1.454.CMB.1.raw
  modified_base (439)..(442): a, c, t, g, unknown or other
  misc_feature (439)..(442): n is a, c, g, or t
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagaggccccgaaagaggaaagtggctacgatttgggaagtactactacatggacgtctggggcaaagggaccacggtcaccgtctcctcagcttccaccaagggcccatcggtcttccccctggcgccctgctccaggagcacctctgggggcacagcggccctgggctgcctggtcaaggactacttcctagtacgtgactgagcgggctggcaaggcgcatagnnnn

SEQ ID NO: 240052 - DNA, 534 bp, Homo sapiens
  misc_feature: GYAE6OF02IV9FX.13.77.G11.1.454.CMB.1.raw
  modified_base (449)..(449): a, c, t, g, unknown or other
  misc_feature (449)..(449): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattgggaagtaaaagtgtgcaaactggtaccagcagaagccaggccagtcccctgtgctggtcatctatcaagatgccaagccggccctcgagggatccctgagcgattctctggctccaactctgggaactcagccactctgaccatcacgcgggacccaggctatggatgaggctgactattactgtcaggcgtgggacagcagcacgtcgcccnctacgtgttcttcggaacgtcgggaaccaaggtccaaccgttccgtaagtccacggaccccaacgggaccccaaccccgctaccg

SEQ ID NO: 240053 - DNA, 531 bp, Homo sapiens
  misc_feature: GYAE6OF02G2QNG.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggcctcagggatccctgagcgattctcggctccaactctgggaacacggccactctgaccatcagtagggtcgaagccgggatggaggccgactattactgtcaggtgtgggatagtagtcgtgagcagtgtggtagttcggcggagggaccaaacgtgaccgtcctaggtcacgcccaaggctcgcccctggtccacgtctcgtcccaccctcctaccg

SEQ ID NO: 240054 - DNA, 427 bp, Homo sapiens
  misc_feature: GYAE6OF02IRVQ0.13.77.G11.1.454.CMB.1.raw
  modified_base (419)..(427): a, c, t, g, unknown or other
  misc_feature (419)..(427): n is a, c, g, or t
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactactggggccagggaacccctggtcaccgtctcctcaccctccaccaagggccccatcggtcttccccctggcaccctcctccaagagcacctctgggggcacagcggccctgggctgcctggtcaaggctacttcctacgtgactgagcgggctggcaaggcgcatagnnnnnnnnn

SEQ ID NO: 240055 - DNA, 430 bp, Homo sapiens
  misc_feature: GYAE6OF02HFO5S.13.77.G11.1.454.CMB.1.raw
  modified_base (231)..(231): a, c, t, g, unknown or other
  misc_feature (231)..(231): n is a, c, g, or t
  modified_base (423)..(430): a, c, t, g, unknown or other
  misc_feature (423)..(430): n is a, c, g, or t
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggcctatattactgtgcgagagtcggaggttacggtnactatcagcagtttgactacgtggggccagggaaccctggtcaccgtctcctcaccctcaccaagggcccatcggtcttccccctggccaccctcctcccaagacgcacctctgggggcacacgcggccctgggctgcctggtcaaggacactttccagtacgtgactgagcggctggcaaggcgcactagnnnnnnnn

SEQ ID NO: 240056 - DNA, 531 bp, Homo sapiens
  misc_feature: GYAE6OF02HHL6W.13.77.G11.1.454.CMB.1.raw
  modified_base (362)..(362): a, c, t, g, unknown or other
  misc_feature (362)..(362): n is a, c, g, or t
  modified_base (448)..(448): a, c, t, g, unknown or other
  misc_feature (448)..(448): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacacattggaagtaaaagtgtgcactggtaccagcagaagccaggccaggcccctgtgctggtcgtctatcaagatgccaagccggccctcagggatccccgtgagcgattctctggctccaactcgtgggaacncagccactctgaccatcagcgggacccaggctgtggatggaggctgactattactgtcaggcgtgggacagcagcaccgtgcccgntacgtcgtcgttacggacgtcgggacctaaggtcctaccgtcctaacgtccacgcccaacggcccaacccccgtactcgtacc

SEQ ID NO: 240057 - DNA, 540 bp, Homo sapiens
  misc_feature: GYAE6OF02HIHMT.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgttctggtcgtctatgttgatagcgaccggccctcgagggactcccgtgagcgattcgtcgggctccaactctgggaacacggccactctgaccatcagtagggtcgaagccgggatggaggccgactattactgtcgaggtgtgggataggtagtcgtgagcatgtggtagtcggcggagggaccaacgtgaccgtcgtaggtcacgcccgaaggcctcgcccctgtccactccgtcgttccccgccctctctacg

SEQ ID NO: 240058 - DNA, 536 bp, Homo sapiens
  misc_feature: GYAE6OF02GH5UU.13.77.G11.1.454.CMB.1.raw
  modified_base (469)..(469): a, c, t, g, unknown or other
  misc_feature (469)..(469): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtggggaaacaacattggaagtaaaagtgtgcactggtaccagcagaagccaggccaggccccctgtgctggtcgtctatgttgatggcgaccggccctcgaggggactccctgacgcgattctctggcctccaactctagggaactcagccactctgaccatcagtagggtacgaacggccggggatggaggccgacttattactgtcgaggtgtagggatagtagtcggtgagcagtgtgtagttcggnggaggaaccaagtcgacgtcgaggtcacgaccaaggctcgcccctcggtccactctcgtccctaccc

SEQ ID NO: 240059 - DNA, 439 bp, Homo sapiens
  misc_feature: GYAE6OF02FH311.13.77.G11.1.454.CMB.1.raw
  modified_base (433)..(439): a, c, t, g, unknown or other
  misc_feature (433)..(439): n is a, c, g, or t
tcagtcacgtactacacgaccggtgctcgatttagctagtcactcaagggaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctgacccctggggcccgggaaccctggtcaccgtctcctcagcctccaccaagggcccatcggtcttccccctggcaccctcctccaagagcacctctgggggcacagcggccctgggctgcctggtcaaggctacttcctagtacgtgactgagcgggctggcaaggcgcatagnnnnnnn

SEQ ID NO: 240060 - DNA, 536 bp, Homo sapiens
  misc_feature: GYAE6OF02GOYK7.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggccccctgtgctggtcgtctatgttgatagcgaccggccctcagggatccctgacgcgattctcgggctcccaactcgtgggaacacggccactctgaccatcagtagggtcgaaggccgggatggagccgactattactgtcaggtgtgggataggtagtcgtgagcatggtggtattcgggcggagggaccaaacgtgaccgtctaggtcagcccaaggctcgccccgtggccactccgtcgtcccgccctcctccg

SEQ ID NO: 240061 - DNA, 676 bp, Homo sapiens
  misc_feature: GYAE6OF02I509Z.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgagctgactcagccaccctcagtgtccgtgtccccaggaccagacagccagcatcacctgctctggaaataatggcagataaatatacttcctggtatcagcagaagtcaggccagtcccctgtcgcttggtcatctatacaagatgaccaaggccggccctgacggggtactccccgtgacgcgtactttcgtctggcctaccgaactcgtacgggaaccttcgacgccctactcctacggaacccagttccgaacggcccgggaaccccgacgggtaccttaacggcggtaagttcgggaaccggtcgtacggtaactttaacgtttaaccggttgttacccgaggggtccgtacggggtaaccgtagggaccgtaacggccgtaaccgtccggaccccggtagttacggtttaccgggtccgtttaaccggggtaaccgttaccgggggaaccccgttaacgggttaccccgtaaccccggtttacccgttaaacggtcccgtaaaccccggg

SEQ ID NO: 240062 - DNA, 535 bp, Homo sapiens
  misc_feature: GYAE6OF02FUO96.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggccccctgtgctggtcgtctatgttgatagcgaccggccctcagggatccctgagcgattctcgggctccaactctggaacacggccactctgaccatcagtagggtcgaagccgggatggaggccgactattactgtcaggtgtgggatagtagtcgtgagcagtgtggtattcggcggagggaccaaacgtgaccgtctaggtcacggcccaaggctcgcccccgtcggtccactctcgttcccaccctcctaccg

SEQ ID NO: 240063 - DNA, 448 bp, Homo sapiens
  misc_feature: GYAE6OF02HRFFY.13.77.G11.1.454.CMB.1.raw
  modified_base (439)..(440): a, c, t, g, unknown or other
  misc_feature (439)..(440): n is a, c, g, or t
  modified_base (442)..(448): a, c, t, g, unknown or other
  misc_feature (442)..(448): n is a, c, g, or t
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagaggccccgaaagaggaaagtggctacgatttgggaagtactactacatggacgtctggggcaaagggaccacggtcaccgtctcctcagcttccaccaaggcccatcggtcttccccctggccgccctgcctccaggagcacctctgggggcacagcggccctgggctgcctggtcaaggactacttcctagtacgtgactgagcgggctggcaaggcgcatgnngnnnnnnn

SEQ ID NO: 240064 - DNA, 756 bp, Homo sapiens
  misc_feature: GYAE6OF02F84BT.13.77.G11.1.454.CMB.1.raw
  modified_base (298)..(298): a, c, t, g, unknown or other
  misc_feature (298)..(298): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacagacggccaggattaccgtggtagggggaaacaacagttaggaaagtaaaagtgtgacacgtggtaccagcaagaagccaggccacggcccctggngctgatcgtctatgttgatagccgaccggccctgacgggtactcccgtgacgtcgtagttccgtcgggcctaccaactcgtacggggaacacggcctaccgtcgcgaaccctataccgaaggtacggggtaccggaaacgggtccggggaatcgggacggtacccggtaacttacgttaaccgtggtaccgtaggggttaggtaggggtaacttaggttacggttcggtaggaacggtcgtaaggtttgggttaggtttacgggttacccggggacggggtaaaccggtaaacccgttaaaaccggtccgggttaaccccggttaccggttaacggggtaccgtaaacccggtaaccccggtaaagggtcccccgtacccggtacccccccggttacgggttacccctaaccggtttcccgtttccccgggttccccccgtaccccccgtttacccgg

SEQ ID NO: 240065 - DNA, 585 bp, Homo sapiens
  misc_feature: GYAE6OF02G3TP0.13.77.G11.1.454.CMB.1.raw
  modified_base (462)..(462): a, c, t, g, unknown or other
  misc_feature (462)..(462): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtgggggaaacaacattggaagtaaaagtgtgcactggtaccagcagaagccaggccaggccccctgtgctggtcgtctatgttgatagcgaccggccctcgagggactccctgacgcgattcgcgggcctccgaactcgtacgggaacacggccactctacgaccatcgaggtacgggtacgaaggcggggatggacggccgacttattacgtgtcgaggtggtgggtagtagtagtcgtgngcagtgtaggtgttcgggcggagggaacctaaacgtcgaccgtcctaggtccacggcccgaacggtcctaccggcccccgttcggtcctaccgttccttccggttcccctaccctccttaccg

SEQ ID NO: 240066 - DNA, 542 bp, Homo sapiens
  misc_feature: GYAE6OF02FI76C.13.77.G11.1.454.CMB.1.raw
  modified_base (445)..(445): a, c, t, g, unknown or other
  misc_feature (445)..(445): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggcctcagggatccctgagcgattctcgggctccaactcgtgggaacacggccactctgaccatcagtacgggtcgaaggccggggatggaggccgactattactgtcagggtgtgggataggtagtcgtgagnatgtggtattgggcggagggaccaaacgtgaccgtcctaggtcacgcccaaggcctcgcccccgtggtcacgttcctcgttccccgccctcctaccg

SEQ ID NO: 240067 - DNA, 659 bp, Homo sapiens
  misc_feature: GYAE6OF02FWHYW.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattaggaagtaaaagtgtgcactggtaccagcagaagccaggccaggcccctgtgctggtcgtctatgttgatagcgaccggcctcgagggactccctgagcgattcgtcgggctccaactcgtgggaacacggccactctcgaccatcgagtacgggtacgaaggccggggatggacggccgacttacgttacgtgtacgagggttggtagggattaggtagtcgtaggagctagtcggttggtacgtttcggggcgggtaacggggaaccctaaacggttcggtaacccggttaccggttacgggtccgaacgggtaccccgtaaacgggtcccgttacccggtacccccccgttacgggttacccctaccggtttccccgttacccggtttaccccccctacccccgttcccgtttaaccccgg

SEQ ID NO: 240068 - DNA, 844 bp, Homo sapiens
  misc_feature: GYAE6OF02J3ET6.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcacgccaccctcggtgtcagtggcccccaggacaggaccggccagggtattacccgtggtacgggggaaaaccaacgtatttagggaaacgttaaaaggtgttgacctacgtcggtaccagccgaagaacgccgaacggcccgaacggcccccgttggtcggcctcgggttacgtcgttagtggttagagttacgccggaacccggcccctacggacgggtactcccgtggacgtcgtacttccggtcgggacctaccgtaactcggtacgggtaacccaccgggtccctacgtccgacggtaacccacggttaccgaacgggtttaacggggtaccgggaaacggggtcccgggggtaagttacgggaaccgggtacccggttaaacgtttaacgtttaaccggttcggtaaccggttaggggttaggtaccggggtaagtttacggttaacggttcggttacggacggtacgtagtttacgggttagggtttacgggttaccggggaccgggtaaacgggttaaacccgaaaccggttaccgttacccgggtaccggtttacggtacccggtaaccggtaacccggtaccgggtacgttccccggaccccggttcccgtaccgtacccgttccgttacccgtttcccccgtacccgtttacccggttacccgg

SEQ ID NO: 240069 - DNA, 421 bp, Homo sapiens
  misc_feature: GYAE6OF02GWPYY.13.77.G11.1.454.CMB.1.raw
  modified_base (312)..(312): a, c, t, g, unknown or other
  misc_feature (312)..(312): n is a, c, g, or t
  modified_base (315)..(315): a, c, t, g, unknown or other
  misc_feature (315)..(315): n is a, c, g, or t
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (374)..(374): a, c, t, g, unknown or other
  misc_feature (374)..(374): n is a, c, g, or t
  modified_base (406)..(421): a, c, t, g, unknown or other
  misc_feature (406)..(421): n is a, c, g, or t
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactactggggccagggaacccctggtcaccgtctcctcaccctccacacggccatcgtcctcccngcncctctcagngcactcgngggcacngccgcctggctgcctgtcaaggctctcctagtcgngactgaggcggtctgggcaagggccagaatgnnnnnnnnnnnnnnnn

SEQ ID NO: 240070 - DNA, 440 bp, Homo sapiens
  misc_feature: GYAE6OF02I1BSR.13.77.G11.1.454.CMB.1.raw
  modified_base (413)..(413): a, c, t, g, unknown or other
  misc_feature (413)..(413): n is a, c, g, or t
  modified_base (430)..(440): a, c, t, g, unknown or other
  misc_feature (430)..(440): n is a, c, g, or t
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagtttctccctgaagctgagctctgtgactgccgcggacacggccgtatattactgtgcgagagtcggaggttacggtgactatcagcagtttgactacgtggggccagggaacctggtcaccgtctcctccaccctccaccaaggcccatcggtccttcccctggccaccctcctccaagacgcacctcgtggggcacgagcggccctgggcctgcctggtcaaggaccttacttccgtagtacgtgctgagcgggcncggcgaacggcgcatgnnnnnnnnnnn

SEQ ID NO: 240071 - DNA, 688 bp, Homo sapiens
  misc_feature: GYAE6OF02F5RAX.13.77.G11.1.454.CMB.1.raw
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtagcactggtaccagcagaagccaggccaggcccctgtgctggtctntatgttnatagcgaccggccctgagggactcccngagcgtattccgcgggctccgaactcgtaggaaccacggccactctacgaccatcgagtacgggtacgaacggccggggatacgggacgggtaccgtaacgttaacgttaccgtaggtacgtagggttcggttaggggtagttaggttacgggttcgtaggaggtccgtaagttgggttacggttaacggtttaccgggacggggtaacggggtaaccctaaacggtccggtaacccggttaccgttagggtccgaaccggtacccggtaacgggtccctacccgggtccccccgttacgggttaccgtaacccgttccggttacccgtttacccccgtacccgttcccgttaacccgg

SEQ ID NO: 240072 - DNA, 838 bp, Homo sapiens
  misc_feature: GYAE6OF02HVIK3.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctggtagggggaaacaacattaggaaagtaaaagtgtagcacgtggtaccagcagaagccaggccacggcccctgtgctggtcgtctatgttgataggcgaccgcctcgagggtactcccgtgacggcgtaattccgtcggggtcctacccgtaaaccgttcgtacgggggaaacctaccggggaccctaaccttccgttaccgaaccctaacgttccgtaaaggggttaccgggggttaaccggaaacggggtaccccgggggggtaattacgggggtaaaccgggtaccccggtaaaccgttttaacgtttaaccgttagggttaccggtaagggttagggttaacggggttaagttaagggtttaggttacgggtaggaggtacgtagtttacggggttagggttaacgtttcgggggaccgggggtaaaccgggaacccggtaaaacgttccgggaaccccggttacccgggtttaacgggtcccggtaaccggaccccggtaaacggggtacccctcccgggtccccccccggtttaaccgggttaccccgtacccgtttccccggttaccccggttttacccccccgtacccccgttaccccgttttaaccccgg

SEQ ID NO: 240073 - DNA, 709 bp, Homo sapiens
  misc_feature: GYAE6OF02ISEYP.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacattaggaaagtaaaagtgtgcactggtaccagcagaagccaggccaggcccctgtgctggtcgtctagtgttagataggccgaccggcccctgagggactcccgtgagcgtattcgtcgggctcaactcgtacgggaactcgaacgcctactccgtacgaacccagtccgacggtccgggaaccctagggacttacgtagggaacttacgggacggtcgttacggtaacttaacgtttaaccgtaggttaccgaacggggtccgggttaacggggaacaacgggaccgtaacgggacccgtaaccgtccggtaccccggtacttaacgttccggttacggtttacccgggaaacgttccgggaaacccgtaagggttcccggaaacccgttaccgttaaacgggtaccgacccggtaaccccgtaaacgggaccccctaaacccgtaccgtaccggttacctaacgtttccccgg

SEQ ID NO: 240074 - DNA, 636 bp, Homo sapiens
  misc_feature: GYAE6OF02HZJ2P.13.77.G11.1.454.CMB.1.raw
  modified_base (300)..(300): a, c, t, g, unknown or other
  misc_feature (300)..(300): n is a, c, g, or t
  modified_base (397)..(397): a, c, t, g, unknown or other
  misc_feature (397)..(397): n is a, c, g, or t
  modified_base (454)..(454): a, c, t, g, unknown or other
  misc_feature (454)..(454): n is a, c, g, or t
tcagtcacgtactacacgaccggtgctcgatttagctagtcactcaagggaaaggggtgtctgggcctaaggaagcagcactggtggtgcctcagccatggcctggaccgttctctcctcggcctcctctctcactgcacaggctctgtgacctcctatgtgctgactcagccaccctcggtgtcaggtcggccccaggacaggacggccgaggacttaccgtggtagggggaaacaacattagggaaagtaaaagtgtgacacgtggtaccagcaagaacgccaggccacggcccctgngcgtggtcatctatacgaagatcgccaagccggaccctcgaacgggactcccgtgacgcgtattcctcgtcggcctaccgacttacgtgggtaaccncgaacgccctacttctacgaccatcgacggcccggaccaaggctaagtggagtcggnggctagtaacttagttaacgtcgtacgaggtcggtagggacagacgacgacgaccgtcgccccgtatccgttgtaccgttacgggaaccgttacggggaacccgtacgggttaccctaacccggttaccgaacgtcccgaaccggtaccccgaaaccgggcccctaacccccgtagtacccg

SEQ ID NO: 240075 - DNA, 704 bp, Homo sapiens
  misc_feature: GYAE6OF02GUL2X.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattaccgtggtgggggaaacaacagttaggaaagtaaaagtgtgcactggtaccagcagaagccaggccaggcccctgtgctggtctctatgttgatagccgaccggccctcgagggactcccgtgaggcgattcgtcgggtcctaccgactcgtacgggaacctaccgggacctaccgtcgtacgaaccctacgtaccgtacggcggtacggggtacggaaacgggtcccggggtaagtacgggaccggtacccgtaacgtttacgtttccgtcggtaccgtagggttcgggtacgggtaactaaggttaaacgtaggtcgtagttacggtaagggttttcgggtttccgggacgggtaccgggaccgtaaggtccgttaacggacccggttaccgtacggtacgaccggtacccggaacggtcctcccggtccccgttcggtacctccgttcccgttacccggttaccccctacccgtttccttaacccgg

SEQ ID NO: 240076 - DNA, 659 bp, Homo sapiens
  misc_feature: GYAE6OF02GI9VO.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtcgctggtctctatgttgatagccgaccggccctcagggactcccgtgacgcgacttcgtcgggctccgaactcgtagggaacacggccactctgaccatacgaggtacgggtcgaaacggccggggaatcgggacggcccgtaacttacgttaacgtcggtaccgagggttacggttagggtaagttaaggttacggttcggtaggtacgaccgtaagtcgggttagggttacgtttcgggacggggtaacgggaaccgtaaacgttcggacccgttccgtacgggtccgaacggtccccgaaagggtcctaccggtcccccgtacggtaccgtaccgttccgttccggttcccccgtcccgttccttacccgg

SEQ ID NO: 240077 - DNA, 616 bp, Homo sapiens
  misc_feature: GYAE6OF02HA6GW.13.77.G11.1.454.CMB.1.raw
  modified_base (298)..(298): a, c, t, g, unknown or other
  misc_feature (298)..(298): n is a, c, g, or t
  modified_base (483)..(483): a, c, t, g, unknown or other
  misc_feature (483)..(483): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggacttaccgtggtagggggaaacaacagttaggaaagtaaaagtggtagacacgtggtaccagcaagaagccaggccaggcccctgngctggtctctatgtgataggccgtaccggccctgacgggactcccgtggagccgtacttcgtcgggctacccaactcgtacgggaaccacggcctactcgtcgacctatcgagggtacgggtcggaacggccgggatcgggagccgtactagtactggtacaggtggtaggagttaggtggtcgngtagctagtggtggtagtcgggacgggtaacggactaaacgtgacccgtacgtacggtcacggacccgaacggtccgtaccggcccccgtcggtacctaccgtccttccggttcccccgtccctccgttaccg

SEQ ID NO: 240078 - DNA, 647 bp, Homo sapiens
  misc_feature: GYAE6OF02ISBTU.13.77.G11.1.454.CMB.1.raw
  modified_base (160)..(160): a, c, t, g, unknown or other
  misc_feature (160)..(160): n is a, c, g, or t
  modified_base (302)..(302): a, c, t, g, unknown or other
  misc_feature (302)..(302): n is a, c, g, or t
  modified_base (316)..(316): a, c, t, g, unknown or other
  misc_feature (316)..(316): n is a, c, g, or t
  modified_base (351)..(351): a, c, t, g, unknown or other
  misc_feature (351)..(351): n is a, c, g, or t
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
  modified_base (449)..(449): a, c, t, g, unknown or other
  misc_feature (449)..(449): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctangtgctgactcagcccaccctcggtgcagtcggcccaggacaggacggccaggattaccgtggtaggggaaacaacagttaggaaagtaaaagtgtgacaacttaggaccagacaagaacgccaaggccagccccgttgcgcnggtcgtctagtgtnagtagcgaccggtcctacgacggactcccgtgacncgaactcgttcgggactccaaacttcgagggaaacacgaccgacnctacgacctanacgtacggccgggacccagacgtaagnggtagtggaacggtntcgtaactaagttactacggttcgacggtcggtagggaacgacgacgacgtccgaacttcggcccctacgttagttaccgtacttaccggtaacgtacggaaaccgtaggtacccgtaaccggtacccttaagtccgaacccgttacccgaaacggttccccaaacccggaacctacgttaccacctcgttaccccgg

SEQ ID NO: 240079 - DNA, 632 bp, Homo sapiens
  misc_feature: GYAE6OF02IFHII.13.77.G11.1.454.CMB.1.raw
  modified_base (338)..(338): a, c, t, g, unknown or other
  misc_feature (338)..(338): n is a, c, g, or t
  modified_base (494)..(494): a, c, t, g, unknown or other
  misc_feature (494)..(494): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacgattaggaagttaaaagtgtgcactaggtaccagcagaacgccaggccaggcccctgtcgctggtcgtctatggttgatgcgaccggcctcgagggactcccgngacgcgtattcgcgggcctacccaacgtcgtacgggaacctacggccactctacgaccataccgaaggtacgggtacgacgggccggggtatcgggacggcccgtattagttacgtcggtcgtagggttggtagggtattacggtagttcggtagngacagttgggtggtacgttcggggagggtacggaacctaaacggtcgaccggtacgtaggtaccgacgtaccgacggtcctcccgtccccgtacggtactacccgttccgttaccgttccccgtccccttccgtaccg

SEQ ID NO: 240080 - DNA, 497 bp, Homo sapiens
  misc_feature: GYAE6OF02H22ZV.13.77.G11.1.454.CMB.1.raw
  modified_base (147)..(147): a, c, t, g, unknown or other
  misc_feature (147)..(147): n is a, c, g, or t
  modified_base (292)..(292): a, c, t, g, unknown or other
  misc_feature (292)..(292): n is a, c, g, or t
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (455)..(456): a, c, t, g, unknown or other
  misc_feature (455)..(456): n is a, c, g, or t
  modified_base (459)..(497): a, c, t, g, unknown or other
  misc_feature (459)..(497): n is a, c, g, or t
tcagtcacgtactacacgaccggtgctcgatttagctagtcactcaagggaaagggccgtggagtggattgggtacatccattacagtgggaccacctactacaacccgtccctcaggagtcgacttaccatatcagtagacacgtntaagaaccagttctccctgaagctgagctctgtgactgccgcggacacggccgtatattactgtgcgagagtcggagggttacgtgactatcagcagttttgacttacgtggggccaggggaccctgggtcaccggtcttcctcnccctccaccaagggccccatcggtccttccccctggcnccctcctccaagngccacctctgggggccacacgcggcccctgggctgcctcggtcaaggctacctttcctagttcgtagactagacggcgggccttgggacgaagggccgtacgacttaggcanncgnnnnnnnnnnnnnnnnnnnnnnnnnnnnnnnnnnnnnnn

SEQ ID NO: 240081 - DNA, 746 bp, Homo sapiens
  misc_feature: GYAE6OF02IQ85C.13.77.G11.1.454.CMB.1.raw
  modified_base (359)..(359): a, c, t, g, unknown or other
  misc_feature (359)..(359): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcacgccaccctcggtgtcagtcggccccaggacagacggccaggacttacctggtagggggaaacaacagttaggaaacgttaaaagtgtgcacgtggtaaccagcaaggaagccgaggcccaacggccccctagtgctggtcgtctagtcgttgatacgccggaccggcccttacgagggacttcccgngtacgacgtactttccgcgggtcctaccgaccgttacgtacgggaacccaacgggcctaaccgtcgtacgacccacgttaccggaccggtaccggggaaccccgtagggtaccgtttaacggtgggtaaccgttagggaaccgggtacgttacggtaaacgtttaccgtttaaccgttcgggttacccgtaagggggtcccggggttagggaccgtacggaccgacggttaccgacccgttacgggtcccgtacgttacgttaaccggtttccggttaccgggtaaacgtaccggggaaccgtaccggtacccgtaccggtacccgttaacgaccgtaccgacccgaacgacccctaccctacgtctaccgtaccttaccgtcccgg

SEQ ID NO: 240082 - DNA, 759 bp, Homo sapiens
  misc_feature: GYAE6OF02JZ10R.13.77.G11.1.454.CMB.1.raw
  modified_base (686)..(686): a, c, t, g, unknown or other
  misc_feature (686)..(686): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacaggacggccgaggacttaccgtggtaggggaaacaacgtagttaggaaagtaaaagtgtagacacgtcggtaccagcaagacgccaggccgacggcccctgtgcgtggtacctcgttagtcggttagagttacggccggtaccccggtcctacggaggggtacctccccggtaggtacgaccggtactttccggtcccggggtaccttaccccgtaacggttcgggtaaccggggaaaccctaccgggaccctaaccggttactacccgaaacctaccggtacgtaacggggtttaccggggtaacggaaccggggaccggggtagtacgggaccggtaacccgtaattaacgttcgacggttacggagggttggtaagggtaagttacggtacggtcgtacggtaggcttaacggttggtaacggtttcgttacggggcggtaaacggggtaccctaaacggtcggtaaccgtcggttaacgngtaacccggtaccggtaacgtcgtaccccgtcccgtagcttaaccgtccgtacctcccgtacctcgttaacgg

SEQ ID NO: 240083 - DNA, 922 bp, Homo sapiens
  misc_feature: GYAE6OF02H1OOV.13.77.G11.1.454.CMB.1.raw
  modified_base (733)..(733): a, c, t, g, unknown or other
  misc_feature (733)..(733): n is a, c, g, or t
tcagtcacgtactacacgaccggtgctcgatttagctagtcactcaagggaaaggggtgtctgggcctaaggaagcagcactggtggtgcctcagccatggcctggaccgttctcctccctcggccttcctctctcactgcacaggccttctgtcgaccctcctatgtgctacgactcacgccctaccccgttcgggtcgtacgaacggttccgggacccccgaagggaaccgaacgggaacccgggacccgtaaggggttaaccgttttaaccggtaggggggttaaacgggggggtaaaaaacctaaacggttaaggtttaagggggtaaaaaaggttaaaaagggtggttaaccgacgtaaccgttacgggtaacccaaggaccgaaggaaaccgccggacggacccgaccgggtccccgtagggtcgaccggttcgggttacgttacgttacgtttggttacggtaacggtaccgggacccggtaacccggtcccgtaaccgggaacgggtaccttacccggtaaggacggtaaccggttacgtttccggccggtaccctacgtaaccgtacggtaacggaccgaccggtacctacgtcgtacgtaaccactacggacgggtaacgggtacgaaagggccgggtaatacggggaccgtaacgtaaccttagttacggtaccggtaggaagggtaggttacggtagttacgtaggttcgacggtaacgtnttaggttagggtcggttacgggtccgggaaccggggttaacaaacccggtaacgtcccggttaaccggtacccggttagtacccggaccgggtaaacccggtaccggtcccgttaccccgtaccccggtacggtttaccaccccggtttcggtccccggtttaccccctccgtttaccggttaaccggg

SEQ ID NO: 240084 - DNA, 841 bp, Homo sapiens
  misc_feature: GYAE6OF02HGQDU.13.77.G11.1.454.CMB.1.raw
tcagtcacgtactacacgaccggtgctcgatttagctagtcactcaagggaaggggtgtctgggcctaaggagcagcactggtgtgcctcagccatggcctggaccgttctccgtcctcggcctcctctctcgactgcacaggctctgtgacctcgtatcgtgctgactcagccacccgttggtcgtcgacgtcggcccctaggacaggacggccaggtactaccgtgtacggggaaaacctacgacgttacgggaagttaaaacgttcgtaggtaccacgtacggtaacccgagtaccgtaaggaacgtccgaagggtccgaacggtccccgtagtacggccgtagggttcctacgttaatacggttcgtaattacggaccggtaacccgtccctcggaacgggtaaccgtcccgttaggaacggtacgtaacgtttaccggtccggggtacctacccgtaaacggttcgtaacgggtaaccaaccggggtccctagtccgtacgtaacctacgttaccggtacgggttccggaacctacggggtaccaacgttgggaacgtacgtaacggccttaaggtaccttaaggtaccgttacggtaaccgtacgggtaaccggttacggaaccggttaccgtacgtcgtaacccgttagtcccggtacccgggtacttaacggtttaccgttacgggtttaacccggaaacgggtttccgggaacccgttaccgggttactaccccggtttaacggtaacggtccccgtaaggtacccccgtaaggtaccccgtaaaccccgtaccgttacggtttaacccgtaccgttaccgtttacccccgg

SEQ ID NO: 240085 - DNA, 946 bp, Homo sapiens
  misc_feature: GYAE6OF02JSFPA.13.77.G11.1.454.CMB.1.raw
  modified_base (166)..(166): a, c, t, g, unknown or other
  misc_feature (166)..(166): n is a, c, g, or t
  modified_base (884)..(884): a, c, t, g, unknown or other
  misc_feature (884)..(884): n is a, c, g, or t
tcagtcacgtactacacgaccggtgctcgatttagctagtcactcaagggaaaggggtgtctgggcctaaggaagcagcactggtggtgcctcagccatggcctggacccgttctcctcctcggccctcctctctcactgcacgacggctctgtcgacccttcctntgtcgtctgacctcgacgccctacccgttcgggtcgtaccgcggtccggaccccgaaggaccgacggaccgggtaccgaacggtacgtttaccgtacggggtaacgggggtaaaccctaacggttaacgttaacgggtaaaacggttaaaaggttcggttcgaaccgtacggtttacggaacccggaagtacggaacggtaaccggaccggaaccggacccgaacccgggtcccgttcggttccggtccggttacggttccggttactggttaccggttaggaccggttaccggcccggtacccggtacccggtaccggtacgtacccgtcccgtaacgggctacggttaccggttccggtaccggtaccctacggtaacccgttacgggaaccggacccgtaacccgggtaccctaccgttgaaccgttacccttaaggtacccggttaacggggtacgggtacggacccgggggtaaggtaccgacgggttaacccggacgttaaacgttcgtaacgggttccggtaaggggtttacgggtccggtaagggttttcccgaagggtttccgggtacgttaaacgcggttggtacgttacgggttggacccgtaggggacggttaaccgtaaccgtacccggtaccgtaacccggttgtacggtacccgtcccggggaaatcccgggtacccggttcccccggccccgggtttaaacnccgttttacccgccccgggtttacccccgttaccccgggttacccgtccgtttaaacccggg

SEQ ID NO: 240086 - DNA, 948 bp, Homo sapiens
  misc_feature: GYAE6OF02HOZH0.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggcctcctcgtctcactgcacaggctctgtgacctcctagtgtgctgactcacgcctacccgtcggtgtacagtcggccccgaggaccacggaccggccaggacttaccgtagggtacgggggaaacaacgtagttaggtaaacggttaaaaggtgtcgtacgaccgttacgggtaaccacggtacgaacggaacggcccgacggaccccgacgggtcccccgttaggtaccggtccggttggggttacccgttacctttaggtttacggttacggttaacgttacgggaccccggtacccccgggtacccccgttacgggaaccggggtacccttccccggttaggaccggttaccggttaacgtttacccggtcccgggtacccttacccgtaaccggtttacccggtacgggggaacccggtacccgggaccctaccgttcccgttaaccggtaacccgtaacggtccggttaaggggttaaccgggggtcgaaaccgggggtccggggttaagtaccggggacggtaccccggttaaatttccggtttaacgttccgggttacgtagggggttacggttacgggttaaggtttcgggttacgggttccgggtaggaaccggtagttacgggtaggttttacgggttaggttccggggaaccggtaacggggaacccttaaacggtcccggtaccgttaccgggttacggtacccggtaccgtaaccgggtaaccggtcccgtacccccgggttccccggtacgttacccgtcccgtttaacccgttcccggtttcccccctacggttttacccggttacccgg

SEQ ID NO: 240087 - DNA, 690 bp, Homo sapiens
  misc_feature: GYAE6OF02GGF00.13.77.G11.1.454.CMB.1.raw
  modified_base (289)..(289): a, c, t, g, unknown or other
  misc_feature (289)..(289): n is a, c, g, or t
tcagtcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagaccggccacaattccctgtgaggaacaaccttagagtcagatcgtcacgtggtaccagcagagtcaggccaggcccctgtggtgcntactatacgagatcgtaccaacggccgtcccgtacgacggactcctaggacgtcgtacttctacgtcggacctaccgaaccttccggtacggtaccttcgacgaccctactcgtaccgacctacaccgtaacggacccggtaacccgtacggtacgttagacggtacgtcggacggtctaggtacctttaagtttccacgtcgggtagggtacgggtacggacgaccggtacgacgccgacgtccgggtcccctagtttagtcccggtttaccgttacggtaaccggtaccgggaaccggttaacgggtacccccgttaccggttaacccgttaacggtcccgtaacccggtaaacccccgtacccgggaacccccttaaccccggaccggtttaacccgg

SEQ ID NO: 240088 - DNA, 696 bp, Homo sapiens
  misc_feature: GYAE6OF02JSDM8.13.77.G11.1.454.CMB.1.raw
  modified_base (195)..(195): a, c, t, g, unknown or other
  misc_feature (195)..(195): n is a, c, g, or t
  modified_base (210)..(210): a, c, t, g, unknown or other
  misc_feature (210)..(210): n is a, c, g, or t
  modified_base (615)..(615): a, c, t, g, unknown or other
  misc_feature (615)..(615): n is a, c, g, or t
  modified_base (625)..(625): a, c, t, g, unknown or other
  misc_feature (625)..(625): n is a, c, g, or t
  modified_base (628)..(628): a, c, t, g, unknown or other
  misc_feature (628)..(628): n is a, c, g, or t
  modified_base (650)..(650): a, c, t, g, unknown or other
  misc_feature (650)..(650): n is a, c, g, or t
  modified_base (662)..(662): a, c, t, g, unknown or other
  misc_feature (662)..(662): n is a, c, g, or t
  modified_base (692)..(692): a, c, t, g, unknown or other
  misc_feature (692)..(692): n is a, c, g, or t
tcagtcacgtactacacgaccggtgctcgatttagctagtcactcaaggaaagggcctggagtggattgggtacatccattacagtgggaccacctactacaacccgtccctcacggagtcgacttaccatatcacgtagacacgtctaagaaccagttctcctgaagcctgagctcgtgtgactgccgcggacncggccgtatattacngtcgcgagagtcggaggttacgtgacttatcgagtcgtagtttacgaccttaacgtcgggggtaccaagggtaaccccgttgggtacctaccggtctccttaccgacccctacgaacccgagggtcccctagttccggtcccttaccccggtgacccgtcccctactaccgaaacgcgtccaaccgtcgggtccgggaccaacgtcgggtaccccgggtccgttgggtcccttaccggcccggtttaacgggtaaccaaaagggtcccccttttacgtttaacccggtacggtaccggttcggaacgtcggggaacccgggtcgggggtaccctaggggacccgtaacggacccgtacgttaaacggtcggctaacggctagacgtcacgcgttcgccgaagtgngcgacgacgngcncgacgcgtacgcgcacacgacncgtcgcgcgcanacagtacgcgacgacgacgacgacgtacgngtcg

SEQ ID NO: 240089 - DNA, 840 bp, Homo sapiens
  misc_feature: GYAE6OF02GOYOJ.13.77.G11.1.454.CMB.1.raw
tcagtcacgtactacacgaccggtgctcgatttagctagtcactcaagggaaaggggtgtctgggcctaaggaagcagcactggtggtgcctcagccatggcctggaccgttctcctcctcggccctcctctctcactcgcacaggctctgtcgacctcctatgtgctgacctcacgccctacccgttcggtgtacaggtccggaccccaggacaggaccggaccagggacttaccgtagggtacggggaaaaccaacgtagttaggaaagtaaaggtgtacgacgtacgtacggtaccagacgaagaacgcctacggacccgacggccccgttgcgtcgttcggtactattagtagttgataccggccggtacccggtccacgacgggtacctccgtaggacgtcgtacgttccggcggtacctacctacgtcggaacggaacaccggtcctacgttcgaacgacctaggtacgtagggtacgggtacggaaccggggtacgggaacgtcgggaacggtcccttaacggttacgttacggtagttacggtaggggtaccggttagggtaacgttacggttacgggtcgtagggtaactcggttaaaggttcgggttcgggttaaacggttccgggggaaccggtaaacccgggtaaacccgttaaaccggtaaccccgggttccgtttaacccggggtaaacgggttccccgaaaccgggtaaccccggtaacggggttccccgttaacccccgggttcccccgtttaacggtcccccgttaaccgtttcccccggttaccccccggttccccggttaccccctttagtttaacccggg

SEQ ID NO: 240090 - DNA, 673 bp, Homo sapiens
  misc_feature: GYAE6OF02JN1G5.13.77.G11.1.454.CMB.1.raw
  modified_base (185)..(185): a, c, t, g, unknown or other
  misc_feature (185)..(185): n is a, c, g, or t
  modified_base (349)..(349): a, c, t, g, unknown or other
  misc_feature (349)..(349): n is a, c, g, or t
  modified_base (434)..(434): a, c, t, g, unknown or other
  misc_feature (434)..(434): n is a, c, g, or t
  modified_base (463)..(463): a, c, t, g, unknown or other
  misc_feature (463)..(463): n is a, c, g, or t
tcagtcacgtactacacgaccggtgctcgatttagctagtcactcaagggaaaggggtgtctgggcctcaggaagcagcatcggaggtgcctcagccatggcatggactccctctcttcctcggcgtccttgtcttatgcacgaggtctccggtgcctctatgagctgactcacgcctaccctgngtcgtccgtctaccccgaggacacgacgacgccagacatccactcgtactcgtaaaggtaaacttaaggtgtactaagaattaatacgtttactccgtagtactgatacgatagtccgaacgtccacgtccgtgtcgtctacggtatacctactagtactaagntaccgacgtaacggccgaaccggtcgacggtaccgtccgagtcgtacgtcttacggctcgtacctcgtacgtacggtcgtaaccnccgacgtaccgtaccgtacgtaccgtacnccgtacggaaccggtccgtaccggacggtactaacgggtcgaagtcggacgtcgtacgttactacgtactgggtacggcggtacggtacgggaccgaggtccgacgtacccgtcgtacccgtaccgtcgtaccggttccgtaacgttaccggtaaccggttaccgtaccggtacccgttaccggtacccgttacggtaaccggtacccgg

SEQ ID NO: 240091 - DNA, 257 bp, Homo sapiens
  misc_feature: GYAE6OF01B1ZC7.45.35.D02.1.454.CMB.1.raw
  modified_base (253)..(257): a, c, t, g, unknown or other
  misc_feature (253)..(257): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgccatctgatcgatcgcgtctgagcgggctggcaaggcgcatagnnnnn

SEQ ID NO: 240092 - DNA, 506 bp, Homo sapiens
  misc_feature: GYAE6OF01A3PP3.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttgcacagacttcactctcacaatcagcagcctccaacctgaagtattttgcagtctattactgtcaacagcgtacagtattggccgtctctacgtttcggcggtacgggaccaagggtggagatacaaacggaactgtaggctgcaccatcgtgtc

SEQ ID NO: 240093 - DNA, 276 bp, Homo sapiens
  misc_feature: GYAE6OF01EWV19.45.35.D02.1.454.CMB.1.raw
  modified_base (253)..(276): a, c, t, g, unknown or other
  misc_feature (253)..(276): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgccatctgatcgatcgcgtctgagcgggctggcaaggcgcatagnnnnnnnnnnnnnnnnnnnnnnnn

SEQ ID NO: 240094 - DNA, 514 bp, Homo sapiens
  misc_feature: GYAE6OF01BYVVV.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttggcacgagacttcactctcacaatcagcagcctccaacctgaagattttgctagtctattactgtacaacagcgtaacagtattggccgtctccactttcggcggtaagggaccgaaggtggagacgtacaaacggaactggtaggctgacaccatcgtgttcc

SEQ ID NO: 240095 - DNA, 255 bp, Homo sapiens
  misc_feature: GYAE6OF01B0L5B.45.35.D02.1.454.CMB.1.raw
  modified_base (253)..(255): a, c, t, g, unknown or other
  misc_feature (253)..(255): n is a, c, g, or t
tcagacgcgatcgacacgaccggtgctcgatttagcacacgatagttgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgccatctgatcgatcgcgtctgagcgggctggcaaggcgcatagnnn

SEQ ID NO: 240096 - DNA, 568 bp, Homo sapiens
  misc_feature: GYAE6OF01A79P5.45.35.D02.1.454.CMB.1.raw
  modified_base (203)..(203): a, c, t, g, unknown or other
  misc_feature (203)..(203): n is a, c, g, or t
tcagacgcgatcgacacgaccggtgctcgatttagcacacgatagttggggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggcctggtatcaaatacaagcctggcctagggtccccgctcctcatctatgatcgcttcagcgacgggccatggcactcccagccaggttcaggtggcggtgggttcgcacagactttcgactcacactatcagcacgcctaccaactgaagtatttgactagtcttattactgtactaacgagtcgtacagtacgttcgaccgtacttcgtacgtttacgggacgggaacggtaccgtaaagggtggaacgtacgtaaccggaaacggtaacgtcggtacggccgtacggacctaaccgtattccggttgttacccg

SEQ ID NO: 240097 - DNA, 255 bp, Homo sapiens
  misc_feature: GYAE6OF01D91B6.45.35.D02.1.454.CMB.1.raw
  modified_base (253)..(255): a, c, t, g, unknown or other
  misc_feature (253)..(255): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgccatctgatcgatcgcgtctgagcgggctggcaaggcgcatagnnn

SEQ ID NO: 240098 - DNA, 257 bp, Homo sapiens
  misc_feature: GYAE6OF01DEC0V.45.35.D02.1.454.CMB.1.raw
  modified_base (247)..(257): a, c, t, g, unknown or other
  misc_feature (247)..(257): n is a, c, g, or t
tcagacgcgatcgacacgaccggtgctcgatttagcacacgataggtgggttggcacagacttcactctcacaatcagcagcctccaacctgaagatttgcagtctattactgtcaacagcgtacagattggccgctcactttcggcggagggaccaaggtggagatcaaacgaactgtggctgcaccatctgctcatctcccgcatctgatcgatcgcgtctgagcgggctggcaaggcgcatagnnnnnnnnnnn

SEQ ID NO: 240099 - DNA, 496 bp, Homo sapiens
  misc_feature: GYAE6OF01CUS2S.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccactggcatcccagccaggttcagtggcggtggtttgcacagacttcactctcacatcagcagcctccaacctgaagtatttgctagtctattactgtacaacagcgtacagtattcggccgtctctactttcggcggaggaccgaaggtggagatacaaacgactgtgctgacacatcgtgtc

SEQ ID NO: 240100 - DNA, 509 bp, Homo sapiens
  misc_feature: GYAE6OF01DG6VG.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttggcacagcttcactctcacatcagcagcctccaaccctgaagtatttgctagtctattactgtcaacagcgtaacagattcgggccgtcttcaccgtttcggacggacgggaccaagggtggagatacaaacgactgtggctgacaccatcgttgtcc

SEQ ID NO: 240101 - DNA, 530 bp, Homo sapiens
  misc_feature: GYAE6OF01ANERT.45.35.D02.1.454.CMB.1.raw
  modified_base (201)..(201): a, c, t, g, unknown or other
  misc_feature (201)..(201): n is a, c, g, or t
  modified_base (355)..(355): a, c, t, g, unknown or other
  misc_feature (355)..(355): n is a, c, g, or t
  modified_base (423)..(423): a, c, t, g, unknown or other
  misc_feature (423)..(423): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagcccaccctctcatgcagggccagtcagagtattagaacatacttggcctggtatcaatacaagcctggccagggtccccgctcctcatctatgatgcttccagcagggccacgtggcatcccagccaggttcagtggcggtgggttgcanagacttcactctcacatcagcagcctcaactgaagtatttgctagtctattactgtcaacagcgtaanagattcggccgtctctacgttccgggacggtacgggaccgaagggtacggagtacgtaacgaaacggtaacgtggtaggtacctggaccaccgacttccgtgttacc

SEQ ID NO: 240102 - DNA, 511 bp, Homo sapiens
  misc_feature: GYAE6OF01BPI6M.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagcccaccctctcatgcagggccagtcagagtattagaacatacttggcctggtatcaatacaagcctggccagggtccccggctcctcatctatgatgcttccagcagggccatggcatcccagccaggttcagtggcggtgggtttggcacagacttcactctcacaatcagcacgcctccaacctgaagtattttgctagttctattactgtacaacagcgtacagattggccgtctcacgtttcggcggtagggaccaagggtgagactacgaaacgtacgtgtggctggacaccatcgtgtcc

SEQ ID NO: 240103 - DNA, 559 bp, Homo sapiens
  misc_feature: GYAE6OF01D5XJ5.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatatatgatgcttccagcagggccactggcatcccagccaggttcagtggcggtgggtttgcacagacttcactctcacatcagcacgcctaccaacctgaagtattttgctagtctattactgtacaacagacgtaacagtattcggccgtcttctacgtttccgggacgggtacgggacccgtaagggtacgggagtaacgtaccgaaaaccggtaacgttagggtacggaccgttcggacctaacccgtacttccgttcgttacc

SEQ ID NO: 240104 - DNA, 254 bp, Homo sapiens
  misc_feature: GYAE6OF01CUGVB.45.35.D02.1.454.CMB.1.raw
  modified_base (252)..(254): a, c, t, g, unknown or other
  misc_feature (252)..(254): n is a, c, g, or t
tcagacgcgatcgacacgaccggtgctcgatttagcacacgatagttgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgcatctgatcgatcgcgtctgagcgggctggcaaggcgcatagnnn

SEQ ID NO: 240105 - DNA, 579 bp, Homo sapiens
  misc_feature: GYAE6OF01BC94E.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccaggtccccggctcctcatctatgatgcttccagcagggccactggcatcccagccaggttcagtggcggtgggtttggctacgagtacttcgactctcacaatcagcagcctaccaaccctagaacgtattttgctagttctatttactgttacaacgtagtcgtaactagaactttgggacccgtcttacgtaccttttaccgggacgggaagggtaacccgtaaagggttcgggaaggtaattacgaaaaccggtaaacttcgggtaggaccttggacccaaccctagttccgttggttaccc

SEQ ID NO: 240106 - DNA, 352 bp, Homo sapiens
  misc_feature: GYAE6OF01DFWYX.45.35.D02.1.454.CMB.1.raw
  modified_base (281)..(289): a, c, t, g, unknown or other
  misc_feature (281)..(289): n is a, c, g, or t
  modified_base (291)..(297): a, c, t, g, unknown or other
  misc_feature (291)..(297): n is a, c, g, or t
  modified_base (299)..(352): a, c, t, g, unknown or other
  misc_feature (299)..(352): n is a, c, g, or t
tcagacgcgatcgacacgaccggtgctcgatttagcacacgatagttgggggtttggtgggtttggcacagacttcactctcacaaatcagcagcctccaaacctgaagattttgcagtctattacctgtcaacagcgtacagattggccgctcactttcggcggagggacccaaaggtggagatcaaaacgaactgtggctgcaccatctggtccttcatcttcccgccatctgtatcgatcgcgtctgagcggggctagggacaagggcgctaataggnnnnnnnnncnnnnnnnannnnnnnnnnnnnnnnnnnnnnnnnnnnnnnnnnnnnnnnnnnnnnnnnnnnnn

SEQ ID NO: 240107 - DNA, 255 bp, Homo sapiens
  misc_feature: GYAE6OF01BTQ2W.45.35.D02.1.454.CMB.1.raw
  modified_base (252)..(255): a, c, t, g, unknown or other
  misc_feature (252)..(255): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgcatctgatcgatcgcgtctgagcgggctggcaaggcgcatagnnnn

SEQ ID NO: 240108 - DNA, 573 bp, Homo sapiens
  misc_feature: GYAE6OF01DM7TW.45.35.D02.1.454.CMB.1.raw
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttccagcagggccacgtggcactcccagccaggttcaggtggcggtgggtttggcacagacttcacttctcacaatcacgcacgcctacccaacctgaagtattttgctagttcttattactgtacaactagcgtaacagtagttcggtcctcgtctaacgttttcgggaccgggtacggggtacccgaaagggttagggaaggtaacgtacgaaaacggtaaccgttacgggtagggtacctcggaccaaccgtacttccgttgttacccg

SEQ ID NO: 240109 - DNA, 260 bp, Homo sapiens
  misc_feature: GYAE6OF01CHBP5.45.35.D02.1.454.CMB.1.raw
  modified_base (232)..(232): a, c, t, g, unknown or other
  misc_feature (232)..(232): n is a, c, g, or t
  modified_base (257)..(260): a, c, t, g, unknown or other
  misc_feature (257)..(260): n is a, c, g, or t
tcagacgcgatcgacacgaccggtgctcgatttagcacacgatagttgggtttggcacagacttcactctcacaatcagcagcctccaacctgaagtattttgcagtctattactgtcaacagcgtacagattggccgctcactttcggcggagggaccaaggtggagatacaaacgaactgtggctgcaccatctgtcttcatccttcccgccatctgatcgatcgcgtcnggagcgggctggcaaggcgcatagnnnn

SEQ ID NO: 240110 - DNA, 541 bp, Homo sapiens
  misc_feature: GYAE6OF01D8OP3.45.35.D02.1.454.CMB.1.raw
  modified_base (241)..(241): a, c, t, g, unknown or other
  misc_feature (241)..(241): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggaaaattgtgttgacacagtctccagccattctgtctctctctccaggggagacagccaccctctcatgcagggccagtcagagtatagaacntacttggcctggtatcaatacaagcctggccaggggtccccgntcctnatctatgatgcttccagcagggccatggcactcccagccaggttcaggtgggcgggttggttggcacgagtactttccacttccgtacaacaatccagccacgcctaccaacctagaagtatttcgactagtcttattactgtacaactagacgtacagtactcggccgtactctacgttcgggacggtacgggaccgtaaggtcggagtagtaccgaaacgacgtggtaggctcgacacattctgtcttac

SEQ ID NO: 240111 - DNA, 536 bp, Homo sapiens
  misc_feature: GYAE6OF01DT2FN.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccactggcatcccagccaggttcagtggcggtgggtttggcacagacttcactctcacaatcagcagcctccaacctgaagtattttgctagttctattactgtacaacagcgtaacagattcggccgtcttcgtaacgtttccgggacgggtacggggacccgaaagggttgggaagtacgtacgaaacggaactaggtggacgttcgacaccatcgtgttcc

SEQ ID NO: 240112 - DNA, 507 bp, Homo sapiens
  misc_feature: GYAE6OF01DBAYR.45.35.D02.1.454.CMB.1.raw
  modified_base (355)..(355): a, c, t, g, unknown or other
  misc_feature (355)..(355): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctttgtttccaggggaaagagccaccctctcctgccagggccagtcagggtgttaacagctacttagcctggtaccaacaaaacctgccaggctcccaggctcatcatctatgacgcatcgaacagggccactggcatcccagccaggttcagtggcagtggtctgggacngacttcactctcacatcagcagcctggaccctgagtatttgcctatttactactgtcagcagcgtggcgaccgagcgctcacgtttcggcggagggaccaaggtggagatacaaacgatgtggctgcacatctgtcttcactccttcccgcc

SEQ ID NO: 240113 - DNA, 525 bp, Homo sapiens
  misc_feature: GYAE6OF01A5W25.45.35.D02.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtatagaacatacttggcctggtatcaatacaagcctggccagggtccccgctcctcatctatgatgcttccagcaggccactggcatccagccagttcagtggcggtggttgcagagacttcgactctcacaatcagcacgcctaccaacctgaatattttgactagtactattactgtacaacagtacgtacagtagttcggtccgcttcgtacttacgggcggagggtaccgaaggtacggaagtactacgaaacgtaacgtaggtacggctcggacaccattcgtgttac

SEQ ID NO: 240114 - DNA, 592 bp, Homo sapiens
  misc_feature: GYAE6OF01DF5PX.45.35.D02.1.454.CMB.1.raw
  modified_base (198)..(198): a, c, t, g, unknown or other
  misc_feature (198)..(198): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagataccaccggaaaattgtgttgacacagtctccaggcaccctgtctctgtctccagggganacagccaccctctcatgcagggccagtcagagtattagaacatacttggcctggtatcaatacaagcctggccacgggtcccggctcctcatctatgatgcttccagcaggccactgcatcccagccagttcagtggcggtgggttgcacgagacttcactctacacaatcagcagcctaccgaacctgaaagtatttagctagtaccttattactgttacaactacgacgtaacgagtagttacggcccgtacttacctaaccggttttcgggaccgggtaacggggtaaccaaggggttcgggaaacgtaagtaaccgtaaaaccggtaaccgttggttacgggacgttacggaccgtaacccgtagttacctcggtttacctcgttaaccc

SEQ ID NO: 240115 - DNA, 518 bp, Homo sapiens
  misc_feature: GYAE6OF01DD9B9.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccactggcatcccagccaggttcaggtggcggtgggtttggcacgagacttcactctcacaatcagcagcctccaaccctgaagtattttgctagtctattactgtacaacagcgtacagtacttggccgctctacgtttcggcggacgggtaccgaagggtggaagagtacgaaacgtacgtgtggactcgacaccatctgttcc

SEQ ID NO: 240116 - DNA, 270 bp, Homo sapiens
  misc_feature: GYAE6OF01E39LX.45.35.D02.1.454.CMB.1.raw
  modified_base (257)..(270): a, c, t, g, unknown or other
  misc_feature (257)..(270): n is a, c, g, or t
tcagacgcgatcgacacgaccggtgctcgatttagcacacgatagggtgggtttggcgacagacttcactctcacaatcagcagcctccaacctgaagattttgcagtctattactgtcaacagcgtacagattggccgctcacttttcggcggagggaccaaggtggagatcaaacgaactgtggctgcaccatctgtcttcatcttcccgccatctgatcgatcgcgtctgagcggggctggcaaggcgcatagnnnnnnnnnnnnnn

SEQ ID NO: 240117 - DNA, 550 bp, Homo sapiens
  misc_feature: GYAE6OF01DZTQF.45.35.D02.1.454.CMB.1.raw
  modified_base (200)..(200): a, c, t, g, unknown or other
  misc_feature (200)..(200): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (353)..(353): a, c, t, g, unknown or other
  misc_feature (353)..(353): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctnatctatgatgcttcagcaggccacgtggcatcccagccaggttcaggtggcggttggttgcacngtacttcactctacacatcagcacgcctaccaacctgaacgtattttgactagtcttaattacttcgtactaacacgtactaacgtagtagttcggccgtctcgtacgtttcgggacggacgggtaccgagggtacggaacggtacgtaacgaaacggtacgtaggtacggcgtagacctacacgttcgtggttacc

SEQ ID NO: 240118 - DNA, 540 bp, Homo sapiens
  misc_feature: GYAE6OF01EXS58.45.35.D02.1.454.CMB.1.raw
  modified_base (234)..(234): a, c, t, g, unknown or other
  misc_feature (234)..(234): n is a, c, g, or t
  modified_base (309)..(309): a, c, t, g, unknown or other
  misc_feature (309)..(309): n is a, c, g, or t
  modified_base (499)..(499): a, c, t, g, unknown or other
  misc_feature (499)..(499): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggagaaattgtgttgacacagtctccagccaccctgtctttgttccaggggaaagagccaccctctcctgcagggccagtcagggtnttaacagctacttagcctggtaccaacaaaacctggccaggcctcccaggctcatcatctatgacgcatcgaacngggccactggcatcccagccaggttcagtggcaggtggtctgggacagacttcactctcaccatcagcagcctggaccctgagtatttcgcctatttactactgtacagcagcgtggccgaccgagccgtctcgtacgttcgggacgggtacgggaccgtaagggtggagactacgaaaacgacgtaggnggtctggaccacctatctcgtcttacattccctcccgctac

SEQ ID NO: 240119 - DNA, 268 bp, Homo sapiens
  misc_feature: GYAE6OF01B3RB0.45.35.D02.1.454.CMB.1.raw
  modified_base (250)..(268): a, c, t, g, unknown or other
  misc_feature (250)..(268): n is a, c, g, or t
tcagacgcgatcgacacgaccggtgctcgatttagcacacgataggtgggtttggcaacagacttcactctcacaatcagcagcctccaacctgaagatttgcagtctattactgtcaacagcgtacagattggccgctcactttcggcggagggaccaaggtgagatcaaacgactgtggctgcaccatctgtcttcatcttcccgccatctgatcgatcgcgtctgacgcggctgcaaggcgcatagnnnnnnnnnnnnnnnnnnn

SEQ ID NO: 240120 - DNA, 256 bp, Homo sapiens
  misc_feature: GYAE6OF01DN5W9.45.35.D02.1.454.CMB.1.raw
  modified_base (252)..(256): a, c, t, g, unknown or other
  misc_feature (252)..(256): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgactgtggctgcaccatctgtcttcatcttcccgccatctgatcgatcgcgtctgagcgggctggcaaggcgcatagnnnnn

SEQ ID NO: 240121 - DNA, 513 bp, Homo sapiens
  misc_feature: GYAE6OF01D27L5.45.35.D02.1.454.CMB.1.raw
  modified_base (201)..(201): a, c, t, g, unknown or other
  misc_feature (201)..(201): n is a, c, g, or t
  modified_base (507)..(507): a, c, t, g, unknown or other
  misc_feature (507)..(507): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccactggcactcccagccaggttcagtggcggtgggtttgcacagacttcactctcacatcagcacgcctaccaacctgaagtatttgctagttctattactgtacaacagactacagtattcggccgcttcgtacgtttcggacggacgggaccgtaagggtggagacgtacgaaacgactgtggctcgacacntctgtc

SEQ ID NO: 240122 - DNA, 543 bp, Homo sapiens
  misc_feature: GYAE6OF01DDWDL.45.35.D02.1.454.CMB.1.raw
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (420)..(420): a, c, t, g, unknown or other
  misc_feature (420)..(420): n is a, c, g, or t
  modified_base (447)..(447): a, c, t, g, unknown or other
  misc_feature (447)..(447): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagagacctccggagaaattgtcttgacacagtctccagccattctgtctctctctccagggganacagccaccctntcatgcagggccagtcagagtattagaacatacttggcctggtatcaatacaagcctggccagggtcccccgctcctcatctatgatgcttccagccagggccacgtggcatcccagcaggttcaggtggcggtggtttgcacgagtaacttcactctacacaatcagcacgcctaccaacctagaagtatttgactagtctattactntacaactacgacgtacagtacgtcgcnctctacgtttcggacggtacggaccgaaggtcggaagtacgtaacgaaacggtacgtacggtaggtacgtcggaccaaccgtactccgtgttaccg

SEQ ID NO: 240123 - DNA, 510 bp, Homo sapiens
  misc_feature: GYAE6OF01DI2JW.45.35.D02.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (313)..(313): a, c, t, g, unknown or other
  misc_feature (313)..(313): n is a, c, g, or t
  modified_base (440)..(440): a, c, t, g, unknown or other
  misc_feature (440)..(440): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcctgcagggccagtcagggtnttaacngctacttagcctaggtaaccaacaaaaacctggaccaggctcccaggctcatcatctatgacgcatcgaacngggccactggcatcccagccaggttcagtggcaggtgggtctgggacagacttcactctcaccatcagcagcctggaccctgaggtatttcgcctagtttgcttactgtcagcagcgtggccgacgngccgtctctacgttcggcggacggacctagggtgagacgtacgaaagactggtgctgcacatctgtctac

SEQ ID NO: 240124 - DNA, 508 bp, Homo sapiens
  misc_feature: GYAE6OF01CMX52.45.35.D02.1.454.CMB.1.raw
  modified_base (200)..(200): a, c, t, g, unknown or other
  misc_feature (200)..(200): n is a, c, g, or t
  modified_base (437)..(437): a, c, t, g, unknown or other
  misc_feature (437)..(437): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttcagcagggccatggcatcccagccaggttcagtggcggtggtttgcacgagacttcgactctcacatcagcacgcctaccaacctgaagtattttgctagtctattactgtacaacagcgtacagtatcggccnctctacgttcggcgagggaccagggtgacggtatacgaaacgtacgtgtgctacgacaccatcgtgttacc

SEQ ID NO: 240125 - DNA, 254 bp, Homo sapiens
  misc_feature: GYAE6OF01CZ9MQ.45.35.D02.1.454.CMB.1.raw
  modified_base (252)..(254): a, c, t, g, unknown or other
  misc_feature (252)..(254): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgcatctgatcgatcgcgtctgagcgggctggcaaggcgcatagnnn

SEQ ID NO: 240126 - DNA, 269 bp, Homo sapiens
  misc_feature: GYAE6OF01CKGWK.45.35.D02.1.454.CMB.1.raw
  modified_base (252)..(269): a, c, t, g, unknown or other
  misc_feature (252)..(269): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgactgtggctgcaccatctgtcttcatcttcccgcatctgatcgatcgcgtctgagcgggctggcaaggcgcaatagnnnnnnnnnnnnnnnnnn

SEQ ID NO: 240127 - DNA, 254 bp, Homo sapiens
  misc_feature: GYAE6OF01BU525.45.35.D02.1.454.CMB.1.raw
  modified_base (253)..(254): a, c, t, g, unknown or other
  misc_feature (253)..(254): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgccatctgatcgatcgcgtctgagcgggctggcaaggcgcatagnn

SEQ ID NO: 240128 - DNA, 514 bp, Homo sapiens
  misc_feature: GYAE6OF01DHYJY.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttggcacagcttcactctcacatcagcagcctccaacctgaacgtattttgctagttctattactgtacaacagcgtaacagtattcggccgctctacgtttcggcggacgggaccgaagggtggagacgtacgaaacggtacgtggtggctgacaccatctgtcc

SEQ ID NO: 240129 - DNA, 575 bp, Homo sapiens
  misc_feature: GYAE6OF01BM81Q.45.35.D02.1.454.CMB.1.raw
  modified_base (203)..(203): a, c, t, g, unknown or other
  misc_feature (203)..(203): n is a, c, g, or t
  modified_base (342)..(342): a, c, t, g, unknown or other
  misc_feature (342)..(342): n is a, c, g, or t
  modified_base (441)..(441): a, c, t, g, unknown or other
  misc_feature (441)..(441): n is a, c, g, or t
tcagacgcgatcgacacgaccggtgctcgatttagcacacgatagttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtaggagtgtcagtaagtacttaggctggtaccaacagaaacctggccaggctcccaggctcctcatccatgatgcatccaacgacgggtccctggccgtcccagacaggttccgnggcaggtgggtctgggacagagttcactctcaccgtcagcagcctggacgcctgatgtatttgactagtttacttctgtcagtcacgtcgttcccgccnccgcccgcctccgtaccggtttccggggccggggggtaccgtaggggtacggaggacgtggacggacgaacgtggtcgcgtcgcctaccacttcgtcgttccttcgtacttcccttccccgcctcgttcgtacg

SEQ ID NO: 240130 - DNA, 568 bp, Homo sapiens
  misc_feature: GYAE6OF01CVGIW.45.35.D02.1.454.CMB.1.raw
  modified_base (199)..(199): a, c, t, g, unknown or other
  misc_feature (199)..(199): n is a, c, g, or t
  modified_base (284)..(284): a, c, t, g, unknown or other
  misc_feature (284)..(284): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagagacctcggagaaattgtcttgacacagtctccagccattctgtctctctctccgagggganacagccaccctctcatgcaggccagtcagagtatagaacatacttggctggtatcaatacaagctggccagggtccccgctcctnatctatgatgcttccagcagggcacgtggcatcccagccaggttcagtggcggttgggttcgcacgagtacttcgactctcacatcaagcacgcctaccaacctgaacgtatttgactagtactattactgtacaactagacgtaactagtacgttcggccgtcttcgtaccgtttcgggacgggtaacgggtaccgaaaggggttacggaacggtaacgtaaccgaaaacggtaacgttagggtacggtacgtacggactaaccgtaacgttcgtcggttacc

SEQ ID NO: 240131 - DNA, 522 bp, Homo sapiens
  misc_feature: GYAE6OF01BM264.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccactggcactcccagccaggttcagtggcggtgggttgcacagacttcactcacacatcagcacgccctaccaactgaagtattttgctagtctattactgtacaacagtacgtacagtagttcggccgtctccgtacgttcgggacggacgggtaccaagggtgaggatacgaaacgacgtggtacggcgtcgaccacactctgttcc

SEQ ID NO: 240132 - DNA, 560 bp, Homo sapiens
  misc_feature: GYAE6OF01EMRZ6.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcaggtgggcggttgggtttgacacgagtacttcactctacactaatcagcacgcctaccaacctgaacgtattttcgactagttcttattactgtactaacagacgtaacagtacgttcggccgtcttcgtacgtttcgggacgggtacgggtaccgtaagggtaggaacgtacgtaacaaacggtacgtaggtacggtacgtacgacacctacttcgtgttccg

SEQ ID NO: 240133 - DNA, 507 bp, Homo sapiens
  misc_feature: GYAE6OF01CFYDM.45.35.D02.1.454.CMB.1.raw
  modified_base (201)..(201): a, c, t, g, unknown or other
  misc_feature (201)..(201): n is a, c, g, or t
  modified_base (282)..(282): a, c, t, g, unknown or other
  misc_feature (282)..(282): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtattagacatactggctggtatcaatacaagcctggccagggtccccggntcctcatctatgatgcttccagcagggccacgtggcatcccagccgaggttcagtggcggtgggtctgggacagcttcactctcacatcagcagcctcggaccctgacggtatttcgacctatttactactgtcagcagcgtggccgacgagcgctctacgttcggcggacgggaccagggtggagagtacaaacggtactggtagctgacacctatcgtgttcc

SEQ ID NO: 240134 - DNA, 516 bp, Homo sapiens
  misc_feature: GYAE6OF01BZ8KV.45.35.D02.1.454.CMB.1.raw
  modified_base (200)..(200): a, c, t, g, unknown or other
  misc_feature (200)..(200): n is a, c, g, or t
  modified_base (506)..(506): a, c, t, g, unknown or other
  misc_feature (506)..(506): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttcagcagggccactggcatcccagccaggttcagtggcgtgggtttgcacagacttcactctcacaatcagcacgcctccaacctgaagtattttgctagttctattactgtacaacagcgtacagtacttggccgtctctacgtttcggcggtacgggaccgaaggtcggagactacgaaacgtacgtgtaggctcgacaccntcgtgttacc

SEQ ID NO: 240135 - DNA, 514 bp, Homo sapiens
  misc_feature: GYAE6OF01D9PF2.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttgcacagacttcactctcacaatcagcagcctaccaacctgaagtatttgctagtctattactgtacaacagcgtacagtattcggccgtcttcgtacgtttcgggcggaagggaccgaagggtggagtagtacaaacggactggtggactgacaccatctgtc

SEQ ID NO: 240136 - DNA, 542 bp, Homo sapiens
  misc_feature: GYAE6OF01AIK8U.45.35.D02.1.454.CMB.1.raw
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
  modified_base (357)..(357): a, c, t, g, unknown or other
  misc_feature (357)..(357): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttccagcagggccactggcactcccagccaggttcaggtggcggtgggtttgcacngactcactctcacatcagcacgcctaccaacctagaagtattttacgctacgttacttattactgtacaactacgacgtacagtagttcggtccgtctcgtacgtttcggacggtacggaccgaaggtaggacggacgtacgaaacggtacgtacgtaggcgtacgacacctagtcgtgttaccg

SEQ ID NO: 240137 - DNA, 577 bp, Homo sapiens
  misc_feature: GYAE6OF01CA18N.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaagtacaagcctggcctagggtccccggctccgtcattctatgatcgcttccagtcagggcctactggcatcccgagccaggttcaggtggcggttggtttcggcacgacgacttcactctcacactcagcacgcctccaacctgaacgtactttcgctagttctattaccgtgtacaactacgacgtacacggtacgttcggaccgtctacgtacgtttccggacgggtacgggaccgtaagggtcggaacggtacgttaccgaaaacggtacgttcggtacggcgttcgaccgaaccctacgtcccgtgttacccg

SEQ ID NO: 240138 - DNA, 562 bp, Homo sapiens
  misc_feature: GYAE6OF01BKD5O.45.35.D02.1.454.CMB.1.raw
  modified_base (201)..(201): a, c, t, g, unknown or other
  misc_feature (201)..(201): n is a, c, g, or t
  modified_base (470)..(470): a, c, t, g, unknown or other
  misc_feature (470)..(470): n is a, c, g, or t
  modified_base (551)..(551): a, c, t, g, unknown or other
  misc_feature (551)..(551): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcagggccagtcagagtatagaacatacttggcctggtatcaatacaagcctggccacggggtccccgctcctcatctatgatcgcttccagcgaggccacgtggcatcccagtccaggttcaggtgggcggttggggtttcgcacgagacttcactctacaacatacgtagcacgccctaccaaccgtagtaatatttagactagttacttattactgttacaactacgtcgtaacagtacgtgggccctntaccgtacgttcgggacggtaacggtaccgaggtacggagtacgtaacgaaaccggtataggtaggccgtacgacaacctntcgtgttaccg

SEQ ID NO: 240139 - DNA, 256 bp, Homo sapiens
  misc_feature: GYAE6OF01BT9WO.45.35.D02.1.454.CMB.1.raw
  modified_base (253)..(256): a, c, t, g, unknown or other
  misc_feature (253)..(256): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgccatctgatcgatcgcgtctgagcgggctggcaaggcgcatagnnnn

SEQ ID NO: 240140 - DNA, 555 bp, Homo sapiens
  misc_feature: GYAE6OF01DPXDS.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggcctggtatcaatacaagcctggccacgggtccccgctcctcatctatgatgcttccagcagggccacgtggacactcccagccaggttcaggtggcggttgggtttcgcacgagtaccttcacttctacacatcagcacgcctaccaactagtaacgtatttgactagttctacttactagtacaactagacgtacagtacgttcggccgtactcgtacgttcgggacggtacgggaccgtagggtaggaacgtactacgaaacggtacgtaggtacgacgtacgactaacgcttcgtgttacc

SEQ ID NO: 240141 - DNA, 559 bp, Homo sapiens
  misc_feature: GYAE6OF01A9IYB.45.35.D02.1.454.CMB.1.raw
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
tcagacgcgatcgacacgaccggtgctcgatttagcacacgatagttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcgggtgttaacagctacttagcctggtaccaacaaaaaacctggccaggctcccaggctcatcatctatgacgcatcgaacagggccactggcatcccagccaggttcagtggcagtgggtctgggacagacttcactctcaccatcagcagcctggaccctgagtattttgcctatttacngtctnacanacgngtcggcgaccgacgcgccgtctacttaccggttcgggacgggacggaacggtagggacggatacgtaacgaaacgtagtggtcgtcgcgaccactacttcgtacgttcctacttacctttccccgtcccgcttacg

SEQ ID NO: 240142 - DNA, 572 bp, Homo sapiens
  misc_feature: GYAE6OF01AT6GU.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaaatacaagcctggccaggggtcccccgctcctcatctatgatgcttccagcagggccacgtggcactcccagccaggttcaggtggcggtgggtttggcacgagacttcactctcacatcagcacgcctaccaacctgaagtattttagctagttctattactcgtacaactacgacgtaacacgtagttcggtccgcgttactacgtttcgggaccgggtacgggtaaccgaagggtagggacgtaacgttacgaaaacggtaacgttagggtacggtacgtcggacctaaccgtacgttcgttcgttaccg

SEQ ID NO: 240143 - DNA, 614 bp, Homo sapiens
  misc_feature: GYAE6OF01APBQS.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaacgcgggtccctggccgtcccagaccgtagggttcccgtggcctaggtcggggtcgtaggggaccaggtacgtttccacttctccgaccgtcagccaggcctgggacgcctgactgtatttgctagtttacttctgtcacgtcacgtccgttccgccgacgcccgtcttccgtaccggtttccggggccggggggtaccgtaggggtcggaggtacgtcggacggacggtacgtcgggtacggtcgtagaccgtaccgtacgttccgttcgttccgttactacgttcccgtttccccgcccgttacg

SEQ ID NO: 240144 - DNA, 522 bp, Homo sapiens
  misc_feature: GYAE6OF01AXLOR.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccgagcagggccacgtggcactcccagccaggttcagtggcggtgggtttggcacgagtacttcactctcacaatcagcacgcctccaaccctgaagtatttgctagttctattactgtacaacagcgtacagtagttcggccgtctctacgtttcggcggtacgggaccgaagggtggaggacgtacaaacggacgtgtggctcgacaccatctgttc

SEQ ID NO: 240145 - DNA, 544 bp, Homo sapiens
  misc_feature: GYAE6OF01AFPNI.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccatttctgtctctctctccagggganacagccaccctctcatgcagggccagtcagagtattagaacatacttggcctggtatcaatacaagcctggccagggtccccggctcctcatctatgatgcttccagcagggccactggcactcccagccaggttcaggtgggcggttgggtttggcacgagacttcactctacacaatcagcacgcctacccaacctagtaacgtattttgactagttctattactgtacaacagtcgtaacagtattcggccgtcttcacgtttcggcggaacgggaccgaagggtggagtacgtacgaaacgtacgtggtacggacgtacgaccaccattcgtgttacc

SEQ ID NO: 240146 - DNA, 508 bp, Homo sapiens
  misc_feature: GYAE6OF01D2PAC.45.35.D02.1.454.CMB.1.raw
  modified_base (201)..(201): a, c, t, g, unknown or other
  misc_feature (201)..(201): n is a, c, g, or t
  modified_base (357)..(357): a, c, t, g, unknown or other
  misc_feature (357)..(357): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttggcacngacttcactctcacatcagcagcctccaacctgaagtattttgctagtctattactgtcaacagcgtaacagattcggccgtctctacgtttcggcggagggaccgaggtggagatacaaacggaactggtgcgtgacaccatcgtgttac

SEQ ID NO: 240147 - DNA, 497 bp, Homo sapiens
  misc_feature: GYAE6OF01E32DA.45.35.D02.1.454.CMB.1.raw
  modified_base (201)..(201): a, c, t, g, unknown or other
  misc_feature (201)..(201): n is a, c, g, or t
  modified_base (491)..(491): a, c, t, g, unknown or other
  misc_feature (491)..(491): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttggcacagacttcactctcacaatcagcagcctccaacctgaagtattttgcagtctattactgtcaacagacgtacagattggccgctctacgtttcggcggagggaccaaggtggagatacaaacgactgtgctgcacntctgtc

SEQ ID NO: 240148 - DNA, 495 bp, Homo sapiens
  misc_feature: GYAE6OF01BH8TD.45.35.D02.1.454.CMB.1.raw
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttccagcagggccactggcatcccagccaggttcagtggcggtggtttgcacagacttcactctcacaatcagcagcctccaacctgaacgtattttgctagtctattactgtacaacagcgtacagattggccgtctctactttcggcggaggaccgaggtggagatacaaacgactgtgctgcacatctgtc

SEQ ID NO: 240149 - DNA, 552 bp, Homo sapiens
  misc_feature: GYAE6OF01AR9FT.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccacggggtccccgctcctcactctatgatgcttccagcagggccacgtggcactcccagccaggttcagtgggcggttgggtttcgcacgtacgtactttcactctacaactaatcagcacgccctaccaacctgtaacgtattttcgactagttcttacttactcgtacaacacgtacgtacagagttcggccgtctacgtacgttcgggacggtacggacgaaggtaggagtacgtacgaaacgtactggtagcgtacgacacctactcgtgttacc

SEQ ID NO: 240150 - DNA, 535 bp, Homo sapiens
  misc_feature: GYAE6OF01E5KPD.45.35.D02.1.454.CMB.1.raw
  modified_base (200)..(200): a, c, t, g, unknown or other
  misc_feature (200)..(200): n is a, c, g, or t
  modified_base (358)..(358): a, c, t, g, unknown or other
  misc_feature (358)..(358): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagacatacttggcctggtatcaatacaagcctggccagggtccccggctcctcatctatgatgcttccagcagggccactggcatcccagccaggtcagtggcggtgggtttgcacagcttnactctacacatcagcacgcctccaacctagaagtattttgctagtctaattactgtacaactacgacgtacagtacttcgggcctctcgtacgtttcgggacggtacgggaccgaagggtaggaacgtactacgaaacggtacgtacggtaggcgtcgacaaccacttctcgttccg

SEQ ID NO: 240151 - DNA, 502 bp, Homo sapiens
  misc_feature: GYAE6OF01DKCSZ.45.35.D02.1.454.CMB.1.raw
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
  modified_base (373)..(373): a, c, t, g, unknown or other
  misc_feature (373)..(373): n is a, c, g, or t
  modified_base (496)..(496): a, c, t, g, unknown or other
  misc_feature (496)..(496): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccagggtcccccgntcctcatctatgatgcttccagcagggccactggcatcccagccaggttcagtggcggtgggtttgcacagcttcactctcacatcancagcctccaactgaagtatttgctagtcttattactgtcaacagcgtacagattcggccgtctcactttcgagcggaggaccgaagggtggagatacgaaacgactgtacggtctagccaccngtctcg

SEQ ID NO: 240152 - DNA, 537 bp, Homo sapiens
  misc_feature: GYAE6OF01A07G2.45.35.D02.1.454.CMB.1.raw
  modified_base (201)..(201): a, c, t, g, unknown or other
  misc_feature (201)..(201): n is a, c, g, or t
  modified_base (356)..(356): a, c, t, g, unknown or other
  misc_feature (356)..(356): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcaggtggcggtgggttgcacngacttcactctacacaatcagcacgcctaccaacctgaacgtatttgctagttctattactgtacaacagacgtacagtgttacggccgtcttctacgtttcgggacggacgggaccgaagggtggaagatacgaaacggtacgtaggtaggacttacggacctaaccattccgtgttacc

SEQ ID NO: 240153 - DNA, 513 bp, Homo sapiens
  misc_feature: GYAE6OF01E2XY5.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccggctcctcatctatgatgcttccagcagggccactggcatcccagccaggttcagtggcggtgggtttgcacagacttcactctcacatcagcacgcctccaacctgaacgtattttgctagtcttattactgtcaacagtcgtacagattcggccgtctcactttcggacggagggaccagggtggagtacgtacgaaacgtacgtgtggctcgacaccatctgttcc

SEQ ID NO: 240154 - DNA, 708 bp, Homo sapiens
  misc_feature: GYAE6OF01DXC14.45.35.D02.1.454.CMB.1.raw
  modified_base (141)..(141): a, c, t, g, unknown or other
  misc_feature (141)..(141): n is a, c, g, or t
  modified_base (208)..(208): a, c, t, g, unknown or other
  misc_feature (208)..(208): n is a, c, g, or t
  modified_base (348)..(348): a, c, t, g, unknown or other
  misc_feature (348)..(348): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccaganacctcggagaattgtcttggactacagtctacagcccattcctcgtctcttcgtctccggagggganacacgccctacctctcatggccagggccaaggtcaagtacgtaactacgaacgtacttacgttcgacctaggtaactacgaactacgaacgcccgtagggccctacgggttcccccgacttcccctatacgtacctttancggtacttaccgaccttacccggaacggtccgaacgggcccctaacggtcggaccaccgtaccccgtagaccgttagggttcgacgggttcggggtcgttagggttacgacctacgtacgtactacacctctacacgtaacgtccgaacgtaccgacgtccccgtaccgaaacgttcggtaacgttacgttttcgaacgtttattaccgttacgtttactacggtactaacgtcgtaccggtacctacggtacgttcgtccgaccgttggtaccgttacgggaccgtaagggacccgtaggtaggacgtacgacgaacggtcgttcggtacgcgttacgactaccgatttctagttcccg

SEQ ID NO: 240155 - DNA, 524 bp, Homo sapiens
  misc_feature: GYAE6OF01BPE1I.45.35.D02.1.454.CMB.1.raw
  modified_base (200)..(200): a, c, t, g, unknown or other
  misc_feature (200)..(200): n is a, c, g, or t
  modified_base (284)..(284): a, c, t, g, unknown or other
  misc_feature (284)..(284): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttcagcagggccatggcatcccagccagttcagtggcggtgggtttggcacagacttcactctcacatcagcacgcctaccaacctgaacgtattttgctagtcctaattactgtactaacagtacgtaacagtagttcggccgtctcgtacgtttcgggcggaagggaccgtaaggtggagacgtagaaacggtactagtaggctaggcaccacttcgtgttc

SEQ ID NO: 240156 - DNA, 545 bp, Homo sapiens
  misc_feature: GYAE6OF01DPKBM.45.35.D02.1.454.CMB.1.raw
  modified_base (181)..(181): a, c, t, g, unknown or other
  misc_feature (181)..(181): n is a, c, g, or t
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattcngtctctctctccagggganacagcccaccctctcgatgcgagggccagtcagagtattagaacatacttggcctggtatcaatacaagcctggccagggtccccgctcctnatctatgatcgcttccagcaggccactggacactcccagccaggttcagggttcggcggttgggttcgacacgagtcttacactcgacaacatcaacgcaccgcctaccgaactagtaagttatttgactagttacttagttactgtacaatacgactacagtacgtcggcctactctacgttcggacggtaggacgtaagggtgaagtacgtaacgaacgtacgtgacgctacgaccacacttgtcgttacc

SEQ ID NO: 240157 - DNA, 510 bp, Homo sapiens
  misc_feature: GYAE6OF01BAJCE.45.35.D02.1.454.CMB.1.raw
  modified_base (201)..(201): a, c, t, g, unknown or other
  misc_feature (201)..(201): n is a, c, g, or t
  modified_base (442)..(442): a, c, t, g, unknown or other
  misc_feature (442)..(442): n is a, c, g, or t
  modified_base (489)..(489): a, c, t, g, unknown or other
  misc_feature (489)..(489): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagacatacttggcctggtatcaatacaagcctggccagggtccccggctcctcgatctatgatgcttccagcacgggccactggcatcccagccaggttcagtggcggtgggtttggcacgagacttcactctcacaatcagcagcctccaacctgaagtattttgctagtctatttactgtacaacagtcgtacagattggccnctactacgtttcggcggaggaccgaaggtggagtatacaacgactgnggctgacacgactcgtgttcc

SEQ ID NO: 240158 - DNA, 560 bp, Homo sapiens
  misc_feature: GYAE6OF01DU8AU.45.35.D02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (353)..(353): a, c, t, g, unknown or other
  misc_feature (353)..(353): n is a, c, g, or t
  modified_base (395)..(395): a, c, t, g, unknown or other
  misc_feature (395)..(395): n is a, c, g, or t
tcagacgcgatcgacacgaccggtgctcgatttagcacacgatagttgggtttggggaggaactgctcagttaggacccagagggaaccatggaagccccagctcagcttctcttcctcctggcactctggctcccagataccaccggagaaattgtgttgacacagtctccaggcaccctgtctctgtctccaggggganacagccaccctctcctgcagggccagtaggagtgtcagtaagtacttaggctggtaccaanagaaacctggccaggcctcccaggctcctcatccatgatgacatccaaacgtacgggtccctgggccgtacccaagacgtacgggttccgnggcaggtcgggtctggggacaggtagtttcactctcaccgtnagcagcctggacgccgtgatgtatttgtctagtttacttctgtcagcacgtccgttccgccaccgccgctctacgtttcggggcgggggaccgagggtggagagtggaacgacgaacgtggtcggcgtggcaccgtatcgtgttcttctacttccgttcccgtcc

SEQ ID NO: 240159 - DNA, 562 bp, Homo sapiens
  misc_feature: GYAE6OF01DHT5G.45.35.D02.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctcgagggganacagccacctctcatgcagggccagtcagagtattagaacatacttggcctggtatcaatacaagcctggccacgggtccccgctcctnatctatgatcgcttccagcagggccacgtggcatcccagccaggttcaggtggcggttgggttgcagagtactttcgacttctacaacaatcacgacacgtacctaccaacctagtaacgtacttttcgactacgttactattacttagtacaactacgacgtaacagtagttcggtccgtactcgtacgttcgggacgggtacgggaacgtaaggtaggaaggtacgtaacgaaacggtacgtaggtacgcgtacgactaacactctgttac

SEQ ID NO: 240160 - DNA, 566 bp, Homo sapiens
  misc_feature: GYAE6OF01BW00F.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccgagggganacagccaccctctcatgcagggccagtcagagtattagaacatacttggcctggtatcaatacaagcctggccacgggtccccgctcctcatctatgatcgcttccagcacgggccacgtggacactcccgagtccgtaggttcagggttcgggtcgggttgggtttcggactacgtagtaccttcacgtctacaacaactcacgtcacgacctacctaactagtaacgtatttacgactagttacttacttactagtactaacgtacgtacgtacagtacgtcggacctctactacgttcggacggtaggacgagggtagagtacgtacgaacgtagtacgtgcgtcgacactctcgtgttacc

SEQ ID NO: 240161 - DNA, 544 bp, Homo sapiens
  misc_feature: GYAE6OF01BN9JM.45.35.D02.1.454.CMB.1.raw
  modified_base (202)..(202): a, c, t, g, unknown or other
  misc_feature (202)..(202): n is a, c, g, or t
  modified_base (453)..(453): a, c, t, g, unknown or other
  misc_feature (453)..(453): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctcctccagggganacagccaccctctcatgcagggccagtcagagtattagaactatacttggcctggtatcaatacaagcctggccagggtccccgctcctcatctatgatgcttccagcacgggccacgtggcatcccagccagttcaggtgggcggttggggtttgctacgagtacttcactctcaactaatcagtccacgtccctacaacctgaagtatttgctagtcctattactgtcaactgctaacagtagtcgccncttcacgttcggacggaaggaccgtagggtcgagtacgtaccgaaacggtaacgtggtacggactacggaccacctacttcgtgtttaccg

SEQ ID NO: 240162 - DNA, 566 bp, Homo sapiens
  misc_feature: GYAE6OF01CCF9A.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctccctcatctatgatgcttccagcagggccactggcactcccagccaggttcagtgggcggtgggtttggcacgagacttcactctacacaatcagcagcctaccaactgaagtatttgctagttctattactcgtacaactagacgtacagtacttcgggcctcgttcctaacggttttcggccggggtaacggggtaccgaaaggggtagggaacgtacgtaacgaaaaccggtaacgttcggtaggccgtacgacccaacctacttcgttgttacccg

SEQ ID NO: 240163 - DNA, 862 bp, Homo sapiens
  misc_feature: GYAE6OF01CY8CW.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagcccagctcagcttctcttcctcctgctactctggctccagagacctccggagaaattgtcttgacacagtctccaggcaccctgtctctcgtctccgagggganacacgcccaccctctccgtgcgacgggccaggtacggagtgtacaggttaagtacgttaggcgttacgggtaaccaaacgaacgtaaacccgtcgggacccaacgggtacccttccccgaacgggtcccttacccgtacctaacctccaagttacgacgttacgacctaacgtacccgaaaaccggtcggggtcccctgggcccgttaccccgaaggtaacccgttcggggttcccggtgggtaccgtaggggtttcgggtacgtacgggggaacctaggttacgtttaccgacccgttaccttacccggacccggttaccgaacggaccgtaaccggtcccggttaagggaccggttacccgtagggtacgttacggttacgttttcgtaccgtttaacgttttaccttcgttcgttacgacggtaccgtacggtcccgtttcccgaaccgtacccggtcccggtccgttaccggttacccggggttttaccgggggacccggggggtaacccggttgggggtaacgggtacgggtaacggttacgggtaacgggaaaccgttaaccgggttcgggtacgggtcctaccggtaccctaacccggttacgttccgttacggtttacccttagttaaccccgttcccggttcccccgtaacg

SEQ ID NO: 240164 - DNA, 886 bp, Homo sapiens
  misc_feature: GYAE6OF01D1HRG.45.35.D02.1.454.CMB.1.raw
tcagacgcgatcgacacgaccggtgctcgatttagcacacgatagttgggtttcggggaaggaactcgctcgagttaggacccagagggaaccatggaagcccagctcagcttctcttcgtcctgctactctggctccagagacctcggagaaattgtcttgacacgagtctcagccattctgtctctcgtctccgaggggacacgacgccacctctacatcgcgagggccagtcaagagtattacgaactattaacgttcgggacctaggttaactacgtaaaagttaacaaacggtccgtttggggacccgtaacggggtcccccgggtaccttaccccggtactaacgttccgttaagtgggtaacgttcgggtcctttacccggaggtaccggtacggggtacccgtaaacggttgggaaccctaactaccccggtaaggtacccggtaacgggttaccgtaaaggggttcggggtacgggggtttaggggttttaccgggaacgttaaccggtacggtaaacccgttttaccgaaccgtttacccgttaacccgaaacccttaaacgttaccgaacggtacccgtaccggtaaccccttacccgaaaccgttacggaaacggtttacgttttacgaccgttaacgttacgtttaaacgttacccgttacgtaaccgaaacgttccggtaaccgttaacgtaacggttaacggttaccgggtaccgtaaccggtttactaaccgggttttaccggggtacgggttaaaccgggaccggttaaagggtacgggttaacggtaaacgttaacggtaaaacggtacggttacgggtaggtaccgtttacggaacttaaccggtactttcggtcggtttaacccgg

SEQ ID NO: 240165 - DNA, 724 bp, Homo sapiens
  misc_feature: GYAE6OF01BXNR4.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagagacctccggagaaattgtcttgacacagtctccagccattctgtctctctctccgagggganacagcccaccctctcatgcagggccagtcagagtattagaacatacttggcctggtatacaatacaagcctggccgtacgggtcccccgctcctcatctatgactcgccttccgagccgacgggcctacgtcggactacgtcccgagccgtaggttcgaggttcggggcgggttggggtttcggactaacgtagtacctttaccacttccgtaccaactaactaccgaacgtaccgacgtacccctaacccgtaaacccgttaggtaaacggttactttttacggaccttaacggtttacctttaacgtttaaccgttacgtttaaccgtaaaccgtacgtaccggttaaacgtaacggtaacggtttaccgggtacccgttaccgtttaccgtaccggttttaccggggaccgggtaaacgggtaaccggtaaaggggtacgggaacgtaacgtaacgaaaaccggtacgtacggtacggtaccgttacggaccgtaacccgtacgttccgttcgtttacccg

SEQ ID NO: 240166 - DNA, 570 bp, Homo sapiens
  misc_feature: GYAE6OF01EQDVX.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggagacagccaccctctcatgcagggccagtcagagtattagaacatacttggcctggtatcaatacaagcctggccacgggtccccggctcctcatctatgatgcttccagcgaggccacgtggcacgtcccagcctaggttcaggtcgggtcgggttagggtttcgacgtacgacgtacttcactctacaacactcgagccacgccctaccaactgaagtatttgactagtcttattactgtacaacagacgtacgagtacgtcggccgtcttcgtacgtttcgggacggtacgggaaccgtagggtaggaagtacgtaacgaaacgtacgtcgggtacggtcgtacgaccgaacctattcgtgttaccc

SEQ ID NO: 240167 - DNA, 577 bp, Homo sapiens
  misc_feature: GYAE6OF01DEX9A.45.35.D02.1.454.CMB.1.raw
  modified_base (202)..(202): a, c, t, g, unknown or other
  misc_feature (202)..(202): n is a, c, g, or t
  modified_base (391)..(391): a, c, t, g, unknown or other
  misc_feature (391)..(391): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcgagggccagtcagagtattagaacatacttggcctggtatacaatacaagcctggccgacgggtccccgctcctcatctatgatgcttcagcacgggccagtggcacgtcccagcctaggttcaggtggcgggttggtttcggcacgagtacttcacgtctacacaatcancacgcctacaactgtaatatttcgactacttctaatttactgtacaacgacgtacgtaacagtacgttcggaccgtcttccgtaacgtttccgggacgggtaaggtaccgaagggtaggaacggtataacgaaaacggtacgttacggtaggtaccgtacgaccaaccgtacgttcgtgtttaccg

SEQ ID NO: 240168 - DNA, 596 bp, Homo sapiens
  misc_feature: GYAE6OF01EJGSL.45.35.D02.1.454.CMB.1.raw
  modified_base (202)..(202): a, c, t, g, unknown or other
  misc_feature (202)..(202): n is a, c, g, or t
  modified_base (342)..(342): a, c, t, g, unknown or other
  misc_feature (342)..(342): n is a, c, g, or t
  modified_base (384)..(384): a, c, t, g, unknown or other
  misc_feature (384)..(384): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatactggcctggtatcaatacaagcctggccagggtccccgctcctcatctatgatgcatccaacgacgggtccctggccgtcccagacacggttccgnggcaggtggggtctggggacaggtacgttcactctcaccgtnagcagccgtggagcctagatgtaattttgacttagtttacttcgtgtcagctacggtccgttcccgcctaccggccgtctcgtaccgtttccgggggcgggggtaccgtagggggtcggacggtagtacgggacggtaaccggtaacgttgggtcgggtaccgttcggaccctaacccgtacgttcccgttcggttccctttccgtaacccg

SEQ ID NO: 240169 - DNA, 653 bp, Homo sapiens
  misc_feature: GYAE6OF01CQWHO.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggagacagccaccctctcatgcagggccagtcagagtattagaacatactggcctggtatcaatacaagcctggccgacgggtccccgctcctcatctatcgatcgtcttccgagcgacgggccacgtcggcacgtccccgagtccgtaggttcgagggtcgggtacgggttggggtttcgaccagtacgtacctttcaccgtctacacaatcgagccacgtcctacccgaaccgtagtaacgttacttttcgacttacgttcttaactacttacgttaaccaacgtacggtacgtaactaaggttacgttaccgggtcccgtacttaccggttacggtttccggggacgggtaacgggtaacggtaaagggtgggaacggtaacgtaacggtaaaaccggtaacgtgggttaccggacttcgggaacctaaccgttacttcggttcgttacccg

SEQ ID NO: 240170 - DNA, 544 bp, Homo sapiens
  misc_feature: GYAE6OF01B4C8W.45.35.D02.1.454.CMB.1.raw
  modified_base (203)..(203): a, c, t, g, unknown or other
  misc_feature (203)..(203): n is a, c, g, or t
  modified_base (438)..(438): a, c, t, g, unknown or other
  misc_feature (438)..(438): n is a, c, g, or t
  modified_base (513)..(513): a, c, t, g, unknown or other
  misc_feature (513)..(513): n is a, c, g, or t
  modified_base (519)..(519): a, c, t, g, unknown or other
  misc_feature (519)..(519): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccaccctgtctttgtttccaggggaaanagccaccctctcctgcagggccagtcagggtgttaacagctacttagcctggtaccaacaaaactgcacgctcccacggctcatcatctatgacgcatcgaaccgaagggccgactcggcgactcccacgccgaggttcagtggcgagtggggtcgtgggacgagacgttctacgtcttcaccactcagcacgcctcggaccctggaggtacttttgcctatttactactgtcancgagcgtcggcgaccgtacgcgctcgacgtttcggcgggagggaccgaggtggagaatcaaacgaactggtggcngccacntctcgtcttcatccttcccgctacg

SEQ ID NO: 240171 - DNA, 600 bp, Homo sapiens
  misc_feature: GYAE6OF01BJVCG.45.35.D02.1.454.CMB.1.raw
  modified_base (201)..(201): a, c, t, g, unknown or other
  misc_feature (201)..(201): n is a, c, g, or t
  modified_base (366)..(366): a, c, t, g, unknown or other
  misc_feature (366)..(366): n is a, c, g, or t
  modified_base (387)..(387): a, c, t, g, unknown or other
  misc_feature (387)..(387): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtatagaacatacttggcctggtatcaatacaagcctggccacgggtccccgctcctcatctatgatcgccttccgagcgacgggccacgtcggacactcccagcctaggtcagtcgggcggttggttgcacgngtacttcactctacacatcancacgtcctaccgtactagtaagtacgttttcgactacgttacttaactttacgtcgttacaactacggtacgtaacgtagtacgttcgggaccgtccttcgtacggttacgggaccggtaacgggaacccgtaagggtacggaagtaacgtaacgaaaacggtaacgttggtacgggtacgtacggacctaacccgtcttccgttcgttaccc

SEQ ID NO: 240172 - DNA, 557 bp, Homo sapiens
  misc_feature: GYAE6OF01BR5XW.45.35.D02.1.454.CMB.1.raw
  modified_base (201)..(201): a, c, t, g, unknown or other
  misc_feature (201)..(201): n is a, c, g, or t
  modified_base (397)..(397): a, c, t, g, unknown or other
  misc_feature (397)..(397): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttcagcaggccactggcactcccagccaggttcaggtggcggtgggttgcacgagacttcgactctcacaatcagcacgcctaccaactgaactntttgctagttctattactagtcaactagcgtaacagtagttcggcccgtcttaccgtaccgtttcgggacgggtacgggtacccgaaggggtacggaagtaacgtacgaaaaccggtacgttcggtacgggcttcggacctacctacttcgttgttaccc

SEQ ID NO: 240173 - DNA, 536 bp, Homo sapiens
  misc_feature: GYAE6OF01BPJH5.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccactggcactcccagcctaggttcaggtggcggttgggtttggccacagacttcactctacacatcagcacgcctaccaaccctgaagtattttgctagttctatttactgtacaacagcgtaacagtacgttcggccgtctcgtacgtttcgggacggtagggaccgtaagggtggaagatacgaaacgaacgtggtcggctcgaccaccattcgtgttaccg

SEQ ID NO: 240174 - DNA, 613 bp, Homo sapiens
  misc_feature: GYAE6OF01C812W.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcgaggccagtcagagtattagaacatactggctgtatacaatacaagcctggccacgggtccccgctcctcatctatgatcgctcagcagggccagtgacactcccagccgtaggttcgaggtcggcgggttgggtttcgcgacgtagtaccttcaactctacaactactcgagctacgcctaccgaactgtaacgtatttgactagttacttaattactacgttacaagtacgtacgttaaccgaagtcgttaccggaccgtaccgttacctaacgggttttccggggacggtaacgggtaaccggtaaggggtacggtaacgtaacgtacgtaaaacggtacggttacggtcggtacgtacgtaaccgaaccttagttccgtaggtttacccg

SEQ ID NO: 240175 - DNA, 654 bp, Homo sapiens
  misc_feature: GYAE6OF01A846F.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctcagccattctgtctctctctccgagggganacagcccacctctcatgcagggccagtcagacgtattagaacattacttggacctggtatacaatacaagcctggaccacgggtccccgctcccgtcactcctatcgatcgtccttccagtcgacggcctactggacctatcccagccgaggttcaggtcggcggttgggtttcgctacgacgtaccttcaacttcgactaactatcagccacgtccctacccgtaactagtaacgtacttttcgaccgtaagttacgttaactttaacgtcgtaacgaacgttacgacgttaacgtaaggtaacgtttccggaccgttaccgttaccgtaccgggtttaccggaaccggggtacgggtaacccgtaagggtacgggtaaacgtacgtaccggtaaaaacggtcgtacggtcggtacgtacggacccgtaaccacgtttcggtacgtttaccc

SEQ ID NO: 240176 - DNA, 507 bp, Homo sapiens
  misc_feature: GYAE6OF01BCPLQ.45.35.D02.1.454.CMB.1.raw
  modified_base (201)..(201): a, c, t, g, unknown or other
  misc_feature (201)..(201): n is a, c, g, or t
  modified_base (438)..(438): a, c, t, g, unknown or other
  misc_feature (438)..(438): n is a, c, g, or t
  modified_base (498)..(498): a, c, t, g, unknown or other
  misc_feature (498)..(498): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggcctggtatcaatacaagcctggccagggtccccgctcctcatctatgatgcttccagcagggccactggcatcccagccaggttcagtggcggtgggtttcgcacagtactcactctcacatcagcagcctaccaacctgaagtatttgactagttctattactgtcaacagcgtacagattcggccncttctacgttcggacggagggaccagggtggacgagtacaacgtactagtggctagcacntccgtgtcc

SEQ ID NO: 240177 - DNA, 698 bp, Homo sapiens
  misc_feature: GYAE6OF01C3UX7.45.35.D02.1.454.CMB.1.raw
  modified_base (150)..(150): a, c, t, g, unknown or other
  misc_feature (150)..(150): n is a, c, g, or t
  modified_base (201)..(201): a, c, t, g, unknown or other
  misc_feature (201)..(201): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccgganaaattgtcttgacacagtctccagccattctgtctctctctccgagggganacagccaccctctcatcgcagggccagtcagagtattagaactatacgttggcctggtatacaatacaagcctggccagggtcccccgctcctcactctatgtatcgcttccagcgaggcccacgtggccacgtcccagcctaggttcgaggtcggtacgggttgggtttcggcgtaactaggtaccttctaacgtcctaccaactaacgtaccagtacccgaccgacccttaacccgaacgttaaggaacgtttcgtttaccgactaacgttttctaaccgtttacgtaccgtaacgtaacgacggttacggtaaactacggttacgtttcccgggtaaccctcttaaccggttaccggttaaccggggtccggaaacggggtaaccctaaagggggtacgggtaaccgaaacgttaaccggtaaaaccggtaccgttcggggtacgtacccgtacgaaccccgtaacctttacgttacccggttcggttaacccc

SEQ ID NO: 240178 - DNA, 638 bp, Homo sapiens
  misc_feature: GYAE6OF01E5ZZ2.45.35.D02.1.454.CMB.1.raw
  modified_base (203)..(203): a, c, t, g, unknown or other
  misc_feature (203)..(203): n is a, c, g, or t
tcagacgcgatcgacacgaccggtgctcgatttagcacacgataggttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctctcatgcgagggccagtcagtagtaattagaactattacttggcctaggtatacaatacagccgtggccgacgggtccccgctcctcatctatcgtatcgcttccgaaggccgacgggtcccacgtcggacctaccgtcccgacggtccgtagggttccgagggtcggggtcgggttgggtttacgcctaacgtacgtaccttcacgtctacacaatcgacgcacgaccctaccgaacgtagtaacgttatttcgacttagtacttaattactacgtaacaacgtacgtacgtaacgagtcgttcggccgtaccgttaccgtacggttccgggacgggtaacgggaccgtaaagggtggaacggtactaacgaaacggtacgttcggtacggtcctagaccctacctcgttcgtcgttcccg

SEQ ID NO: 240179 - DNA, 533 bp, Homo sapiens
  misc_feature: GYAE6OF01EBAPL.45.35.D02.1.454.CMB.1.raw
  modified_base (151)..(151): a, c, t, g, unknown or other
  misc_feature (151)..(151): n is a, c, g, or t
  modified_base (201)..(201): a, c, t, g, unknown or other
  misc_feature (201)..(201): n is a, c, g, or t
  modified_base (507)..(507): a, c, t, g, unknown or other
  misc_feature (507)..(507): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccgganaaattgtcttgacacagtctccagccattctgtctctctctccagggganacagccaccctctcatgcagggccagtcagagtattagaacatacttggcctggtatcaatacaagcctggccacgggtccccggctcctcatctatgatcgcttccagcagggccacgtggcatcccagccaggttcagtgggcggttgggtttcgcacagacttcactctcacatcagcagcctaccaactgaactatttcgctagtcttattactcgtacaacacgacgtaactagtagttcggcccgtctacctacgtttcggacgggtaggaccgaagggtggagactacgaaacgtacgngttacgcgtgacacctatcgtgttac

SEQ ID NO: 240180 - DNA, 521 bp, Homo sapiens
  misc_feature: GYAE6OF01DC0YG.45.35.D02.1.454.CMB.1.raw
  modified_base (200)..(200): a, c, t, g, unknown or other
  misc_feature (200)..(200): n is a, c, g, or t
  modified_base (283)..(283): a, c, t, g, unknown or other
  misc_feature (283)..(283): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccaggtccccgntcctcatctatgatgcttccagcagggccactggcatcccagccagttcagtgcggtggttgcacagacttcactctacacaatcagcagcctaccaacctgaagtatttgactagtctattactgtacaacacgtcgtaacagtagttacggccgcttactacgtttccgggacggtacgggaccaaagggtggaagtactacgaaacgactaggtagcgtgacaccatcgtgttac

SEQ ID NO: 240181 - DNA, 578 bp, Homo sapiens
  misc_feature: GYAE6OF01BKSMT.45.35.D02.1.454.CMB.1.raw
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatcgcttccagcagggccactggcatcccagccaggttcaggtggcggtgggtttgcacgagacttcactctacacaatcagcacgacctaccaacctgaacgtatttacgctagttacttattactgtacaacgtagtcgtaacagtaacgttcggtacccgtcttaccgtaccgtttcgggacgggtacgggaacccgtaagggtacgggtaacgacgttaacgaaaccggtacgttacggtacggtacgtcgaccgtaccacgttccgtgtttacccg

SEQ ID NO: 240182 - DNA, 596 bp, Homo sapiens
  misc_feature: GYAE6OF01ES50R.45.35.D02.1.454.CMB.1.raw
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
  modified_base (419)..(419): a, c, t, g, unknown or other
  misc_feature (419)..(419): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcaggccagtcagagtattagacatacttggcctggtatcaatacagcctggccagggtccccgctcctnagtatagtgtatcgcttccgagtcgacgggccacgtggactacgtcccagccgtaggtcaggtggtacggttgggtttcgcacgtagtacctctactactcaactactcacgctacgcctaccaactgaatntttacgactagtctattactagtacaactgtacgtacagtacgtcggtacctcgttacctacggttacgggaccggtaacgggtaccgtaaagggtcggtaacgtaacgtaacgaaaccggtcgtacgggtacgtaccgttaacgacgtaaacccgttcgtaacgttcgtttaaccg

SEQ ID NO: 240183 - DNA, 577 bp, Homo sapiens
  misc_feature: GYAE6OF01AMJ1P.45.35.D02.1.454.CMB.1.raw
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtattagaacatacttggcctggtatcaatacaagcctggccagggtccccggntccctcatctatgatcgcttccagcagggcccacgtggcatcccagccaggttccaggtgggcggttgggtttcggctacgacgacctttcgaacttccgtaccaacaacttcagcacgcctaccaacctagaacgtacttttgctatcttattacgtgtacaactagtacgttaacagtacgttcggcccgtccttacgtaccgtttacgggaccgggtaacgggaccgtaagggtggacgacgtacgaaacggtacgtaggtgacgtcgacctacacgtcgtcgttaccg

SEQ ID NO: 240184 - DNA, 624 bp, Homo sapiens
  misc_feature: GYAE6OF01B3091.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcgagggccagtcagagtatagacatactggctgtatcaatacaagcctggccacgggtccccggctccgtcatctatgatgcttccagcacgggccacgtggccactcccagccgtaggttccaggtgggccgggttgggtttcggctaacgacgtaccttcacgtctacacgtaactcgaacgtaccaacggtcccctacccaaacccgtacgtaaagttaacttttcgaccgtaacgtttacttaacgtttaccgtcgttaaccaacgtacgtacgtaacgagtaacgttcggacccgtctaccgtacgtttcgggacggtagggaaccgtaaagggtcgggtaacgtacgtaccgaaacggtacgtagtacggactcggaccaaccgtacttcgttcgttaccg

SEQ ID NO: 240185 - DNA, 615 bp, Homo sapiens
  misc_feature: GYAE6OF01DIUTC.45.35.D02.1.454.CMB.1.raw
  modified_base (201)..(201): a, c, t, g, unknown or other
  misc_feature (201)..(201): n is a, c, g, or t
  modified_base (288)..(288): a, c, t, g, unknown or other
  misc_feature (288)..(288): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggccttggtatcaatacaagcctggccgacgggtccccgntcctcatctatgatgtcttccagtcacgggcctacgtcggcactcccagtccgaggttcgaggtgggccgggttggggtttcgactacgtacggaccttttcaccttcgactaacatacacgaccgacgtccctacccgaacccgttagtaacgtaattttcgacgtacgttacttaacttactcgtaaccaacgtagtacgtaacgtagtacgttcggccgtcgttaccgttaccgtttcgggcggacgggtaaccgagggtacgaaggaacttacgaaacggtaacgtggtcgacgtcggacctacctacttcgttcgttacccg

SEQ ID NO: 240186 - DNA, 633 bp, Homo sapiens
  misc_feature: GYAE6OF01DOBEG.45.35.D02.1.454.CMB.1.raw
  modified_base (201)..(201): a, c, t, g, unknown or other
  misc_feature (201)..(201): n is a, c, g, or t
  modified_base (498)..(498): a, c, t, g, unknown or other
  misc_feature (498)..(498): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccgagggganacacgccaccctctcatgcaggccagtcagagtatagaacatacttggctgtatcaatacaagctggccgacggtccccgctcctctactctatcgatcgccttccagtcgaacgggccacgtcgaccactcccgagtccgtaggttccgaagggtcggggtcggttggggtttcggacaacgtacgttacctcctaacgtcctacaacgaacttccaagtccgaacgtcccctaccgtaaacgttcgtaaagttcttttacgacgttagtacttaactttactacgtactaaacgngtaactacgtagttacggttcggaccgtccgttacgtacggtttacgggaccgggttaaggaaccggagggtacggaagtacgtaacgaaacgtacggtcggtaggcgtacgcctaacgtacgttcgtgttaccg

SEQ ID NO: 240187 - DNA, 560 bp, Homo sapiens
  misc_feature: GYAE6OF01AJ3E4.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttcagcagggccacgtcggcatcccagccaggttcaggtgggcggttgggtttcggcacgagtacttcactctcacatcagcacgcctccaacctgaagtatttagctagtctattactgtactaacagtacgtaacagtacgttcggaccgtctacgtacgtttcgggacgggtacgggaccgtaagggtagggaacggacgtaccgaaaacggtacgtacggtacggacgttacgaccacctactccgtgttaccc

SEQ ID NO: 240188 - DNA, 924 bp, Homo sapiens
  misc_feature: GYAE6OF01AFEBR.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggtagggaactgctcagttaggacccagagggaaccatggaagcccagctcagcttctcttcctcctgctactctggctccagagacctccggagaaattgtcttgacacagtctccagccattctgtctctctctccgagggtanacagcccacctctcatcgcgacgggccaggtcagagttattagaactatacgttggcctggtactcaaatacaagccttggcctacggggtccccgccttccgtcaattcgtagtcgtattccgtccgttacctaggccgtacggggcccctaacgtcgggtaccacgttaccccgaggtcccgttaacgggttccgtaacggggtcggggttccgggggtttaggggttttaccgggacctaacggttaccggggttaccttttaccgtaaacccgtttcccgtaacccgttaaccccgttaagttacccggtaacggtaccgttaaccggtccccggtaccggttaaacccccggttagggttaacggttaaccggttttttcccgaacccgttttaaaccgtttttaccgttaacccggtttacggttaccgaaccgggttacggtaacccgggttaccgggttcggggtaaccccgggttacccgggtaaccggttaaccccggtccgttttaaccccgggtttaaccgggtttaccccggggaacccgggggttaaaccgggggtaaccccggttaaacggggggtacccggtaaaaccggggttacccttaaacccggggtaaaaccggggttacccgttacgggggttacggtacccggttaacggttaaccccttaacccgggtacctttcccggtttagggtttaacccccgg

SEQ ID NO: 240189 - DNA, 558 bp, Homo sapiens
  misc_feature: GYAE6OF01BG9ZZ.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagcccaccctctcatgcagggccagtcagagtatagaacatacttggcctgtatcaatacaagcctggccacgggtcccccggctcctcatctatgatgcttcagcagggccactggcactcccagccgaggttcgaggtcgggcgggttgggtttcggctacgagaccttcacgtctcacaactcagcacgccctaccaacctagaagtatttgactagtactattactgtacaacagcgtaacagtacgttcggccgtcttcgtacgtttcgggacggtacggggaccgtaaagggtggaacgtacgtaacgaaacggtacgtggtacgctcgaccacctacttcgtgttacc

SEQ ID NO: 240190 - DNA, 677 bp, Homo sapiens
  misc_feature: GYAE6OF01CJUZB.45.35.D02.1.454.CMB.1.raw
  modified_base (201)..(201): a, c, t, g, unknown or other
  misc_feature (201)..(201): n is a, c, g, or t
  modified_base (253)..(253): a, c, t, g, unknown or other
  misc_feature (253)..(253): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccgagggganacagccaccctctcatgcaggccagtcagagtatagaacatactggctgtancaatcaagctggccacgggtcccgctctgactcgtatgatcgcttacagcgagggccacgtggacatcccagcctaggttcagggtggcggttgggttcgcacgtaggtccttcactctacaactaacgtacgaggccaacgacccttaccgaaaccttacggtaaagttacgttttaggaccttaacggttacttaacgtttaacctaggttaacctaaacgtacggtaccgttaacgtaacgttacggtttaccgggtacccgttaccgttaccgttaccggttttaccggggaaccggggtaacggggtaaaccggtaacggggtacggaacggtaaacgttaaccgaaaaccgggtaacggttacgggtacgggtaccgtaccggaaccgtaacccgtacgttccggttagtttaccccg

SEQ ID NO: 240191 - DNA, 530 bp, Homo sapiens
  misc_feature: GYAE6OF01A2H1Q.45.35.D02.1.454.CMB.1.raw
  modified_base (202)..(202): a, c, t, g, unknown or other
  misc_feature (202)..(202): n is a, c, g, or t
  modified_base (510)..(510): a, c, t, g, unknown or other
  misc_feature (510)..(510): n is a, c, g, or t
  modified_base (521)..(521): a, c, t, g, unknown or other
  misc_feature (521)..(521): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatcgcagggccagtcagagtattagaacatacttggcctggtatcaatacaagcctggccacgggtccccgctcctcactctatgatgccttcagcgaggccacgtggccatcccagccaggttcgaggtggcggtggtttcggcacgagacttcactctcactatcagcacgccctaccgaaacctgaacgtatttcgactagtctattacctgtacaacgagtacgacgagtagtcggcctctctacgttcggcggtaacggacgaggtgagacgtacgaaacgacgttggngctacgcactntcgtcgttc

SEQ ID NO: 240192 - DNA, 514 bp, Homo sapiens
  misc_feature: GYAE6OF01BQWP6.45.35.D02.1.454.CMB.1.raw
  modified_base (377)..(377): a, c, t, g, unknown or other
  misc_feature (377)..(377): n is a, c, g, or t
  modified_base (469)..(469): a, c, t, g, unknown or other
  misc_feature (469)..(469): n is a, c, g, or t
  modified_base (479)..(479): a, c, t, g, unknown or other
  misc_feature (479)..(479): n is a, c, g, or t
  modified_base (490)..(490): a, c, t, g, unknown or other
  misc_feature (490)..(490): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaaggctcccaggctcatcatctatgacgcatcgaacagggccactggcactcccagccaggttcagtggcagtgggtctgggacagcttcactctcacatcancagcctggaccctgagtatttgcctatttactactgtcagcagcgtggcgacgagcgctcacgttcggcggagggaccaggtggagacgtanaaacgtacgngtggctagacncatctgtctctatcctccgctacg

SEQ ID NO: 240193 - DNA, 510 bp, Homo sapiens
  misc_feature: GYAE6OF01EKCAH.45.35.D02.1.454.CMB.1.raw
  modified_base (201)..(201): a, c, t, g, unknown or other
  misc_feature (201)..(201): n is a, c, g, or t
  modified_base (359)..(359): a, c, t, g, unknown or other
  misc_feature (359)..(359): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccaggtccccgctcctcatctatgatcgcttccagcagggccacgtggcactcccagccaggttcagtggcggtgggtttcgcacgngacttcactctcacatcacgcacgcctccaactgaagtatttgctagtctattctgtcaangacgtanagagttcgcctctctacgttcggcggagggaccgaggtggagacgtagaaacgtacgtaggtgactcgactacattctgttcc

SEQ ID NO: 240194 - DNA, 525 bp, Homo sapiens
  misc_feature: GYAE6OF01BFNAO.45.35.D02.1.454.CMB.1.raw
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (517)..(517): a, c, t, g, unknown or other
  misc_feature (517)..(517): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggagacagccaccctctcatgcaggccagtcagagtatagaacatattggctgtatcaatacaagctggaccacgggtccccgctcctcactctatgatcgcttccagcagggccagtggcactccagcctaggttcaggtgggtcggtgggttgcacgtagtaccttcacgtctacactaatcagcacgtcctaccaactagaagtatttgactagttctattactntacaanacgtactacagtcgttcgccgtctactacgttcggcggaacggacgagggtagagtactagaacggacgtggtagctagacactntcgtgtac

SEQ ID NO: 240195 - DNA, 695 bp, Homo sapiens
  misc_feature: GYAE6OF01CQ8TA.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctcggagaaattgtcttgacacagtctccagccattctgtctctctctccgagggganacacgccaccctctcatgcagggccagtcagagtataagacatacgtggcctaggatacaatacaagcctggacctacgggtccccgactcctacgattactagtgactcgcttaccagcgacggcacgtggacactcccgaggacctaggttcacgggttcgggacggtttggggttacgctaacgtacggtacttcaacgttcaacaataaccgtacacgaccacggaccccttaacgaacccttagtaaacgttaacttttgaccgtaggttacttaactttacgtagtactaacgtagtacgttaacaacggtacgttaccggtacccgtcgttaccgtaccggtttaccggggaccgggtaaaccgggtaaccggtaaagggtacggggaaacgttaaaccggtaaaccgtaaaacccgggtaagttaaccgggttacggaccgttaacgaacccgttaaccctaaacgttccgttacccggtttaaccg

SEQ ID NO: 240196 - DNA, 532 bp, Homo sapiens
  misc_feature: GYAE6OF01D12JT.45.35.D02.1.454.CMB.1.raw
  modified_base (307)..(307): a, c, t, g, unknown or other
  misc_feature (307)..(307): n is a, c, g, or t
tcagacgcgatcgacacgaccggtgctcgatttagcacacgatagttgggtttggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaacctggccaggctccaggctcatcatctatgacgcatcgaacnggggccacgtggccatcccgagcctaggttcaggtggctaggtgggtctgggacagacttcactctcacatcagcagcctggacctgtaggtatttcgacctatttactactgtcagcagcgtcggccgacgagcgctcgtacgttcgggacgggtaggaccgagggtgagactacgaaacgacgtgtcggctgcacatctacgtcttcacttcctcccgtctac

SEQ ID NO: 240197 - DNA, 658 bp, Homo sapiens
  misc_feature: GYAE6OF01B9KA8.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagataccactggagaaatagtggtgacgcagtctccaggcaccctgtctgtgtctccgaggggagagagtcaccctctcctgcacggccagtcaaagtgttcgcaccggatactagcctggtaccagcagagacctggccagccctcccaggcctcctcatctagtggtgcatccctcgacgggcctcgtggtcgtccccgcgtaggttcaggtggctaggtcgggtctgggacaggtacgttccacgttctacacctagtcgagcacgccgtgacgtagtctaggtaagttattttcggacgtttaattttacttagtttcggttacttacgtacttaatttaagtaaacgttacggtccgttacgggtacccgttaggggttaacccggtttcccgggaacccggtaacggggtacccgtaaggggttaacgtaaaacgttaccgtaaaacgggtaaccgttgggtacggtaccttacggtaccctaacccgtatttcccggttcgttccgtttacccg

SEQ ID NO: 240198 - DNA, 571 bp, Homo sapiens
  misc_feature: GYAE6OF01DMKFJ.45.35.D02.1.454.CMB.1.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (382)..(382): a, c, t, g, unknown or other
  misc_feature (382)..(382): n is a, c, g, or t
  modified_base (547)..(547): a, c, t, g, unknown or other
  misc_feature (547)..(547): n is a, c, g, or t
tcagacgcgatcgacacgaccggtgctcgatttagcacacgatagttgggtttggggaggaactgctcagttaggacccagagggaaccatggaagcccagctcagcttctcttcctcctgctactctggctccagagacctcggagaaattgtcttgacacagtctccagccattctgtctctctctccgagggganacacgccaccctctcatgcaggccagtcagagtatagacatagtggctggtatcaatacaagctggccgacgggtccccgctcctnactctatgatcgtcttccagccagggtccagtcggacactcccagcctaggttcaggtgggcggttgggttcgacacgtagtacttcgactctacaanaactctagctacgcctaccaactagaacgtatttcgactagttcttaacttactagtaacaacgacgtacgtacgaaggttcgtacgggtcctacttcgttacgttcgggacgggtaaggaccgaagggttacgaggtaactaagaaacgtacgtggtacggacncggtaccactacgttctgttaccc

SEQ ID NO: 240199 - DNA, 200 bp, Homo sapiens
  misc_feature: GYAE6OF01A0XLR.45.35.D02.1.454.CMB.1.raw
  modified_base (198)..(200): a, c, t, g, unknown or other
  misc_feature (198)..(200): n is a, c, g, or t
tcagacgcgatcgacacgaccggtgctcgatttagcacacgatagttgggtttggggaggaactgctcagttaggacccagagggaaccatggaagcccagctcagcttctcttcctcctgctactctggctcccagagacctccggagaaattgtcttgacacagtctccagccattctgtctctctctccgagggnnn

SEQ ID NO: 240200 - DNA, 780 bp, Homo sapiens
  misc_feature: GYAE6OF01D4KR0.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgcccaccctctcctgccagggccagtacggagtcgtacagtaagttacgtaggctaggtaaccaacacgtaaacctggaccagggcctcccgaggtcctcctacactccatgtactgacctactaccaacgtacgggtccctggccgtacccagtaccgtacgggttcccgtgggacgtaggtcgggtacgtacggggaacaggtacgttaccacgttccgtaccgacggttcaacgtcgaccgtccggtacgggacgtccgtagtacgttacgtttagttttcgaccgtttacgttttaccgttcgtcggttacacggtccgtaacggttccccgtttacccggccctaacccgggtcccgttaccgttcccgtttaccgggggtttaccgggggaaccgggggggttacccgtaagggggttccgggtaagtacgggttaacgggaaccggttaacggtaccggttacgggtaccgggtccgttaccgggtaccctaccggttacgtttcccgtttacggtttaccccttacgttaaccccggtttccccgttcccccggtctttaacccgg

SEQ ID NO: 240201 - DNA, 793 bp, Homo sapiens
  misc_feature: GYAE6OF01DN22L.45.35.D02.1.454.CMB.1.raw
  modified_base (785)..(785): a, c, t, g, unknown or other
  misc_feature (785)..(785): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagagacctccggagaaattgtcttgacacagtctccaggccattctgtctctctctccgagggagacacgccaccctctcatcgcgaggccagtcagagtattagaacatactggctggtatacaatacaagcctcggaccgacgggtcccccgctcctcactctagtgatgtccttccgaggtccgacgggccaacgtcgggacctaccgtaccccgacgtacccgtacgggtttaccgtaacggggttcggggtaccggggtttgggggttttaccggaccgtaaccggtaacggttaccctttacccgaaccctttacccgttaaaccaaacccgttaaacgttcccgaaacggtaccccgtaacccggttacccccttaaccccgtaaaaacccggtttacggttaaaacgttttaacctttttcgggaacctttaggtttaacctttaaaccgttttaaccgtacgttaacccgaaaacgttaccgggtaactttaacggaacggttacgtttacccggggaccgttaccttttaccgtaaccggtttccggggaaccgggtaacggggtaaaccgaaggggttaacgggaacgtaaacgtaaaccggaaacgtacggttggtacggactacgacctactcgttntcgttacc

SEQ ID NO: 240202 - DNA, 581 bp, Homo sapiens
  misc_feature: GYAE6OF01EC7SW.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttcagcagggccactggcactcccagccgtaggttcaggtgggtcgggttggggtttcggcacgagtacttcactctcaactaactcacgcacgcctaccaacctgaacgtattttcgctagttcttattactcgtactaacgagtacgtaacagtacgttcgggcccgtcttcgtacgtttccggggacgggtaaccgggaaccgtaagggtacggaacgtaacgtaacgaaacggtacgtagggtacggcgtacggacctaaccgtattccgtgttccc

SEQ ID NO: 240203 - DNA, 730 bp, Homo sapiens
  misc_feature: GYAE6OF01CUF6C.45.35.D02.1.454.CMB.1.raw
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
tcagacgcgatcgacacgaccggtgctcgatttagcacacgatagttgggtttgggggaggaactgctcaagtttaggacccgagagggaaccatggaagccccagctcagcttctacttcctcctgctactctggctcccagagacctccggagaaattgtcttgacacagtctccagccattctgtctctctctccgaggganacngccgaccctgtcagtcgaccgtacgggcccagtcaacgtacgtaacttaaggaacctattaccgttcggcccttgggtactcaatacaacgccgtaggccgacgggtcccccggactcctcactctacgtcgtacgtcgtctccgaggtcacggggcctacgttcggaccactcccgaggcctaggttaccgagggttcggtcggggttgggtttacggccgtaacgtaacgtaccgtttacgaccttcgtaccaactaacttccgaacgtccaacgtacccctacccgaaaacccgttggtaaacgtttacgttttcggacctaaggttaccttaacgtttacctcggttaaccaaacgtacgtacgttaaacgtaacggttacgtttaccgggaccgttaccgttaccgttaaccggtttcgggaccgggtaacggggaccctaaaggggttcggaacgtacgtaacgaaaaccggtcgttcggtagtccgtacggacctacctacgttcgttgttaccc

SEQ ID NO: 240204 - DNA, 558 bp, Homo sapiens
  misc_feature: GYAE6OF01CIN1J.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtatagaacatacttggctggtatcaatacaagcctggccagggtccccgctcctcatctatgatcgcttccgagcgacgggccacgtggcactcccagcctaggttcagtcgggcggttgggttgcacagacttcactctacacaatcacgcacgcctaccaacctagaagtatttgactagtacttattactcgtacaacagtacgtacagtacgttcggccgtcttcgtacgtttcgggacggaacgggaccgaagggtaggaggtacgtaacgaaacggtacgtacggtacggtccgtacgaccacctacgtcgttcgttacc

SEQ ID NO: 240205 - DNA, 945 bp, Homo sapiens
  misc_feature: GYAE6OF01DG1H4.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctcagccattctgtctctctctccgagggganacacgccaccctctcatgcagggccagtcagagtatagaacatacgtgctgtatcaatacaagcctggccacgggtccccgctcctcactctatggtatcgtccttccgagcgacgggcccacgtcggcctacgtccccgagtcccgtaaggttccgaagggttcgggtacggggtttcggggtttcggacctaacggtacggtaaccctttaccgtaccgtttacccgtaccgtaaaccgtaaacgttacccgaacggtacccgtaacccggtacccccgtttaaccccgtaaaaccccggtttaacgggttaaaaccgtttaaccgtttttttaccgggaaccgtttaacgttttaacccgtttaaaccgttttaacccggtttaaccggttaaaccccggttaaaccggttaaccgggttacccggtttaaaccgtaaccgggtttaaccggtttacccgggggttacccccgttaaccgtttacccggtttaacccgggtttttacccgggggggaaacccgggggttaaaacccggggggtaaaccccgggttaaaacggggggttaaccgggggtaaaacggggtttaaaaccggttaaaaccccgggtaaaaaaacggggtttaaaccccgggtttaacggggttaacccggggttacccgggtttaacccgggaaaccccggtttaaaccccggttaaccggtttttaccccgtttaccggggtttttaaccccccg

SEQ ID NO: 240206 - DNA, 805 bp, Homo sapiens
  misc_feature: GYAE6OF01BVQL8.45.35.D02.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccaggcaccctgtctctgtctccagggganacagccaccctctcctgcagggccagtaggatgtcagtaagtacttaggctggtaccaanagaaacctggccaggcctcccgaggcctcctcactccagtgatcgcactccaacgacggggtcccctggccctacccgaaggaccgtacgggttcccgtgggctaggggttcgggtcgtagggggaacctaggtacggtttccaaccgttccgtacccgaacccgggttcaacggccgaacggtcccggttagggaaccggtcccgtaggtagttacggttacgtttttcggaccgttttaacgttttaaccgtttccgtttacggttaccgtaacggtcccgtaaccgggttccccggtttacccccggtacccgtaacccgggtcccggttacccgtttaccggttaccccggggttttacccggggggtacccggggggggtaacccggttaacggggggttacgggtaacggtacggttacgggaaaccgggtaaccgggtaaaccggttgggttaccgggtaccgtacggtacccgtacccgtaacgttccgttacggtttacctttaccgttaccgtttccccgttccccggtaaccc

SEQ ID NO: 240207 - DNA, 255 bp, Homo sapiens
  misc_feature: GYAE6OF01B70PB.45.35.D02.1.454.CMB.1.raw
  modified_base (251)..(255): a, c, t, g, unknown or other
  misc_feature (251)..(255): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgaactgtgctgcaccatctgtcttcatcttcccgcatctgatcgatcgcgtctgagcgggctggcaaggcgcatagnnnnn

SEQ ID NO: 240208 - DNA, 788 bp, Homo sapiens
  misc_feature: GYAE6OF01B29CJ.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccgaggganacagccaccctctcatgcgagggccagtcagagtattagaactatactgctaggtatacaatacaagcctggaccacgggtccccgactccgtcattctactgatcgcttaccgagacgacgggccacgtcggctaacgtccccgagtacccgtaacgggtttccgaacggggttcggggtaccggggtttcgggggttttacgggacccgtaaaccggtaacgggtaaccctttcgaaaccgtttccttaccgaaaccgtaacttacccgaaacgggtccctaaccggtaaccccctaacccggtaaaccccgttaagggtaaacgtttaacgtttttacggacccgttaacggttttaccttaagtttaaccgttacggttaaacctaaaccgttacgggtaaccgttaaacgtaacggttacgtttacgggtcccgtaccttaccggttaaccggtttaccggggacggggtaaaccgggtaaccggtaaacggggtacggaaacggtacgtaaacggaaaacccggtacgttacgggtacggtacctccgggtaaccctaccgttacttcgtcgtttaaccccg

SEQ ID NO: 240209 - DNA, 631 bp, Homo sapiens
  misc_feature: GYAE6OF01CJOXU.45.35.D02.1.454.CMB.1.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcaggccagtcagagtattagaacatacttggcctggtatcaatacaagcctggccacgggtccccgctcctnactctatgatcgtccttccagccacgggcctagtcgcactccagcctaggttcagtgggtcggttgggttcgacacgacgtactttcgaaccttcgtacaacgtatcacgacacgtaccctacctaaacccgtagaaacgtttcttttacggacttaacgttacttaactttacgttacgtaacctaacgtacggtacgtaacgtagtaacgtttcgggacccgtcttacgtaccggtttacgggaccgggtaagggtaccgaaagggttggaaacgtactaacgaaaacggtacggttcgtacgggacttcggaacctaccctagtccgttggttaccc

SEQ ID NO: 240210 - DNA, 724 bp, Homo sapiens
  misc_feature: GYAE6OF01A7TT3.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctccagataccaccggaaaattgtgttgacacagtctccaggctaccctgtctctgtctccgaggggagacacgcccaccctctcctgcgacgggccaggtaggagtgtacaagtaagtacgttaggcgtacggtaccaaacgaacgtaaaccgtggaccgacggcctaccgaggtcctaccgtcactcagtgatcgcactaccaacgtcggtccctacggtccgtaccgagtaccgtacggttccgtgggacgtaggtcggtcggtacgggacgtacgtacgttaccgtactccgtacgacccgtcgaacgtcgacgtccgtagggactccgtagtacgttcgttagttttcgtacgtttacgtttcgttcgttacgacgtacggtcgtccgtacccggttcccgtacgcccgtccggtcccgtttacgtaacccggggtttccggggggaaccggggtccggtaagggttccgggaacgtacggttaacgggaacggtaacggtaccgttgggcccggtcttaccggacgtaccctaggttccggtttactccgtttaacccgaccgttttccccgtcccggtaattccg

SEQ ID NO: 240211 - DNA, 678 bp, Homo sapiens
  misc_feature: GYAE6OF01D7J1Z.45.35.D02.1.454.CMB.1.raw
  modified_base (202)..(202): a, c, t, g, unknown or other
  misc_feature (202)..(202): n is a, c, g, or t
  modified_base (247)..(247): a, c, t, g, unknown or other
  misc_feature (247)..(247): n is a, c, g, or t
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctaccgagggganacacgcccacctctcaatgccgaggccagtcagagtatagaactntactggctggtactacaatacaagcctggcctacgggtccccgctccgtcatctangtatcgaccttccaggccgacgggcctacgtcgggacctaccgaggtaccgtacgggtttccgngggacgtagggttcggggtcgacggggtaacaggtacgtttaccaacttccgtacaaccggtcagcgaacgccgtaggacgtcccgttagcgttagttatttcgcgtttaacgttttcgtctgtacgtaacggccttacggtccggttcccgaccgacccggtacccgtcttaccggtacgggtttccgggggaccgggggaccgtaagggggtcggacggtaaggttacggaaacggttaacgggaacggttcggacgggtacgtaccggtaaccggtaccctaaggttccgttggttacccttaacccg

SEQ ID NO: 240212 - DNA, 581 bp, Homo sapiens
  misc_feature: GYAE6OF01DTCXF.45.35.D02.1.454.CMB.1.raw
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
  modified_base (391)..(391): a, c, t, g, unknown or other
  misc_feature (391)..(391): n is a, c, g, or t
  modified_base (438)..(438): a, c, t, g, unknown or other
  misc_feature (438)..(438): n is a, c, g, or t
  modified_base (457)..(457): a, c, t, g, unknown or other
  misc_feature (457)..(457): n is a, c, g, or t
  modified_base (537)..(537): a, c, t, g, unknown or other
  misc_feature (537)..(537): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctcggagaaattgtcttgacacagtctcagccattctgtctctctctccgagggganacagcccaccctctcatcgcgacgggccagtcagagtatagaacatactggctgtatcaatacaagcctggccgacggtccccgctcctnatctatgatcgtctccagcgagggccacgtggcactcccgagcctaggttcgaggtgggtcgggttcgggttcgacgtacagtacttcgactctacaactancagcacgcctacgaactgaacgttattcgacagttactacttacgtntaacgaacgtcgtacgtanaacgtgttacgggtcctacgttccgtacggtttaccgggacgggtaacgggtaacgaagggttcggaagtaaccggtaanaaacggtacgtggtacggactcgaactacctatccgttgttacc

SEQ ID NO: 240213 - DNA, 677 bp, Homo sapiens
  misc_feature: GYAE6OF01B0ZCE.45.35.D02.1.454.CMB.1.raw
  modified_base (329)..(329): a, c, t, g, unknown or other
  misc_feature (329)..(329): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggacacacgccaccctctcatcgcaggccagtcagagtatagaacatacgtggctgtatacaatacaagccgtggccgtacgggtccccgctccgtcacttctatcgatcgtcttccagcgagggccacgngcactcccgagtccgtaggttcgaggtcggggtcggttgggtttggacacgtacgtacttacgaccttctaaccgactaatcgacgtacaccgtaccctaacccgtaaacgtaacgttaacgttacgttttcgacgttacgttaccgtttaaactttaccgtacggtttaactaacgtacggtaaccgtaacgtaaggtaccgttaccgggtccgtacccgttaccgttacccggtttacgggaaccggggtaaccgggtaaccgtaacgggttacgggtaaacgtaacgtaacggaaaacggttcgttacggtcggtacgtacgacgtaccgtagttcgtcgttacc

SEQ ID NO: 240214 - DNA, 703 bp, Homo sapiens
  misc_feature: GYAE6OF01DIEBC.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggnacagccaccctctcatgcagggccagtcagagtattagaacatacttggcctggtatacaatacaagtccgtggcccgaggggtcccccgctccgtcatctatgatcggcttaccgagcgacgggtcccacgtggccacgtccccgagtcccgtaggtttccgaagggttcgggggtcggggtttaggggtttcggacctaacggtaacggtacctttaccaaccgtttcctaccaacgtaactcgaacgccaaccggtcccctaacccgaaacgttaggaaacgtttacgttttcgacctacgtttacttaacgtttactacgttaacccaacgtacgggtacctaaacgtaggttaaccgttccgggacccgtccttaccggttaaccggtttcggggaccgggtaacgggtacccggtaaggggtcggaaacggtacgtaaccggtaaacggtacgttagggtcggacgttaccgacctaccgttaatcgttcgttccc

SEQ ID NO: 240215 - DNA, 611 bp, Homo sapiens
  misc_feature: GYAE6OF01BJJKW.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccacctctcatgcagggccagtcagagtatagacatacttggcctggtatcaatacaagcctggccacgggtccccgctcctcatctatgatcgccttcgagcgacgggcccacgtggacctactccccgagtcccgtaggttcctaacgggtggggtcgggttggggtttcggccgtaacgtacggtaccttcacgttcctacgaacaacttcacgaccacgtacccctacctaaaccgtagtaacgtattttacggactaagttactaactttacgtacgttacaacgagtaccgtactaagtagtccgggtacctccttacgtacgtttcgggacggtacgggactagggtagagaactacgaaacgtacgtggtacgacgtcgacaactctcgtgttaccg

SEQ ID NO: 240216 - DNA, 783 bp, Homo sapiens
  misc_feature: GYAE6OF01D9EMM.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcgaggccagtcagagtatagaacatacttggcctggtatcaatacagcctggccacgggtccccgctcctcatctatgattcgcttccgagcgacgggtccacgtggcctacgtccccaaggcccgtaggtttccgaggttcggggtccgggttggggtttcggaccgtacgtaacgtaccgtttccgaacgttcctaacctaacgtaaacttaccgaacgtacccgtaacgtcccctaacccgtaaacccgttaaggtaaacgtttacgttttacggacgttaacggtttactttaaacgtttaccgtacgttaaccgtaaacgtacggtaacgttaacgtaacggttacgtttaccgggacccggttacctttaccgtttaacccggttttaccgggggaacccgggtaacgggggttaaaccccgtaaagggggttaaccgggtaaacggtaaacggttaaccccggtaaaaaaccgggttcggttaaaccggggtacggtacccggtttaacgggaaccccttaacccggtaccgtttccgtaacccggttttaaccccg

SEQ ID NO: 240217 - DNA, 933 bp, Homo sapiens
  misc_feature: GYAE6OF01BVVXR.45.35.D02.1.454.CMB.1.raw
  modified_base (198)..(198): a, c, t, g, unknown or other
  misc_feature (198)..(198): n is a, c, g, or t
tcagacgcgatcgacacgaccggtgctcgatttagcacacgataggttgggtttggggaggaactgctcagttaggacccagagggaaccatggaagcccagctcagcttctcttctcctgctactctggctccagagacctccggagaattgtcttgacacagtctccagccattctgtctctctctccgagggganacgacgccaccctctcagtcgcgacggactagtacgagtagtagtaacggaactacgttacgtcggtaccgtacggtaactaaccgtaagtaccgaaacgtccgtacgggaccgtacgggttccccgcttaccgttacgacttcgtaactacggtataccgtactccggaacgccggaacgggtcctacggtacggtaccaccgtacccggtaggtaccggtaacggtttcgaacggggttgggtccggtttagggggtttaccggactaacggtaccgtttacgttacccggtaactttaccgaaacgtaaccgtaacgttaccggacggtaaccgtaaccggtaccccctaaaacccggtaacgtaaccgggttaagttttaactttaccggtaacgtttaaccggtttactttaaacgtttaacgtaccggttaaaccgaaccggtttaaccggtaccgggtttaaaccgttacgggttaacccggtttaccggggttaacccccgttaacccgggttaccgggttttaacccggggtaacccgggggttaaacccgggggtaaacgggtaaaccccgggttaaagggggttaaacgggtaaaaaccggtttacccgtaaaaaacccggggttaaacccgggtaacggggttacgggtaaccgggttaacccgtttaaaccgggtaaccccgttactaaaacccggtttttcgttaacccgggtttaacccc

SEQ ID NO: 240218 - DNA, 750 bp, Homo sapiens
  misc_feature: GYAE6OF01B98EG.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatcgccttccagcgagggcccacgtcgggaccactcccgaagcccgtaggtttccgaaggttcggggcggggtttggggtttcggccgtaaccgtaggtaccctttcgaaccgtttacctaccaaaccgtaactccgaacggacctaaccggtaccccttaacccgaaaccccgttaggtaaacgttacgtttttcggacttaacggtttacctttaacgtttaaccgttacggttaaccctaaaccgtaacggtaaccggttaaacgtaacggtacgtttccggggtaccccgtaccgtttacccgttaaccggttttacccgggacgttacggggtaaaccggggtaacccggtaaaggggtacgggtaaaggtaacgttaaccggaaaaaccggtacggttaacggtacgggtaccgttaggacccgtaaccgtagttcccggttaacgg

SEQ ID NO: 240219 - DNA, 729 bp, Homo sapiens
  misc_feature: GYAE6OF01CY2PQ.45.35.D02.1.454.CMB.1.raw
  modified_base (151)..(151): a, c, t, g, unknown or other
  misc_feature (151)..(151): n is a, c, g, or t
  modified_base (202)..(202): a, c, t, g, unknown or other
  misc_feature (202)..(202): n is a, c, g, or t
  modified_base (354)..(354): a, c, t, g, unknown or other
  misc_feature (354)..(354): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccgganaaatagtgatgacgcagtctccagtcaccctgtctgtgtctccgagggganaccggccaccctctcctgcgacgggccagtctagtatgttagccaactattagccgtaggaaccaactagacgacctgcccaggcctacccaaactcctctactctcgtggttactatcctaccgcggtcctacgtggtcgtcccagtacgnggttacgaagggcgaggttgggtcgtcgggtaacaggtagtttcgtactcctaccacctaatccgaaggtccgctcgactagtccgtagtaacgttagttttacggttaacgttttattaacgttgttacgtagtacttaaggttaacttaacgttaccgtaccgttacgggttacccggtttaaccgttaaccgggtttttaccggggacccggggggtaaccgtaacgggttccggtaacgggtacgtaaacggttaaaccgtaaaacccggtaacggttacgggttacggtaccggttacgaaccctaacccgtacgttaccgttcggtttacccttacgttaaccttttcccgtaccccgttccttaaccg

SEQ ID NO: 240220 - DNA, 652 bp, Homo sapiens
  misc_feature: GYAE6OF01BEKWD.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatcgcagggccagtcagagtattagacatacttggcctggtatcaatacaagcctggccacgggtccccggctcctcatctatgatgcttccagcagggccacgtggcatcccagcctaggttccagggtcggcgggttagggtttggccgacgtagtactttacgactccgtacaacgtaatcgacgaccacgtccctaacccgaacccgtaggtaacgtagtttttagacctaaggttaccttaactttacgttagtaccgaacgacgtacgttaaacgtagtaacgttcggtacccgtccgttaccgtacgtttaccgggaccgggtaacggggtaccggaaaggggttacgggtaacggtaacgttaaccggaaaacggttaacgtacgggttaggtaccgtacggacctaccgtacgtccgttcgttaccg

SEQ ID NO: 240221 - DNA, 813 bp, Homo sapiens
  misc_feature: GYAE6OF01EGU4T.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaacgagaaacctggccaggcctcccaggctcctcactccatgatgacactaccaacgacgggtccctggccgtcccgagacgtacggttccgtggcgtaggtggtacgtgggacagtacgttcacttcctacgaccgtacacgactacggccgtacggacgtcccgttaggacgtttaggttacgtttttacggacgtttaacgtttttaaccgtttcgttacggttacccgtaacggttaccgtaacccgggttaccccggttttacccccggaccccggttaaccccggtcccccggttacccgtttaccccgggtttacccggggtttttaccccgggggggaacccgggggggggtaccccgggttaacgggggggttacggggtaaaccggtacgggttaacgggtaaaccgggttaacccggtaaccgggtttacgggtacggggtccgttaccgggaccccgtaacccgtaaccggtttccgttaccggttttaccctttacccgttaacccgtttcccccgtttccccgtaccccgtttaaccgg

SEQ ID NO: 240222 - DNA, 698 bp, Homo sapiens
  misc_feature: GYAE6OF01A0G9Q.45.35.D02.1.454.CMB.1.raw
  modified_base (199)..(199): a, c, t, g, unknown or other
  misc_feature (199)..(199): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagacgacctccggagaaattgtcttgacacagtctcagccattctgtctctctctcgaggganacagccacctctcatcgacgagggccagtcagagtattagaactatacttggcctaggtactacgaaatacaacggtcctggaccgtacggggtcccccgcttacctcctacttactacgtacgtactcgtccttccgaacggtccgacgggtccacggttaggacctaacgtccccgtacgccgtaacggtttccgaacgggtcggggtacgggttcgggtttcggacgtacggtacgtaccgttctaaccgttcgtactaacctaactacgtacgctaccgtacctaacccaaacccgttagtaacgttacgtttacgacttacgttacgttaactttactacgtacgtaactacggtacgtaaccgagttacgttcgggaccgtccgttcgttaaccggtttcgggaccgggtaacggacgaaacgggtgaacgtacgtaacgaaacggtacgtcggtacgtcgttacgacccgtaactacgttccgtggttaccc

SEQ ID NO: 240223 - DNA, 535 bp, Homo sapiens
  misc_feature: GYAE6OF01AF4Z6.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaaaacagcctggccagggtccccgctcctcatctatgatgcttccagcagggccactggcactcccagccaggttcaggtggcggtgggttgcacagacttcactctcacatcagcagcctaccaacctgaagtatttgctagttctattactgtacaacagccgtacagtagttcggccgtcttccgtaccgtttcgggacgggtaacgggaccgaagggtcggaagtacgtacgaaacgacgtggtacggctcgaccaccgtatctgttcttcg

SEQ ID NO: 240224 - DNA, 842 bp, Homo sapiens
  misc_feature: GYAE6OF01AOXYQ.45.35.D02.1.454.CMB.1.raw
  modified_base (203)..(203): a, c, t, g, unknown or other
  misc_feature (203)..(203): n is a, c, g, or t
tcagacgcgatcgacacgaccggtgctcgatttagcacacgataggttgggtttgggggaggaactgctcagttaggacccagagggaaccatggaagccccagctcagcttctcttcctcctgctactctggctccagagacctccggagtaaattgtcttgacacagtctccagccattctgtctctctctccgagggganacacgcccacctctcatgcagggccagtcagatattagaacatacttggcctggtatacaatacgacgccgtcggccgaccggggtccccgctcctcacttctatgatcgtccttcgagcgacgggccctacgtcgggacctacctacccgacggtaccggttacgggttacggtacggggttcgggggttaccgggggtttacgggggtttaccggaccgttaacggtaaccggtttacccttttaccctaaacccgtttcctaaacccgtaacgtaaccggttacccgaacccggaccgttaaaccccggttaacccccgttaaccccggtaaaacggtttaaccggttaaaaccggtttttaccggttttaaccgaacccgttttaacggttttaaccgtttaaccgtttaacggtttaacccgtaacgtaaaccgggttaccggtaacgttaaccggtaagggttacccggtacccgggttcccgtaccggtttaccggttaacccggggttacgggggaaccggggttaacgggaaccggtagggggtaacgtaaacgtaacgttaaaccgggaaacgtcgggttacgggtacgtacgtaccgtaacctaccgttctttccgttcgtttacccc

SEQ ID NO: 240225 - DNA, 685 bp, Homo sapiens
  misc_feature: GYAE6OF01B7GST.45.35.D02.1.454.CMB.1.raw
  modified_base (152)..(152): a, c, t, g, unknown or other
  misc_feature (152)..(152): n is a, c, g, or t
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
  modified_base (671)..(671): a, c, t, g, unknown or other
  misc_feature (671)..(671): n is a, c, g, or t
  modified_base (678)..(678): a, c, t, g, unknown or other
  misc_feature (678)..(678): n is a, c, g, or t
tcagacgcgatcgacacgaccggtgctcgatttagcacacgatagttgggtttgggggaggaactgctcagttagtacccagagggaaccatggaagccccagctcagcttctcttcctcctgctactctggcctcccagagacctccgganaaattgtcttgacacagtctccagccattctgtctctctctccgagggganacacgccaccctctcatcgcgagggccagtcagtagtatagaacatacgttggctgtatcaatacaagccgtggccgacggggtccccgctcctnacttctatgatcgccttccgagccgacggccacgtcggacacgtcccagtccgtaaggttcgaggttcgggtacgggttggtttacggcgaacgtacggtacctttaccgaaccttctaccaactaacgtaccgaacgtccgtaacgtccccttaacccgaaccgttagtaaacgttagttttacacgttaagttaccttaattaccgtagtaaccgtaacgtacggttaactaacggtaacggttacgttccgggtaccctaccgttcccgttaaccgggtttccgggaacgggtaacgggtaacgtaaggggttaggaagtaacgtaaccgaaaacggtacggtggtacggtaccgttacgaccttaccgnttccgtnttacccg

SEQ ID NO: 240226 - DNA, 654 bp, Homo sapiens
  misc_feature: GYAE6OF01B1JOS.45.35.D02.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (320)..(320): a, c, t, g, unknown or other
  misc_feature (320)..(320): n is a, c, g, or t
  modified_base (477)..(477): a, c, t, g, unknown or other
  misc_feature (477)..(477): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggcctcccagagacctccggagaaattgtcttgacacagtctccagccattctgtctctctctccgagggganacagcccaccctntcatgcgagggccagtcaagtagtattaagaactatacgttggcctaggtatacaataacgaacgccgtcggccgacggggtcccccggctccgtactactcgtntcggtatcgtaccttccaggccgacggggccacgtcggctacctcccgagcccgtaggttccgaggtcgggtcgggtgggtttcggctacgacgtaccttacacgttctacgactacgtacacgtccacgtacccctacctaaaccgtgtaacgttntttacggccttagttaccttaattactcgtaacactacgacgtacgagtacggttcgaccttctccggtacggtttccgggaacgggcggtaacggtagggtacgtaacggaacgttaacggaaacggtacgttaggtaccggtacggtactacgtaacctccttcgttcggttacc

SEQ ID NO: 240227 - DNA, 548 bp, Homo sapiens
  misc_feature: GYAE6OF01BZTRI.45.35.D02.1.454.CMB.1.raw
  modified_base (153)..(153): a, c, t, g, unknown or other
  misc_feature (153)..(153): n is a, c, g, or t
  modified_base (361)..(361): a, c, t, g, unknown or other
  misc_feature (361)..(361): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctcccagacgacctccgganaaattgtcttgacacagtctccagccattctgtctctctctccaggggacacagccaccctctcatgcagggccagtcagagttatagacatacttggcctggtatcaatacaagcctggccagggtccccgctccctcatctatgatgcttccagcagggccactggcactcccagccaggttcacgtggcggttggttcgctacgngtacctcgacctcacaacactcacgcgacgtcctacccgaacgtacgaacgtacgtttgactagttctacttactgtaccacacgtcgtaacagtactcggacctcttcgtacgttcggacggtacggaccgtaggtaggacgacgtaacaaacgtacgtgtagcgtacgacaccatcgtgttaccc

SEQ ID NO: 240228 - DNA, 688 bp, Homo sapiens
  misc_feature: GYAE6OF01ALG1P.45.35.D02.1.454.CMB.1.raw
tcagacgcgatcgacacgaccggtgctcgatttagcacacgatagttggggtttgggggaggaactgctcagttaggacccagagggaaccatggaagccccagctcacgcttctcttcctcctgctactctggcctcccagagacctccggagtaaacttggtcttgacacagtctccagcctattctgtctctctctccggagggacacacgcccaccctctcagtgccgacggccagtcagagtatagaactagtacttggcgtggtatacaatacgaacgccgtcggccgacgggtccccgctccgtcactctatgtactcgtcttaccaggtccgaacgggccacgtcggacctacgtcccgaacgtccgtaacggttccgacggggttcgggtcggggttcgggtttacgggctaacggtacgttcttacccgacttccacgtaactacgtcacgacaccggtcccaccgtaacgtaggtaacttcttagctacgttattcgtatcgtaacaccgtacgacgtacgagtcggtggtaccctacgttaccggtaccggtttcggggaaccggtacggggtaacccgtaggggtaaccggtaaacgaccggttaaaccggaaacgtacgggttggtaggtttacccaaccggttcaaacccggttctttccgtacggtttaccc

SEQ ID NO: 240229 - DNA, 642 bp, Homo sapiens
  misc_feature: GYAE6OF01CC7DK.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccactggagaaatagtggtgacgcagtctccaggcaccctgtctctgtctccgagggganacagccaccctctcctgcgacgggccaggtaggagtgtacagtaagtacttaggctaggtacaacagaaacctggaccaggcctcccgaggtctcctcactccatcgatcgacactaccgaacgtacgggtcctcggccgtacccagtaccgtacggtttccggtaggccgtaggtttcgggtttgaccgaacgacgtacttacgaaccttcgtaccaaacgaactcaacgtcgaaccgtaccctaaccaacctaggtaacttacgtttacgacgtagttaccttaacgtttactacgtaactaacgagtacctaacgagtagtcggccgtctcgttacgttcgggacggtacggaccgtaggtcgaagtactacgaaacgtacgtggtaggactcggaacctacctaagttcctagtttacctctacttcccgtacccg

SEQ ID NO: 240230 - DNA, 709 bp, Homo sapiens
  misc_feature: GYAE6OF01DUMFH.45.35.D02.1.454.CMB.1.raw
  modified_base (201)..(201): a, c, t, g, unknown or other
  misc_feature (201)..(201): n is a, c, g, or t
  modified_base (333)..(333): a, c, t, g, unknown or other
  misc_feature (333)..(333): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcgaggccagtcagagtataagaacatacttggcctggtactacaataacacgccgtggccgacgggtcccccgctcctcatctatgatcgtcttccagtcgacgggacctacgnggccactcccagccgaggttcaggtcgggtacgggttgggtttcgaccgtaacgtacgtaccgttacaccgttcttaccaacgttaataccgacgtacccgaaccgtccccttaaacccgaaaccgttgtaaaacgttagtttttacgaccgttaacgtttccgtttaactttaccgttaccgttaacgtaaacgtacgtaccggttaaacgaggttacgttcgggacccctacgtttcccgttaaccgggtttccgggaacgggtaaacgggtacccggtaaagggtacgggtaacgtaaacgttaacggaaaaccggttaaggttcggtacggtacgttacggaaccctacctacggttccgttgttaaccccg

SEQ ID NO: 240231 - DNA, 652 bp, Homo sapiens
  misc_feature: GYAE6OF01A0KX1.45.35.D02.1.454.CMB.1.raw
  modified_base (200)..(200): a, c, t, g, unknown or other
  misc_feature (200)..(200): n is a, c, g, or t
  modified_base (305)..(305): a, c, t, g, unknown or other
  misc_feature (305)..(305): n is a, c, g, or t
  modified_base (613)..(613): a, c, t, g, unknown or other
  misc_feature (613)..(613): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctcagggganacagccaccctctcatcgcacgggccagtcagagtatagacatacttggctggtatcaatacaagcctggaccgtcgggtccccgctccgtacatctagtgatcncgttccagcgacgggccacgtcgcactcccacgcctaacggtcagggtcgggtcgggttcggggtttcgctacgacgtaccttacgacctctacaacctaactcgacgaccaccgtaccccttacccgtaaccgttacgtaaacgttcttttacgaccgtaacgtttcttaacgtttacgtacgtacaaacgtacggtcgttaaacgtaaggttacgttacgggtccgttaccttccgttaacggtttccgggacgggtacggggtaacccgtagggtacggaacgtacgtaccggaaacggttacgnggtaccgtcgtacgacctaacgtctaccgttgttaaccc

SEQ ID NO: 240232 - DNA, 706 bp, Homo sapiens
  misc_feature: GYAE6OF01AZBU8.45.35.D02.1.454.CMB.1.raw
  modified_base (202)..(202): a, c, t, g, unknown or other
  misc_feature (202)..(202): n is a, c, g, or t
  modified_base (395)..(395): a, c, t, g, unknown or other
  misc_feature (395)..(395): n is a, c, g, or t
  modified_base (660)..(660): a, c, t, g, unknown or other
  misc_feature (660)..(660): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgcccaccctctcctgcacgggccaggtaggagtgtcaagtaacgtacgttaggctaggtaaccaacgaagaaaccctggcccaagggcctaccccgaggcctcccgtacactcccgattgacttcggaccactacccgaaaccgtacggggtcccctcggccgtccccaagacgtacgggtttcccggnggcgtaggtggggtacctggggaacctaggtaccttacgaccttccgtaccaacctacgtccaacgctaccgcccgttacgggacccgtaggtacggttacttttacggacccttaacttttaccgtacgttgtaccgacgtcgtaggtccggtcggaccgaccggacgccgtccgtcctacgggtttcgggaccgggtaacgggtaaccggtaagggtcggtaagtacgtaacgtaaccggtacgtaggtcggcgtacggaccncgtacgttaccgtgttcctacgttacgttcccttcccgccttacgg

SEQ ID NO: 240233 - DNA, 768 bp, Homo sapiens
  misc_feature: GYAE6OF01AJJ5D.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctctcatcgcagggccagtcagagtatagaacatacgttggcctggtatcaatacaagcctggccacgggtccccgctcctcactctatgatcgcttccgagccgagggccacgtcggacctacgtacccgagtccgtacggttacagggttcggggtcgggtttgggtttacggcctaacgtacgtacctttccgaaccttctaccgtaacaacgtcaacgtaccgacgtcccctacccgaaaccgtacggtaaacgttacgttttacgaccgttaacgtttaccttaaacgtttaccgttacgtaacctaaaccgtacgggttaaccgtaaaccgtaggttacgttaccgggtacccggttaccgtttaacccggttaacccgggtttaccgggggaaccggggtaaaccggggtaacccggttaaaacggggttcgggtaaacggtaaacgttaaccccgggtaaaaacgggttaccggtttagggtaccggggttacccgttaaccggaccccgttaaacccgttacggttttccgttaaccgggtttaccc

SEQ ID NO: 240234 - DNA, 529 bp, Homo sapiens
  misc_feature: GYAE6OF01E2GY6.45.35.D02.1.454.CMB.1.raw
  modified_base (201)..(201): a, c, t, g, unknown or other
  misc_feature (201)..(201): n is a, c, g, or t
  modified_base (357)..(357): a, c, t, g, unknown or other
  misc_feature (357)..(357): n is a, c, g, or t
  modified_base (399)..(399): a, c, t, g, unknown or other
  misc_feature (399)..(399): n is a, c, g, or t
  modified_base (476)..(476): a, c, t, g, unknown or other
  misc_feature (476)..(476): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggcctggtatcaatacaagcctggccagggtccccgctcctcatctatgatgcttccagcagggccacgtggcactccagccaggttcaggtggtcggtgggtttgcancgtacttcactcgtacacatcagcacgcctccaactagaatntttgactagtactattactgtacaactgactacgagagttcggctcttctacgttcggacggtaggaccgtaagggnggacgtacgtaacgaaacggtactgtacggctacgcaacctattcgtgttacc

SEQ ID NO: 240235 - DNA, 612 bp, Homo sapiens
  misc_feature: GYAE6OF01A3BAK.45.35.D02.1.454.CMB.1.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (285)..(285): a, c, t, g, unknown or other
  misc_feature (285)..(285): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctcagggganacagccacctntcatgcgagggccagtcagagtattagaacatacttggcctggtatcaatacaagcctggccacgggtccccgntcctcatctatgatcgcttcagcagggccagtcggctactcccagcctaggttcaggtgggtcggttgggttcgcacgagtacttcactctcgaactaatcagcacgccctaccaacctagtaacgttattttagtacttcgttaattactcgtactaacgtacgtaccgtaacacgtagttcggtacgtccgttacgtaccgtttaccgggacgggtaacgggaaccgtaaggggttacggaaggtaacgtaacggaaaccggttaacgttcggtacggtacgtaccgtaccgtaacccgtagttcccgttgttcccgtttacccg

SEQ ID NO: 240236 - DNA, 661 bp, Homo sapiens
  misc_feature: GYAE6OF01BONEF.45.35.D02.1.454.CMB.1.raw
  modified_base (200)..(200): a, c, t, g, unknown or other
  misc_feature (200)..(200): n is a, c, g, or t
  modified_base (301)..(301): a, c, t, g, unknown or other
  misc_feature (301)..(301): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcacgggccaggtcagagttattagaactatacttggcctggtatcaatacaagctggccaggggtccccgctcctcatctatgntgcttcgagcgacgggccacgtgctactcccgagcctaggttccaggtcggggtacggggttgggtttcgggacacgtaggtaacctttcgacctaccttacaaccctaaatccgaacggtcccaacgtcccccttacccgtaaaccttagggtaaacgttctttttacgccgtaagttcccttaatttacccgtagtacccaaacgtacggtaccgttaactaacggtacgtttaccgggtccctcgttaccgtaaccggtttaccggggacgggtacggggtaccgtaaagggtcgggaaacgtcgtaaacgaaacggtacgtaggtcggacctgacctaacgtcttcgtggttaccc

SEQ ID NO: 240237 - DNA, 681 bp, Homo sapiens
  misc_feature: GYAE6OF01B31GV.45.35.D02.1.454.CMB.1.raw
  modified_base (203)..(203): a, c, t, g, unknown or other
  misc_feature (203)..(203): n is a, c, g, or t
tcagacgcgatcgacacgaccggtgctcgattttagcacacgatagttgggtttggggaggaactgcgtcagttaggacccagagggaaccatggaagcccagctcagcttctcttcctcctgctactctggactcccagagacctccggagaattcgtcttgacacagtctccagccattctgtctctctctccgagggganacacgccaccctctacatgccgacgggcctagtcagagtattagaactataccttggcctggtactacaatacaagcctggaccacgggtccccggctcctcactctatgatcgtccgttacacgcgacgggcccacgtcggcctactccccagcccgtaggttccagggtcgggtcgggtttgggtttacggcctacgacggtacctttccgaccttctaccaactaatcaacgccgtacgtaccctaccgtaaccgtacgtaacgttacgttttcgaccgtagttacttaactttaccgtacgttcctaacgtacgtaccgtaagtacggtacggttacgggtcccgtccttaccgttaccggttacgggacgggtaacgggtacccggtaaggggacggtacggtaacgtaaccgaaacgtaccggttcggtaggtacccgtcggtaccctaaccctgttccgttacgttacccg

SEQ ID NO: 240238 - DNA, 603 bp, Homo sapiens
  misc_feature: GYAE6OF01C9MSJ.45.35.D02.1.454.CMB.1.raw
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtattagaacatacttggcctggtatacaatacaagcctggccagggtccccgntcctcatctatgatgcttcgagcagggccacgtggcactcccagcctaggttcaggtcggcggtagggtttggacacgagcgtttcactcgtacaacaatcaacgcaacgccctaccctaaaccctgaacgttaacttttcgactacgttacttaatttaccttagttaccaactacgacgttaacagtaacgtttcgggccctacgttcgtacgttttccggggacgggtaacgggaacccgaaagggtgggaagacgtaacgaaacggtaacgttacggtaggaccgttacaccgtacctagttccgtgttacccg

SEQ ID NO: 240239 - DNA, 671 bp, Homo sapiens
  misc_feature: GYAE6OF01ALD8B.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctctcatgcacgggccagtcagagttaattagaactattacttggcctggtaatacaatacaacgcctcggccgacggggtcccccgctcctcatctagtgatcgtccttccaggccgacgggcccacgtggaccacgtcccagccgtaggtttcgagggtgggtcgggttagggtttcggacctacgtacggtaccttcaaccgttccacaactaactccgacgaccaccggtaccctaccctaaaccgttaggtaacgttacgttttacgacgttaacgttactttaacttacttacgtacctaacgtacgtaacgtaacgacgttacgtacgggtcctcttacgttaccggtttaccgggacgggtaacggaaccggtaggtagggaacgtaacgtaacgaaacggtacggtggtacggtactaccggacctaaccgtgttccgttcggtttaccc

SEQ ID NO: 240240 - DNA, 831 bp, Homo sapiens
  misc_feature: GYAE6OF01A7LBP.45.35.D02.1.454.CMB.1.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagagacctcggagaattgtcttgacacagtctccagccattctgtctctctctccgagggganacacgccaccctntacagtcgacgtagggccagttcaaggacgttattaacgaactattaccgttggccttagggtacctacgtaaataccgaaacggtcccgttacggacccgtaacgggggttcccccgacttaccctacgaacgttccgtaaacgttcggtaacgtttccggacctttaccgaacgggtacccgtaacggggtaccccttaaacggttaccgggtaccctaacccggtttaccccgaaacggttcccgtaacgggtttaccgaaacggggttcggggttaccgggttaggggttttaccggaccttaacggtaaccggtttaccctttacgaacccgtttaccgttaccgaacgttaaaccgttccgtaacggtaccgtaaccggtacccttaacccgtaaacccgttacgggttaaaccgttaccggtttttaaccggaaccgtttaaccgggtttacctttaaacgtttacccggtacgtaaccgtaacgtacggtaccgtaagtacgtacgtaccgtaccgtcttacgtacgttacggacgtacggtaacctaggtacgtagtacgtaacgaacgttacggcgtacggacgtacgacttaaccgcttcgtcgttacg

SEQ ID NO: 240241 - DNA, 723 bp, Homo sapiens
  misc_feature: GYAE6OF01DHKRU.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttggggaggaactgctcagttaggacccagagggaaccatggaagccccagctcagcttctcttcctcctgctattctggctccagagacctccggagaaattgtcttgacacagtctccagcctattctgtctctctctccgagggganacacgccaccctctcatgcagggccagtcagtagtatagaacatacttggcctggtatacaatacaacgccgtcggaccgtacgggtccccgactcccgtactacttccgtaatcgtacgtcgtaccttccgacggccgacgggtcctaacgtcggacctaacgtcccaaggtcccgtaaggttcgaagggtcgggtacgggtttggggtttacggactaacgtacggtaccttaccgtacctaccgtaccgtaactaacgtacacggtacctaccgtacccctaacccgtaaacgttacggtaaacgttacgttttacgaacgttacgtttacttaacgtttacgtacgtaaccgaacgtacggtaacgttaacgtaacgttacggttcccgggtaccgtaccttacggttacggttccggggaacgggttaacgggaaccggtagggtacgacgtaacgtaaccgaaacggttcggtaggacgttacgtaccgtaactacccgttcgttgtccgttaccg

SEQ ID NO: 240242 - DNA, 876 bp, Homo sapiens
  misc_feature: GYAE6OF01EN75K.45.35.D02.1.454.CMB.1.raw
  modified_base (429)..(429): a, c, t, g, unknown or other
  misc_feature (429)..(429): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctcccagagacctccggagtaaattgtcttgacacagtcctccaggccaccctgtctctgtctccgaggggacacacgcccacctctcctgcgagggccaggtagggtacgttgtactaaggttaacgtacgttagggcttacgggtaacccaaacgtaacgaaacccgttggacccaacgggtcctacccgaaggtccttacctaccgacgttcccaattcggtactcgcctaacgtacccgaaacgtccgggtccctacgggaccctacccgaaggtaccgtacgggttcccgnggaccgtgggttcgggtacgtgggacgtaggtacgttcaccttctaccgaccgtcgagacctacggccgtacggtacgtaccgtaggtagttacggttacgttttacggtacgtttaacgttttaccgttaccggttacgttacggtaacgttacgttaacggtttaacttaaccgttaacgttaacggtttcggttaaccgtttaacgggtttaaccggttttacgggttttaccgggaacccggggttaaacgggtaaaccccggttaagggtaacccggttaaagggtaaaacccgttaaacccgggtaaaaacggttaacccggttacgggttaaccgggtaaccccgttaaccggaaacccgttaacccgttaaccgtttacccggtttaaccggttaacccttttaaccccttaacccggtttcccccgttaacccccggg

SEQ ID NO: 240243 - DNA, 801 bp, Homo sapiens
  misc_feature: GYAE6OF01CYQYC.45.35.D02.1.454.CMB.1.raw
tcagacgcgatcgacacgaccggtgctcgatttagcacacgatagttgggtttggggaggaactgctcagttaggacccgagagggaaccatggtaagccccagctcagcttctcttcctcctgctactctggctccgagaggacctccggagaaattgtcttggacacagtctccagcctattctgtctctctctccgaggggatacagcccaccctctcagtcgccgacgggccagtcgaaggtagttaagttaacgaacgtagttacggttcgggaccttaggttactaacaaacgtacaacggtccgttacgggaccggtaccggggtcccccgtaccttccctacgtacttacgttaagtgtaccgttcggtcccttaccgacggtaccggacgggtaccctacggtcggtaaccaacccgtacccgtaacggttacccgttacgggttttaccggtaacggggtttcgggggttcggggttttacggggtttaccggaaccgtaaccggtacggttacccgtttaccgacccgtttacctaaaccgtaacgtaacctcgaaccgggtcctaaccgttaccccgtaaaccctaaccggttaggtaacgtttaacgttcgggaccttacgtttaaccttacgttaacgtacgttaacaacgttaacgtacgttaacggtacgttacggtttccggcccgttacgttacggttacccggttgggacgggtaacgggtacgtacggtgtaacgacgtaccgaaacgcgtcggacgtcgtaccacacctcgtcttcgtcc

SEQ ID NO: 240244 - DNA, 772 bp, Homo sapiens
  misc_feature: GYAE6OF01CCNT5.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctccagacgacctccggaagaaattgtcttgacacagtctccagcctattctgtctctctctccgaggggacacacgccctacctctcatcgcgacgggccagtcgagtacgtaatacgaactattacgttggccttaggtaactacaaacttacaaacgtcccggttacggacccgtaccggggtcccccggtcttaccgtacgtaacttctaagttcggaacgttcctaccggtttaccgacgggtaccgacggggtacccctaacggtccgggtacctaaccgttaccccgaacgggtcccgttacgggtttaccggtaaggggttcgggggtaccggggttttcggggtttaccggacgtaaccggtaccggttaccttccgtaaccctttcgaaactaaccgtaacgtccgaacgtccgtaacccgtaccccgttaccgtaaacccgttagtaaacgttacgttttaggaccttacgttacttaacgttctacgacctaagtacgtacgtaacgacgttacgtccggtccctagttaccgtacggttccggggacgtaacgggtaccgtaaggacggtaagtcctaacggtaaacgtgtaccggcgtactacgaccttagcgtacgttgttaccc

SEQ ID NO: 240245 - DNA, 710 bp, Homo sapiens
  misc_feature: GYAE6OF01BAHDB.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggnacacgcccaccctctcatcgcgacgggccagtcagtagtattaagaactattacgtggccttggtatacgaaatacgaacgccgtggaccgtaccggggtcccccgctcctcgacttcctatcgtatcgtccgttccgagcgacggcctacgtcggcctaccgtcccgagttacgtacggttcgagggttcgggtcggggtttgggttcggacgacgtacggtaccttccgtactacctacaacctaatccgaacgtccaaccgtcccctaaccgaaaccgttagtaacgtttacgtttacgacttacggtttactaacgtttacctagtaaccgaacgtacgtacgtaacgaggttacgtaccggtcctacgttaccggtaccggttacggaacgggtacgggaaccgtagggtacggtaaacgtacgttaaacccggaaacggttccggtagggtacccggtaccgtacgggaaccctaaaccggtttcttccgttccggtttaaccc

SEQ ID NO: 240246 - DNA, 666 bp, Homo sapiens
  misc_feature: GYAE6OF01DZZWI.45.35.D02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (644)..(644): a, c, t, g, unknown or other
  misc_feature (644)..(644): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctctcagtcgcgacgggcagtcagagtattagactatacttggctaggtanacaatacagcctcggccacgggtcccgctcctcactcatgacttcgtaccttccgagccggtacgggcccacgtcggaccacgtcccgacggccgtacggttcgagggtcgggtccggggttggggtttacgactaacgtacggttaccttcgaacgtcccttacaactaacgtcgacgacctaccgtaccctaccctaaacccgttaggtaaacgtttacgttttacgaacgttacggttaccttaactttaccgtacgtaactaacgtacgtaaccctaaggtacgttacgtcggtcctacttacccgtacgttaccggggacggtacggaaccggtagggtagaaacgtcgtaacgaaaggtccgtagggtgttaccgnacccgatacgtcgtcggttacc

SEQ ID NO: 240247 - DNA, 932 bp, Homo sapiens
  misc_feature: GYAE6OF01BHW5Y.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggcctcccagagacctccggaagaaattgtcttgacacagtctccagcctattctgtctctctctccgaggggacgacacgcccaccctctcatgcgagggccagtcagagtatagaactatacgttggccttaggtactacaaatacgaagtccgtcggaccgtacggggtcccccgactccctacgtaacttctagtcgacttcgtaccttaccgaggtaccgacgggtccctaacgtcgggtacctaaccgttccccgacggtacccgtaacgggtttaccgaacggggttcggggtacggggtttacgggggtttccggaacgttaaccggtaacgggttaacccttttacccgaaccggtttacccttaaccgtaaacccgttaaaccgttaccgtaaccggggaccctaaacccggttacccccccgttaaacccgtaaaaccccggttaacgggttaaaacggtttaaccggtttttaaccggaacccgtttaaaccggttttaaccttaaaccgttttaccgtaaccgtttaaacgtaaaaccggttacgttaaccggttaaccgttaaacgggttaccggtttaccggggtaccccgtttacccgttaacccgggttaacccgggtttacccgggggaaccggggtaaccggggttaaaccgggtaaacggggtaccgggaaacgttaaacccgggttaaacccggtaaaacgggttaaaccggttcgggttaaccgggtaccggttaaccgacccgttaacccgtttacgttcccggttttcgttaaccccg

SEQ ID NO: 240248 - DNA, 729 bp, Homo sapiens
  misc_feature: GYAE6OF01CEZLR.45.35.D02.1.454.CMB.1.raw
  modified_base (206)..(206): a, c, t, g, unknown or other
  misc_feature (206)..(206): n is a, c, g, or t
  modified_base (297)..(297): a, c, t, g, unknown or other
  misc_feature (297)..(297): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctcccagagacctccggagaaattgtcttgacacagtctccagccattctgtctctctctccgaggggagacngcccaccctctcatgcgaggccagtcagagtattagaacatactggcctggtatacaatacaagcctggccgacgggtccccggctccgtnactcctatgatcgaccttccgagtccgacgggccctacgtggcctacgtccccacggtccgtaggtttccgagggttcgggccggggtttggggtttcggacgaaccgtacggtacctttcgtaccgtcgttaccaactacgtacgtacgcctaacgtcccctaacccgtaaaccgttacggtaacttacgttttacgaccgttagtttaaccttacgtttacgttaccgtacctaaagttacgttaacgttaccggttaaccttacccgttacccgttttacccgttccggttttaccccgggtcccgtaccgggtaaaccgtaacgggttaccgaaaccttaacgtaacccgtaaaaccggttaaggtacgggttacgacggttaaccgaccgtaccgtacttacgtttccgttccgttacgttaccccg

SEQ ID NO: 240249 - DNA, 548 bp, Homo sapiens
  misc_feature: GYAE6OF01CJ9S0.45.35.D02.1.454.CMB.1.raw
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
  modified_base (326)..(326): a, c, t, g, unknown or other
  misc_feature (326)..(326): n is a, c, g, or t
  modified_base (384)..(384): a, c, t, g, unknown or other
  misc_feature (384)..(384): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaattgtcttgacacagtctccagccattctgtctctctctccgagggganacacgccaccctctcatgcgagggccagtcagagtatagacatacttggcctggtatcaatacaagcctggccagggtccccgntcctcatcgtatgatcgcttccagcacgggccagtcggacncgtcccagcctaggttcaggtggcggttgggttgcagagtccttcactctcactatcngcacgcctaccaacctagaacgtatttagactacgttcttacttacgtcgtacaacacgtacgtacgacgtagttcggtccgtcttcgacgtttcggacgggtacggacgagggtgagacgtacgaaacgtacgtggtcgcgtacgacaccgtctcgtcgttcg

SEQ ID NO: 240250 - DNA, 727 bp, Homo sapiens
  misc_feature: GYAE6OF01B0J3F.45.35.D02.1.454.CMB.1.raw
  modified_base (252)..(252): a, c, t, g, unknown or other
  misc_feature (252)..(252): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagcctattctgtctcctctcctccgagggggacacacgcccaccctctacagtgcagggccagtcagagtattacgaanattacgtggcctggtataccaaatacaacgccgtcggacctacggggtcccccgcttccctacacttctagtcgactcgccttacgagcgaccgggacctacggtggacctaccgtacccgagtccggtaggttacgacgggttcggggtcgggttggggtttacgaccgtaacgtaagttacccttacctacgtccgtaactaactaacgtaccgtaaccgccgtaaccgtacccctaacccgtaaaccgttacggtaaacgtttacgttttacgtacgttaacgtttaacgttaactttaccgtaacgtaaccgtaacgtaacggtacgtaacgtacgttaacggttccgtaccgttacccgttacggtaaccggtttacgggaccgggtaacgggtaacggtaaggtacggtaacgtaactaaccggaaacgttacgcggtacgcgtacggacaactcgtcgttcgttaccg

SEQ ID NO: 240251 - DNA, 590 bp, Homo sapiens
  misc_feature: GYAE6OF01A84SZ.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtattagaacatacttggcctggtatcaatacaagcctggccagggtccccggctcctcatctatgatgcttccagcagggccacgtggcatcccagccaggttcagtggcggtgggtttgcagacgacttcactctacacaatcacgcacgccctaccaaccgtagtaagtacttttagctacgttacttagttactacggtactaacgacgtacgtaacagtacgttccggaccgtccttacgtaccgtttcgggaccggtacggggtaaccgtaaggggtagggaacgtaacgtaacgaaacggtaacgttacgggtaggtccgtacggaccgtaaccgtacttcgttcgttaccg

SEQ ID NO: 240252 - DNA, 659 bp, Homo sapiens
  misc_feature: GYAE6OF01AMPU9.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggagacagccaccctctcatgcagggccagtcagagtattagaacatactggcctggtatcaatacaagcctggccagggtccccgctcctcatctatgatgcttccagcagggccatggcactcccgagccaggttccaggttgggccgggttagggtttggcctacgaggtacctttcgaacttccgtacaactaacttcacgacctacggtacccctacccgtaaacccctggtaaacggttactttttacggaccttaacggttaccttaactttacgttacgtacctaacgtacggtaccgttaacgaagtaacgtttcgggtacccgtccttacgtaccgtttacgggaccgggtaacgggtacccggaaagggttcgggaacgtacgtaaccgaaaacggtacgttacgggtacgtacgtacggaccgtacccgattacccgttcggttaaccc

SEQ ID NO: 240253 - DNA, 715 bp, Homo sapiens
  misc_feature: GYAE6OF01CACN0.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagaccctccggagaaattgtcttgacacagtctccagccattctgtctctctctccgaggggagacagccaccctctcatgcgaggccagtcagagtatagaacattacgtcggctggtatcaatacaagccgtggccgacgggtcccccgctcccgtcatctatgatcgtccttaccgagcgacgggccacgtcggcacctcccacgccgtaggtccgaggtcgggtacgggttgggtttcggacgactagtaccttcaccgttacctacgactaacgtcgaacggtacccaccgtaccctaacccgtaacgtacggtaacgtttaacgttttccgacgttaaggtttaccctttaagtttacgtccgttaaaccgaacgttaacggtacccgtaaacgtaggttaccggttaccgggtacccggttacttacccggttaccggttacccgggacggggtaaccgggtaaccggtaaggggtacgggtaaaccgtacgtaaacccggtaaacggtacgttacgggtacggtaccgtaccggtacccgtaacttaccggttcgttacgtttacccg

SEQ ID NO: 240254 - DNA, 823 bp, Homo sapiens
  misc_feature: GYAE6OF01EAZ2R.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggaaaattgtgttgacacagtctccaggcaccctgtctctgtcctccgagggganacagcccaccctctcctgcgaggccaggtaggagtgtcagtaagtctaggctaggtaccaacagaaacctggaccacggcctcccgaggtcctcctacactccgatgaactgccaacttacccaacgacgggtcccctggcccgtacccgagtaaccgtcggttcccgtgggactgggtcggtccggagggacacggtgttaccacgttcctaccgaccgtacgacgaccgacggtcccgtagggaccgtccgtacgtacgttacggttacgttttttacggccgttttaaacggttttacccgtttcgttacggttaccgtaacgggttccgtaccgggtttcccccggtttacccggcccccggtaacccggttcccggtaccccgttttacccggttacccgggggtttttacccgggggggacccggggggggtaaaccgggttaaggggggttccgggtaacggtaccggttcggggtaaaacgtcccgggttaaagggtccggggttacgggtaccgttaccgggtacccgtaacccggttaagttcccccggtttaacgtttccttttaaccccgaccgttttacccccccgttcccgttccccgtttaaccgg

SEQ ID NO: 240255 - DNA, 655 bp, Homo sapiens
  misc_feature: GYAE6OF01DL7LA.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggcctcccagagacctccggagaaattgtcttgacacagtcctcagcctattctgtctctctctccgaggggacacacgccacctctcatgcagggccagtcagagtatagaacatacgtggctggtatacaatacaagtccgtcgggaccgtaccgggtccccgtctcctcgacttctatgactcgccttccgagcgacggccacgtcggcacctccgacgccgtaggttcgagggttcgggtcgggttgggtcgacgacgtacgtactcactccacaacgtactcacgcacgtcctaccgaagtagtaacgttacgttacgacgttacttactaattacctacgtaacctaacgtacgtacgtacgaggttaccgtcgggtaaccctcgttaccggtacggttaccggggacggggtaaccggtaaaccggagggtacggtaaacgtaacggtaaacgtaaacgggtacggtgggtaccgtaccggttcgaacccgtaaccgtccgtttagtccgtttacccg

SEQ ID NO: 240256 - DNA, 627 bp, Homo sapiens
  misc_feature: GYAE6OF01EOBJ1.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagagacctccggagtaaattgtcttgacacagtctccagccattctgtctctctctccgagggganacacgccaccctctcatcgcagggccagtcagagtatagaacatactggctgtatacaatacaagcgtggaccgtacgggtccccgctcctcatctatgatcgccttccgagcgacgggccagtgaccactcccagccgtaggttcacgggttgggtcggtggggtttcgcgacgtacgtactcactctacaacatcgacgccacgtcccctaacaacgtagtaaagttactttaggacttaagttaccttaagtttactgtaaccaacgtacgtacgttaaacgaagttacgtacggaccctacgttaccgtacggttaccgggacgggtaaacgggtaccggtaagggtaacgaacggtaaactaacgaaaacggttacgtagggtacggacctacggaacaccgttacttcgttcggttaccc

SEQ ID NO: 240257 - DNA, 716 bp, Homo sapiens
  misc_feature: GYAE6OF01B2WG6.45.35.D02.1.454.CMB.1.raw
  modified_base (181)..(181): a, c, t, g, unknown or other
  misc_feature (181)..(181): n is a, c, g, or t
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattcngtctctctctccgagggganacagcccacctctcatgcgagggccagtcagagtattagaacattactggcctggtatcaatacaagctggccacgggtccccgctcctnactctatcgatgccttccagacacggggccacgtgggcactcccgagccgtaacggtttccgaaggttcgggcggggttcgggtttcggactacggtaagtacctttcgaacttactctaaccaattaccaaggcaaccggtaccctaacccgtaaacccgtaacgtaaacggttacgtttttacgacgtaacggttctttaaactttaccgtcggttaaacctaaaccgttaacgggtaccgtttaaccaaacgggttagtacccggggtacccgttaccgtacccgtttacccgggtttacggggaccgggtaaacgggggtaaccggtaaacggggttacgggaaacggtaacgtaaccgaaaaaccggttacgtacgggtaacggtccgtagaacctacccggaattccggttgtttaccc

SEQ ID NO: 240258 - DNA, 709 bp, Homo sapiens
  misc_feature: GYAE6OF01DK0XN.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagcctattctgtctctctctccgagggganacagcccacctctcatgccgagggccagtcagagttatagaacatacgttgctaggtatacaatacaagcctggccgacgggtccccgctcctcacttctatgacgtcgtccttccgagccgacgggccaacgtcggcctacgtcccgagtccgtacggtttcgagggttcgggtcggggttgggtttacgccgacgtaacgtacctttcaccttctaccctaacgtactacgaacgtccaaccgtacccctaaccctaaaccgttaggtaaacgtttacttttaccggacgttaacggtttaccttaacgtttacgttacgtaactaaacgtaacgtacggttaacgtacggttaacggttccgggacccgttccgttaccgttaccgggtttacccgggacggggttaaccgggaaccggtaaggggttacggaaggtaaacttaaccgaaaacggttacggttacggtacggactccggacctacgttcgttcgttacggttcc

SEQ ID NO: 240259 - DNA, 764 bp, Homo sapiens
  misc_feature: GYAE6OF01CY9EZ.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagagacctccggagaaattgtcttgacacagtctccagccattctgtctctctctccgagggganacacgccaccctctcatgcaggccagtcagagtatagaactatacgttggctggtatacaatacaacgcctaggccgacgggtcccccggcttcctcattacctacgtagacttcgtccttaccgacggccgtacggggccctaacgtcggacccgtaccgtacccgacggtcccgtacgggtttaccgaggggtttcgggggaccgggggttttcggggttttacgggaccgtaaaccggtacggttacccgttttaccgacccgtttctacccaaccttaacgtacccgtaacgggtccctaaccgtccccccgttaaccgaaacccgttacgtaaacggttacgtttttacgaccgttacggtttactttaacgttacgttaacgttaaccgtaaccgtacggttaacgtaacgaagttaccgtttccgggacccgttcctacgttaccgggttaccgggacgggtaacgggaccggtaagggtcggtaacggacgttaacgaaaccggttacgcggttaggaccgttcggtaaccaccgtacgttccgttcgtttacccg

SEQ ID NO: 240260 - DNA, 552 bp, Homo sapiens
  misc_feature: GYAE6OF01E4YIX.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccagggtccccggctcctcatctatgatgcttccagcagggccactggcatcccagccaggttcaggtgggcggtgggtttggcacgagacttcactcacacaatcagcacgcctcccaacctgtaagtattttcgactagtacttattacttcgtacaacagacgtaacgagtagttcgggtccgtcctctacgtttccgggacgggacggggaccgtaaagggtaggacggtagtaccaaacggtaacgtaggtcggcgtcgacaccgacttctgttacc

SEQ ID NO: 240261 - DNA, 630 bp, Homo sapiens
  misc_feature: GYAE6OF01E4FQ7.45.35.D02.1.454.CMB.1.raw
  modified_base (444)..(444): a, c, t, g, unknown or other
  misc_feature (444)..(444): n is a, c, g, or t
  modified_base (482)..(482): a, c, t, g, unknown or other
  misc_feature (482)..(482): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacacgccaccctctcatgcacgggccagtcagagtattagaacccccatacttggcctggtatcaatacaagcctggccgacgggtccccggctcctcatctatgatgccttccgagcgacgggccactcggcactcccgacgccgtaggttcacggtgggtcgggttggggtttcggcgtacgagtacttcactctactacaactcgacgccgtacgcccctcccaaaccctagtaacgttnttttacggactagttacttaattacctagtacctaacncgtacgtaacgtagtacgttcggcccgtcttaccgttacggttccgggacgggtaacgggaccggtaaaggggtaggaacggtaacgtaacgaaaaccggtacgttagggtacggtaccgtacggacctaaccgacttccgtcgttcc

SEQ ID NO: 240262 - DNA, 665 bp, Homo sapiens
  misc_feature: GYAE6OF01BH3PE.45.35.D02.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggganacagccaccctctcatgcgaggccagtcagagtattagaacatacgtggctgtatacaanacaagccgtggaccgacgggtccccgcgtcctcattctagtgatcgcttaccgagtcgacggcctagtcggaccacgtcccgagtccgtaggtcagggttcggtccgggttggggtttcgacgtacgtacgtaccttctactctacgaactacgtcgaaggtaccacgccccgttaacaaccgtagtaaacgttcgttttcgactacgttaccgttactttacctagtaacctaacggtaccgtaacgtagtaacgttcggtacgtccccgtactttaccggtaaccggtttacggggaccgggaaacggtaccgtaaaggggtacggtaacgaacgtaaacccggtaaaggaaccgttggaacggtacctacgtacccggtacctacgttcgttccggttacc

SEQ ID NO: 240263 - DNA, 743 bp, Homo sapiens
  misc_feature: GYAE6OF01BNUKN.45.35.D02.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (713)..(713): a, c, t, g, unknown or other
  misc_feature (713)..(713): n is a, c, g, or t
  modified_base (719)..(719): a, c, t, g, unknown or other
  misc_feature (719)..(719): n is a, c, g, or t
  modified_base (733)..(733): a, c, t, g, unknown or other
  misc_feature (733)..(733): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctcgaggganacacgccaccctcncatgcgacgggccagtcaagtagtaacttaagaactacgttacgttcggccttggtaactactaaactaaccgaaacgtccctacgggacccgacggggttcccccccggacttccccgtacgtacttccttaagtcggtaacttcggtacctttaccgaacggtaccggaacggggtccctaaccggtgggcctaaccgttccccgacggtacccgtaacggtttccggtaaggggttcgggggttccggggtttaggggttttaccgggaaccgttaacggtaaccgggttaaacctttcctaaccgttcctaaccgtaaactaaacgtcgaacgaccaaccgtacccctaaccgtaaacctagtaacgttagttttcgacttacgttacttacgttactacgtaactaacgacgtacgtaacgagttacgtcgtaccgtcgttacgttacggttcgggacggtaacggtacgagggtagacgtacgtacgtaacgngtacgngtacctcgacactntccgtagtcc

SEQ ID NO: 240264 - DNA, 678 bp, Homo sapiens
  misc_feature: GYAE6OF01EIHB3.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggagacagcccaccctctcatgcagggccagtcagagtatagaacatactggcctggtatcaatacaagcctaggccgagggtcccccgctcctcatctatgatcgtcttccgagcgacgggccacgtcggacacgtcccacgccgtaggtacgagggtcgggtacggggttcgggtttcggacgaacgtacgtaccttactaaccttccgtaccaacgtaacgtaccgaacgacctacggtacccctaacccaaaccgttgaaacgtttacgttttacgaccgttaacgtttacttaactttaacgtacgttaaccaacgtacggtacgtaaccgtaaggttaccgtccgggtacctacgttaccgtacggtttaccgggacgggtaacgggaaccgtaaggggtaggaacgtaactaaccggaaaacgtacggttaggtaccggacgttacgacctaacctacttccgttcgttaccc

SEQ ID NO: 240265 - DNA, 789 bp, Homo sapiens
  misc_feature: GYAE6OF01B4IF8.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaattgtcttgacacagtctccagccattctgtctctctctccgagggganacacgcccaccctctcatcgcgagggcctaagtcgaagtaagttattaacgaactattacgttcggccttaggtatacaataacgaacgtccgtacggaccgtacggggtcccccgcttcccctcgtactacctagtacgtatccgtccttaccgaggtccggacgggtccctacgtcggaccacgttaccccgaggtacccgttaagggtttccgaaggggttcgggggtacggggtttcgggggtttacggaaccgtaacgtaacggttacctttaccgaacctttccgtaacctaaccgttaactaccgacggtaccctaaccggtcccctaacccgtaaaccggttacgtaacggtttacgtttacggaccgttaacggttactttaacgtttaaccgttacggtaacctaacgtacggttaccgtaacgtaacggttaacgtccgggtaccgttacgttaccgttaacgggtttaccgggacggggtaaccgggtaacggtacgggtacggaacggtaacgtaaccggaaacggttgtacggggtacgtacgttacgacctaacgtacttccgttcgttaccc

SEQ ID NO: 240266 - DNA, 815 bp, Homo sapiens
  misc_feature: GYAE6OF01CY2HC.45.35.D02.1.454.CMB.1.raw
  modified_base (203)..(203): a, c, t, g, unknown or other
  misc_feature (203)..(203): n is a, c, g, or t
  modified_base (808)..(808): a, c, t, g, unknown or other
  misc_feature (808)..(808): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagaccctccggagaaattgtcttgacacagtctccagccattctgtctctctctccgagggganacacgcccaccctctcagtcgcgacgggcccagtcaagagttacttaagaactagtacttggaccttggtataacaactaacaacgccgtcggaccgtacggggtcccccgctcccgtcactcgtaatcgacttcgcttccgaggaccgacgggccctacgtcgggaccacctaccccgagtcccgtaaggttcgacggggttcggggtacggggtttggggtttacggcctaaaccggttacggtaacccgtttaccgtaccctttacgtaacccgtaactaacgttacgaacccggtccctaaaccggtcccccttaacccgtaaaaccccggttaggttaaaccggtttaactttttaccggaaccgtttaacggttttaccttaaacttttaacccgtacgtttaaacccgtaaacggtcggttaaccggttaacgtaacggttaaccggtttccggacccggttactttacccgggtttacgggtttcccggggaaccggggttaacggtaaaccgttacggggtaggtaacgtaaacggttaacccggaaacggtaggttcggtacgacgttacccgaaacgtaccgttagtcccgttnttacccg

SEQ ID NO: 240267 - DNA, 688 bp, Homo sapiens
  misc_feature: GYAE6OF01DFAWI.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggacacacgcccaccctctcaatgacctagggccaggtccagtacgtaattagaactatacttggccttggtactacaatacaagcctaggcctacggggtcccccgctccgtcactcctatgatcgcctcagcacgggtccagtcggccaactcccagccgtacgttcgaggtcgggcgggttgggtttcgcgacgtacgtactttccactccgtacgaactaagtcacgcgtaaccgtccctaacccaactacggtaaacgttacgttttacgacgtagttaacttacttacgtacgttactaactacggtacgtaacaaggttacgttacgggccgttaccgttacgtacccgggtttaccgggacccggggtaaacgggtaccggtaacgggtacggaaaccgtaacggtaacccggaaaacggtaccggttacgggtacgtaccgtacggtaccctaaccggtacgttccgttcggtttaacccg

SEQ ID NO: 240268 - DNA, 603 bp, Homo sapiens
  misc_feature: GYAE6OF01BDJE4.45.35.D02.1.454.CMB.1.raw
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
tcagacgcgatcgacacgaccggtgctcgatttagcacacgatagttgggttgggggaggaactgctcagttaggacccagagggaaccatggaagccccagctcagcttctcttcctcctgctactctggctccagagacctccggagaaattgtcttgacacagtctccagccattctgtctctctctcgagggganacagcctacctntcatgcagggccagtcagagtatagacntactggctgtatcaatcaagtcctaggccgacggtccccgcttaccgtcatcctagtgatcgccttcgagtcacgggcagtcggtcacttcccagtcctaggttcgaggtcgggacggtttcgggttgaccgtacgtacgtactaccgcgtctacaacgaatcgaagccgtaatcccctactaaacccggataacgttatttacggacgtattaattacgttacgttactaacgtaactaggtacgtaaccgtaagttcgtacggtacctccttagtccggtacggacgggaccgtaacgtaggtcgtacgacgttaccgaaaagtccgttgaccgggttacacgacccattggtccttggtcc

SEQ ID NO: 240269 - DNA, 812 bp, Homo sapiens
  misc_feature: GYAE6OF01ETGVT.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatactggcctggtatcaatacaagcctggccagggtccccgctcctcatctatgtatcgcttccagtcgacgggtccacgtcggcctactccccgacgtcccgtaacgggtttccgaagggttcggggtaccggggtttgggggtttttccggaccgtaaccggaagggtttaaccctttacccggaaacctttcccgttaaccaaaccgttaaacgttaccgtaacggtacccgtaacccgttacccccgttaaaccccgttaaacccggttaacggtaaacggtttttacgttttaccggtaaccgtttacgttttaaccgttttaactttaccggtttaacgtaaacccgtaacggtaccgttaaccggtaacgtaaggttacggttcccggggtaccgtttacccgttaccgtttacccgggtttacgggggaaccgggtaaaccggggtaaacccgggttaaaggggtacggtaaacggttaaccgtaaaaccggtaaaccggttcggtacgggtaccggtaaccggtccgaacccgttaacgttaccttcggttccgtttacccg

SEQ ID NO: 240270 - DNA, 741 bp, Homo sapiens
  misc_feature: GYAE6OF01B87LL.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctcggagaaattgtcttgacacagtctccagccattctgtctctctctccgagggganacagcccaccctctcagtgcgagggccagtcagtagtattagaacagtacttggcctgtatacaatacagcctggccgacgggtccccgctcctcatctatgatcgtccttccgaggcgacgggccctacgtcggaccactacccgacgtccgtaggttccgagggttcggggtccgggttggggtttcgggacctaacgtacggtacttcccgtacgttacctaccaactaacgtccacggtaccaacgtacccctaacccgtaaaccgtaacggtaaacgtttacgttttacggaccttaagtttaccttaacgttttaccgtacgttaaccgtaaacgtacggtaaccgttaacgtaacggtacggtttaccgggtacccgttaccgttaccggttaccggtttaccggggaaccggggtaaccggggaacccggtaaagggtacgggtaacggtaaccgttaaaccggaaacggttaaccggtacgggttacgggtaccgtacggacccgtaaccgtcgttccgttacgtttaccg

SEQ ID NO: 240271 - DNA, 686 bp, Homo sapiens
  misc_feature: GYAE6OF01ELBCA.45.35.D02.1.454.CMB.1.raw
tcagacgcgatcgacacgaccggtgctcgatttagcacacgatagttgggtttggggaggaactgctcagttaggacccagacggaaccatggaggccccagcgcggcttctcttcctcctgctactctggctcccagataccactggagaaatagtgatgacgcagtctccagtcaccctgtctgtgtctccgagggggagaccggcccacccgtctcctgcagggccagtcagttatgttagccacctaacttagccctaggtaaccaacagacgacctgacccaggcctaccaaacctcctacatccttcgtggtgtactccgacgacgggccacgttggtcgtaccagacgtaggtacgaagggcagggtcggtacgtagggactaggtagttcacttcacctaccatccgaggtccggtcctgctacgtacgtagtaagttacgttttaggtaacttttagttactacgtacgagtacctaaagttaacttaatccgtaacgtcgggtacccgttaacgttacgggtttaccggggaccggggggtaacccttaggtacgtagggtaacgtaacgttaacgaaaccgtaacgtggtaccggtaaccgttggaacccgtaaccttacgttaccgttccgttaccgtttaacctacccgttttcccgttcccgacgttaaccg

SEQ ID NO: 240272 - DNA, 688 bp, Homo sapiens
  misc_feature: GYAE6OF01C733L.45.35.D02.1.454.CMB.1.raw
  modified_base (205)..(205): a, c, t, g, unknown or other
  misc_feature (205)..(205): n is a, c, g, or t
tcagacgcgatcgacacgaccggtgctcgatttagcacacgatagttggggtttggggggaggaactgctcagttaggacccagagggaaccatggaagccccagctcagcttctcttcctcctgctactctggctcccagagacctccggagaaattgtcttgacacagtctccagccattctgtctctcctctccgagggganacagcccaccctctcatgcgacgggcagtcagagtatagaactatacgttggctaggtactacaatacgaagccgtggaccgacggggtccccgctccctacgtacttactatggactcggtccttacccgaggtccgacgggtacccacggttggacctacctacccgagtaccggtacggttaccgaggggttcgggtcggggtttgggtttacggcctacgtacgtaccttacgacttcgtacacaatcgacgaccgaccgtaccctacccgtaaaccgtacgtaaacgtttacgtttacgaccgttacgttacctttacgttacgttacgtaacaaccgttagtaaccgttaacgtaacgtacgttcccgggaccctacgttaccggttaccgttcgggaccgggtaacggaccgagggtacggacgtaacgtacgaaacggtacggtgtcggactacgaccatactcgttcgttaccg

SEQ ID NO: 240273 - DNA, 747 bp, Homo sapiens
  misc_feature: GYAE6OF01CIUDX.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcgagggccagtcaagagtattaagaactatacgttggcctggtaatacgaatacaacgtcctacggaccgtacgggtcccccggcttccgtacatcctatcgatacgtccttccagtcgacgggccacgtacggcaacgtcccagtacccgtaggttaccgaggtgggtacgggtttggggtttcggacctaacgtaacggtaccttaccgaccgttaccttaccaaacgtaaccgtacgaacgtccgtaaccggtacccctaaaccccgtaaaccgtacggtaaaacgtttaacgtttacgaaccgttaagttacctttaacgtttaccgtacgttaaccaaccgtaacggtaccgttaacgaacgttacgttacccgggacccgtacgttacccgtaccgggtttaccgggaccggggtaaaccgggtaaccgaaagggtacggtaacgtaacggtaaccgaaaacggtaccgtacggtacggtacgttaccggaacctaaaccgttagttccgttacgtttacccg

SEQ ID NO: 240274 - DNA, 668 bp, Homo sapiens
  misc_feature: GYAE6OF01CZ2P7.45.35.D02.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatcgcagggccagtcagagtattaganatacgtgcctggtatcaatacaagcctcggccgacgggtcccccggtactcccgtctatctatgactcgtccttccaggcgaacgggcccaacgtcggccaacgtccccagacccgtaggttaccgagggttcggggtccggggtttggggtttcggaccgtaacgtaacggtacctttaccgacctttccgtacaactaactacaacggaccacgtcccctaccgaacccttagaacgttatttcgactacgttacttagttactagtaccaacgtacgtacgtaactaggtacgttcgggcccgtacttaccgttacgtttaccggggacgggtacggaaccgtaagggtacggaacgtaacgtacgtaaaacggtacggttacggtaggtaccgtacgaacctactacgttctcggttacc

SEQ ID NO: 240275 - DNA, 781 bp, Homo sapiens
  misc_feature: GYAE6OF01BQ6ZR.45.35.D02.1.454.CMB.1.raw
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtcctctctctccgagggganacngccaccctntcatgcagggccagtcagtagtatagaacatacgttcggcctggtatcaatacaagccgtaggccgacggggtcccccgctccctacacgttcctagtcgtattcgtccttccgaacggccgacgggtccctacgttcggaccacgtcccgacgccgtaacggttacgagggttcggggcggggtttgggtttcgggccgtaacggtaacggtacctttaccgtactccgtaactacgtaaactccgtaacgacctaaccgtaccccttaaccccgtaaacccgtaaggtaaacgttacgttttacgaccgttaacggtttaaccgttactttaaccggtacgttacctaaaccggtccgtaacggttaacgtaacggttacggttacccgggtacccggtttacccgttacggtttaaccccggtttacggggaccggggaaaccggggttaaacccggtaaggggtaacggaaaccgggtaacgtaaacccggaaaacggttaccggtaagggtacggtaccgtacggtaacccgtaaccgtactttcccgttcggtttaaccc

SEQ ID NO: 240276 - DNA, 708 bp, Homo sapiens
  misc_feature: GYAE6OF01C1NRN.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctctcatcgcgacgggccagtcagagtatagacatacgtgctggtatacaatacaagccgtggccgacgggtccccgctcctacattctagtgatcgcttaccgagtcgacgggcctacgtcggaccacgtcccgaagtcccgtaaggtttccgaagggtcgggtccgggtttggggtttacggaccgtaacgtacggtcctttaccgacttcccgtacaacctaagtccgaacgtccgtaccgtaccctaacccgtaaaccgttaggtaaactttcgttttacggaccttaaggtttaccttaacgtttaccgtagttaacccgaaacgtaggtaaccgttaacgaacggttaccgttacgggcccgttaccttacggtaccggtttacggggaaccggttacgggaccgtaagggtcggaactaacggtaccgaaacgttacggcgggttaggtcccgtaaggtacccgaacttacgttcggttcgttacccg

SEQ ID NO: 240277 - DNA, 259 bp, Homo sapiens
  misc_feature: GYAE6OF01BWQGM.45.35.D02.1.454.CMB.1.raw
  modified_base (254)..(259): a, c, t, g, unknown or other
  misc_feature (254)..(259): n is a, c, g, or t
tcagacgcgatcgacacgaccggtgctcgatttagcacacgatagttgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatccttcccgccatctgatcgatcgcgtctgagcgggctggcaaggcgcatagnnnnnn

SEQ ID NO: 240278 - DNA, 714 bp, Homo sapiens
  misc_feature: GYAE6OF01DUNY8.45.35.D02.1.454.CMB.1.raw
  modified_base (379)..(379): a, c, t, g, unknown or other
  misc_feature (379)..(379): n is a, c, g, or t
  modified_base (654)..(654): a, c, t, g, unknown or other
  misc_feature (654)..(654): n is a, c, g, or t
  modified_base (673)..(673): a, c, t, g, unknown or other
  misc_feature (673)..(673): n is a, c, g, or t
  modified_base (697)..(697): a, c, t, g, unknown or other
  misc_feature (697)..(697): n is a, c, g, or t
  modified_base (711)..(711): a, c, t, g, unknown or other
  misc_feature (711)..(711): n is a, c, g, or t
tcagacgcgatcgacacgaccggtgctcgatttagcacacgataggttgggtttgggggaggaactgctcagttaggacccagagggaaccatggaacgccccagctcagcttctcttcctcctgctactctggctcccagatacccaaccggtaaaattgtgttgacacagtcctccgacgcaccctgtcctcgtcgtctcgagggacacgacgcccaccctcctcccgtcggaccgtacggacgtagggtacgtagtacgtagtaacggttacggttacgtacggttaccgtaccggtaaccgtaacgaaaccgtaacccggtaccggaaccgtccggaccctaccggccgttaccctccgtactacctacgtactntacgtacacctaaccgtacccgaaccggtaccggtcccgaccgtccgaccgacgtccgtacgggtcgtcgacgtaggtcggtacgcggtagttcgtcttacgaccgtctacccggtcgtaccgacgtccgacggtacgcgtacgtcgtagttacgttggttaccttgttaaaccgtttccgtttcgacgttacggactcgtaccgtccgtccgtcccgacctcgtccgtcgtaccgttcgggtaccgggcgttaaggcggtacgtacggacgtanacccgggtgtcgcggtacncggtacacgtgtcgacttcgtacncgtactccgtcgtntcg

SEQ ID NO: 240279 - DNA, 799 bp, Homo sapiens
  misc_feature: GYAE6OF01C4S4G.45.35.D02.1.454.CMB.1.raw
  modified_base (793)..(793): a, c, t, g, unknown or other
  misc_feature (793)..(793): n is a, c, g, or t
tcagacgcgatcgacacgaccggtgctcgatttagcacacgatagttggggtttgggggaggaactgctcagttaggacccagagggaaccatggaagccccagctcagcttctcttcctcctgctactctggctccagagacctaccggaaaaattgtgttgacacagtctccaggcacctgtctctgtcctcgaggggacgacacgccaccctctcctgcgagggccaaggtaggagtgtacaggtaacgtacttaggcgtaggtaccaacagaaacctcggacctacggcctaccccgaaggtcctaccgtaccacgtaccacgtcgtaacgtacgacctacgttaaccccgaaacggtaccggggttacccgttcggggaccccggttaccgaacggaaccggtacggggttcccggtacgggtccgtaacgggtcgggtcggtacggggaacgtaacgggtacgttacctaacccgttcgtaccgtacccgtacgacggacctaccggtccgtacgggtcgtacccgttgtaacgttcgttaacttttcggacctttaggtttacttccgtagttacgagtccggtaccgtccgtttaccccgaccgacggtaccgtcccgttacggttacccgggtttaccgggggggccggggggtaacgtcgggggttaacgggtaacgtccgggttaaggaaccgggtttaacgaacgggtttggcccgggtacacggtacccaacggttacctacgtttcggttaccttaacgtcccggttacccttccccgngttaac

SEQ ID NO: 240280 - DNA, 727 bp, Homo sapiens
  misc_feature: GYAE6OF01B0XC7.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatcgcagggccagtcagagtatagaactatactggctgtatacaatacaagcctcggccgacgggtcccccgctcctcatctagtgatcgtccttccgagccgacgggccctacgcggaccaccgtaccccgagcccgtaggtttcgagggttcggggtcgggttcgggtttcggaccgtacgtacggtacttaccgaccttccgtacctaacgaacgttaccgaacgtacccgtaccggtacccccttaaacccgtaaacccttaacggtaaacgttactttttcggaacttacggttaccttaacgtttaccgtacgtaaccgtaaacgtaccggtacgttaacgtaaggttaccggttcggtcccgttaccgttacccgttaccgggttaccgggaccggggaaccgggtaaccggtaaggggtacggaacgggttaacctaaccggtaaaacggtacgttagggtacggtacccgtacgtaccgaacctacttcgttcggttaccc

SEQ ID NO: 240281 - DNA, 742 bp, Homo sapiens
  misc_feature: GYAE6OF01DPBII.45.35.D02.1.454.CMB.1.raw
  modified_base (203)..(203): a, c, t, g, unknown or other
  misc_feature (203)..(203): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctcccagagacctcggaagtaattgtcttgacacagtctccagcctattctgtctctctctcgagggganacacgccacctctcagtcgcgacgggccagtcgaagtagttaattaacgaactacgtttacgttcggaccgttaggttactacaaacttaacgaacggtcccgttacgggacccgtaccgggggttccccccgtaccgttaccctactacgttacttaacgtcgtacgttcggtccttaccgacggcgaccgggcctaacggtcggacctaccgtaccgacgtaccgtaggttacgagggttcggggtcgggttcgggttacgactacgtacgttaccttaccgacttcctacgaactacgtacacgtacctaccgtaccctaacctaaagttacgtaacgttacgtttacgactgttacttaacgttacgtactaacgtaacgtacgtacgttaagtcgttacgttaccggccgttaccgttacgttacggtaccggggacggttaacgggaccggtaagggtacggtaagtaacgtaaaccgaaggtacgttacgggacgtaccgtacaaccgtaaccgtcgttcgttccgttaacg

SEQ ID NO: 240282 - DNA, 703 bp, Homo sapiens
  misc_feature: GYAE6OF01BNYT5.45.35.D02.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagacgcgatcgacacgaccggtgctcgatttagcacacgatagttgggtttgggggaggaactgctcagttaggacccagagggaaccatggaagccccagctcagcttctcttcctcctggcactctggctcccagataccaccggagaaattgtcttgacacagtctccagccattctgtctctctctccgagggganacagccaccctctcatgcagggccagtcagtagtatagaacntacttggcctggtatcaatacaagcctggccacgggtccccgctccgtcatctatgactcgtccttccgagcgacgggccagtggctactcccacggccctaaggtttccagggtcgggtacggggttggggtttacggaccgtaacgtacgtaccgtttccgaacttcctacctaactaacgttacccacggtaccaccgggtacccctacccgaaacccgttaggaacgtttagttttacggacttagttaccttagttactacgtaacctaacgagtaccggtaactaggtacgttcgggtacccgtacgtttaccgtccggttttacgggacccgggtacgggtaacccgtaaggggtacgggtaaacggtaccgttaaacggtaaaacccggtacggttacggttaccgggtcgttacggaaccctaacccgtagtttcccgtcggtttacccg

SEQ ID NO: 240283 - DNA, 792 bp, Homo sapiens
  misc_feature: GYAE6OF01ECKBI.45.35.D02.1.454.CMB.1.raw
  modified_base (198)..(198): a, c, t, g, unknown or other
  misc_feature (198)..(198): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagataccaccggaaaaattgtgttgacacagtctcagccattctgtctctctctcgaggganacacgccaccctctcatcgcagggccagtcaagagtatagaactatacgttgcctggtactcaatacagcctggccgacgggtccccggctccgtacacttcctagtgtactcgtccttaccgagtaccgagggggaccctaacggttcggacctaccgttaccccgaacggtcccgtaaggtttccgaagggttcggggttacggggttcgggtttacgggaccgtaacggtaacggtaccttttaccgaacttacccgttacgaaacctaacgttaccacggtacccggtaacctaccccgtaaccctaaacccggttacggtaaacgtttaacgtttttaccggaccgttaacgtttaacccgtttaactttaccggttaacgttaaccgtaaaccgtaacggtaacggttaaccgtaaggtaccgttaccgggtacccgtccgtttaacccgtaccgggtttccggggaacggggtaacccggggtaaaccggtaggggttaccggtaaacgggtacgttaaaccggtaaacggtacggttacggtcggtaactccgggacctacctagtttaccgtcgttcctaacccg

SEQ ID NO: 240284 - DNA, 863 bp, Homo sapiens
  misc_feature: GYAE6OF01EHHFT.45.35.D02.1.454.CMB.1.raw
  modified_base (852)..(852): a, c, t, g, unknown or other
  misc_feature (852)..(852): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggcctcccagacgacctccggaagtaaattgtcttgacacagtctccagcctattctcgtctcctctcgtccgagggacgacgacgccctaccctctacagtcgacgacgggcctagtacgaagtagttaactaagaactagttacgttcggacgttaggtataaccaaataccgtaacggtccgtacggacccggtaccggggttcccccggacttcccctacgtacttaccgttaagtgtacgttccggtccttaccgacggtccggacgggtacccctaggtaccggacccttaccgccccggtaacgtaccgggttaacgggtaaccgttcgggggttcggggttcgggggttttagggtacccggaaccgttaacggacgtttacccgttaccctaccgttaccttaaccgaaaccgttagtacccgtaaccggacccgtaaccccgtacccgtttaaaccccgaacggtttaaacgggttaacgtttacgtttaacgtaccgtttaagttttacccgttaaacggttttctaaccggttaacctaaacggttcgtaacgtaacggttaccggtaacggtcccgggtaaccgttcccgttaaccgggtttccggttaccgggggaaccggttaaggggaccgttaacggggaggtaacgtaacggtaacgtaaaccgggtgtacgggtacctacgaccgtacctaacctgtttcccgnggtttaacccc

SEQ ID NO: 240285 - DNA, 621 bp, Homo sapiens
  misc_feature: GYAE6OF01A6FJD.45.35.D02.1.454.CMB.1.raw
  modified_base (203)..(203): a, c, t, g, unknown or other
  misc_feature (203)..(203): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagatacctctggagaaatagtgatgacgcagtctccagccaccctgtctctgtctccgagggggaanagccaccttctcctgtaggccagtcagactattaccagcaacttagcctaggtatcagacaaaacctggccaggctcccggctcctcatctcgtggtgctacacaccgagggccacgtggtactcccagccaggttcaggtggcaggtgggtctgggacgtagggttcctcgtcgaccagtcggaacgggctacgagtctaggtaagtattttgacttaagtttatacgttgtctaatcgtaagttactcactcggacgggtactaacgttacggttttacgggaccgaagggggtaaccctaaaggtcgtaagggtacgaacggttacaaaaccgggtaacgttggtacgggccttacgggtaccaaccttagttccttacggttccttacgaactttcccttcccggattaacccg

SEQ ID NO: 240286 - DNA, 728 bp, Homo sapiens
  misc_feature: GYAE6OF01BWRYA.45.35.D02.1.454.CMB.1.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcagggcagtcagagtatagaacatacgtgctaggtatacgaatacagcctcggccgtacggtccccgtctccgtcntctatgatcgcttccgacgcgacggccacgtcggctaccgtacccgacggccgtacggttcgaagggtcggggtcggggttgggttttacggacgtaacgtacgtactttaccgtacttcccgtaacaactaacgtacgacgtaccgtacgtacccctaaccgtaaaccgttacgtaaacgtttacgtttacggtacgttaacgtttaccgttaactttaaccgtacgtaaccgtaacggtaccgtaacggttaaacgtaggttaaccgttaccggggtacccgttaccgttacgttaaccggtttaccgggacgggtaaccgggtaacccgtaaggggtaaccggtacggaaacgttaaccggtaaaaccggtacggttacggttaccggtaccgtacggaccctaaaccgttctaccgtttacgttacccg

SEQ ID NO: 240287 - DNA, 913 bp, Homo sapiens
  misc_feature: GYAE6OF01AT9UH.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagtagacctaccggacgaaacgttgtcttagtacacgtagtacctaccaagtcctacttctcgtcctcgttcttcgtccgacggggaggaacacggcccacccgttctcctagtcggacggacggacctagtacgagtaggttagtacgaactacgttacgttcggtccgttacggtaactacgtaaacgtaccgaacggtccgtccggacccgtaaccgggggtccccccgtacgttacccgttaccgtaacgttccgtttaacgtcgtaacgttaccgtaccgttccggaacggtacgtacggggaccctacgtccggacctaccgtacccgtacgtaccggtaggttaccgtaggggttcggggtacgggttcggggtttaacgacgtaacgttacggtaccttaccgtaccttacccgtacgtaaccaacgttaccgaacggtacccgtaaccggtaccccgttacccgtaaaccccggttagggtaaacggttttacgtttttaccggaaccgttttaacggttttaccctttaaaccgttttaaccggtaccgtttaaacctaacccgtaacgggttaacccgttaacggttaccgggtttaccggttacccggggtacccgttaaccggtttacccgggttaaccgggttacggggtaacccgggtaaccgggtaacggttacgggtaaacggtacggttaacgtaaccggaaacggttacggtacggtacgtaccgttacggacctacgtccgttcgtcgttaccccg

SEQ ID NO: 240288 - DNA, 634 bp, Homo sapiens
  misc_feature: GYAE6OF01ACWAZ.45.35.D02.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (293)..(293): a, c, t, g, unknown or other
  misc_feature (293)..(293): n is a, c, g, or t
  modified_base (611)..(611): a, c, t, g, unknown or other
  misc_feature (611)..(611): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctcccagagacctccggataaattgtcttgacacagtctccagccattctgtctctctctcgagggganacacgccaccctctcagcgcgagggccagcagagtatagaacatacttggcctgtatacaanacaagcctggccgacgggtccccgctccncatctatgatcgtccttccgagcgacgggtccacgtcggcaacgtcccacgccgtaaggttccgaggtggggtacgggtttggggttacggctaacgtagtacctttcgaacttcacactaactcgaagcctaacgccctaccaaccgtagtaacgtttactttcgaaccttgttacttagtttacgacgtaccaacgtacgtacgtaaccgttagacgttaccggcccgttacttacgtaccgggttacggggacgggtaacggaccggtagggtacgacgttaacgaaccgtaaacggtgtcggttaggacttacncccgtacaggttcctcgttaccc

SEQ ID NO: 240289 - DNA, 693 bp, Homo sapiens
  misc_feature: GYAE6OF01EVMUM.45.35.D02.1.454.CMB.1.raw
  modified_base (203)..(203): a, c, t, g, unknown or other
  misc_feature (203)..(203): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctcccagataccaaccggaaaaattgtgttgacacagtctccaggcacctgtctctgtctccgagggganacacgcccaccctctcctgcgaggccaggtaggagtgtacaagtaagtacgtaggctacggtaaccaacgaacgaaaccgtggaccgacggcctacccgaggtcctacgatcactctagtcgacgcaacgtccgaacgacgggaccacgtcggactacctacccgacgaccgtacgggtacgtacggtacggccgtaagggttcggggtccgggtagggaaccgtacggtaacctttaccaccgtttaccacctaacccgattacccgaacgccgtacggtccgtacccggtaccgtaggtagggtttctttacgaccttagttttaccacttcgacaggcgtacgtacggtggaccgaccggacgtccgcccgttacgttacccgggttggaacgggtacgggacgtaacgggtcggtaactaacgtaacgtaaacggtcgtgggaccgtcggcctacgaacctgttacttacgcttacgccgttcccg

SEQ ID NO: 240290 - DNA, 757 bp, Homo sapiens
  misc_feature: GYAE6OF01E3RRY.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctcggcctcccagacgacccgtccggaagtaaattgtcttagacacacgtctccagcctattctgtcctctctcgtccggaggggacacaccgccctaccctctcagtcggcgacggccagtacgaacgtaagttaattaacgaaactagtttaccgttcggtccgtaggttaactaccaaagttaaccgaacggtcccgtcgggacccggtaccggggtcccccgtccgtcctactaccgttacgtaacgtcgtacgtcgttaccgttaccggacggtcgaccgggccctacggtacgtaccctaccgtacccgaccggtaccgttacgggtttcgacggggtttcggggttaccgggtttggggttacgaccgttaacgtacgttaccgttaccgtacgtacccgtaacaaccgtaacgttccgaacgtacccgtaaccgtacccctaaacccgtaacgttaaggttaacgttcgttaacgcgttaactttacgttactacgtacgtacgaacctgtacgtacgagttccggtccggcttacgttacgtacgggtcggacggtaacgtggacgtagtacgacgtaaacgacgttgcgtacgctaacgcgtaatcgtttcgtctaccg

SEQ ID NO: 240291 - DNA, 778 bp, Homo sapiens
  misc_feature: GYAE6OF01C9SG3.45.35.D02.1.454.CMB.1.raw
  modified_base (199)..(199): a, c, t, g, unknown or other
  misc_feature (199)..(199): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctcggagaattgtcttgacacagtctccagccattctgtctctctctccgagggganacacgccaccctctcatcgcacgggccagtcaagtagtattagaactatacgttcggccgtaggttatactaaactacgaaacgccgttacgggccgacggggtcccccggctcctcacttctagtgatcgtccttccgagtacgacgggtcctacgtgggacccaccgttcccgacgtaccggtacggtttccgagggttcggggtcgggttggggtttacgggacccaacgtagttacccgttacacccgttctaccgaactaactcgaccgaaccgtacctacccgaacctaaccgtaacgtaaaggtttagtttacggacttacggtttaacctttaacggtttacctttaggtaaccgtaaaccgttacggtacccgtaacgttaacgggttaccgtttaccgggggtacccttaccgttaccggttacccgggtttacgggggaccgggttaaaccgggggaaaccggtaaggggttacggaaaccggtaaacggtaacccgttaaacggtaaccggtacggttacggtaccggtaccgtaccgtaacgtttccgtgggtttacctttcccgg

SEQ ID NO: 240292 - DNA, 627 bp, Homo sapiens
  misc_feature: GYAE6OF01EJC2M.45.35.D02.1.454.CMB.1.raw
  modified_base (304)..(304): a, c, t, g, unknown or other
  misc_feature (304)..(304): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggcacacgcctaccctctcatgcgaggccagtcagagtatagaactatacgttggcctaggtactacaataccaagtccgtggccacgggtccccgacctcgtactntctatcgactcgtcttcgagcacgggtccacgtcggacacgtccccagtccgtaggttcgaggttcgggcgggttgttcggactagacgtcttcactcctacaactaactcgacgcactaccctacccaacgtgtaattacgtttgacgttacgttcttaacttacgttcgtaacgaacgtagtacgtaacgtaagcgttaccggtcctaccgttcgtaccgttacggggaccgtaacgggtaccgagggtaggaacggtaacgtaacgaaacggtacgtaggtacggtaccgtaacgtacctacgtcttcgttcgttacccg

SEQ ID NO: 240293 - DNA, 649 bp, Homo sapiens
  misc_feature: GYAE6OF01D7K23.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcgagggccagtcagagtatagaacatactggcctggtatacaatacaagcctaggccacgggtccccgctccgtcatatatgatcgcttccgagcagggccacgtggctactcccgacgccgtaggttcgaggtcgggtacggttggggtttcggacgtacaacggtactttccgactctacaactaactcgacgacctaccgtaccctacccgaaaccttagtaacgttattttccgaacgtacgtttaccttacgttttaactacggttaaccaaacgtacggtacgtaacgaaggtacgttccgggaccttaccgttccgtacggttttccgggaccgggtaacggaaccggtaagggtaggaacgtaacgtaacggaaaacgtcggtaggtcgtacgcggtacctaaccgtcgtccgttgttaccc

SEQ ID NO: 240294 - DNA, 819 bp, Homo sapiens
  misc_feature: GYAE6OF01D0EK7.45.35.D02.1.454.CMB.1.raw
  modified_base (203)..(203): a, c, t, g, unknown or other
  misc_feature (203)..(203): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagtaaattgtcttgacacagtctccagccattctgtctctctctccgagggganacacgcccacccctctactcgcgacgggaccgacgtacgacgaagtaagttaagtaaactaacttaacgttcggtccgtaggttacgtactaaactaacaacgccgtccggtaccggaccggggtaccccgggtccccgtaccttaccctacgttccttacgtacgtacgttacgtccgttacccgtacggaccggtacgggccgtacccgtacgggtaccgaccgtaccccgtaccggaccggttacggttccggtaacgggttcgggggttcggggttcgggggtttacgggtaccgaaccgtaacgtaccgttacccttacctaccgttacaaaccgtaacttaccgacggtaccgaccgtaaccccgtaccctaaaccgtaggttaacgttaacgttttcgacctagtttaacgtttactttactacgttaacaaccgtaagtaccgtaacaggttcgttacggtcccgtacgttacgttaaccggtttccggggtacggggaaacgggtaaccggtaagggtccgggtaaggaccgttaaaccgaaacggtaacggttcggtcgggtacccgtacgtacccggaacttacttccggttagttcccgttaac

SEQ ID NO: 240295 - DNA, 848 bp, Homo sapiens
  misc_feature: GYAE6OF01EH50V.45.35.D02.1.454.CMB.1.raw
  modified_base (712)..(712): a, c, t, g, unknown or other
  misc_feature (712)..(712): n is a, c, g, or t
tcagacgcgatcgacacgaccggtgctcgatttagcacacgatagttgggtttgggggaggaactgctcagttaggacccagagggaaccatggaacgccccagctcagcttctcttcctcctgctactcgtggcctccgagacgacccttcggaagtaaattcgtcttagacacacgttctccagtcctattctgtcctctactcaccgtaggggacacgtacgcctaccgttctcagttcgccgaacgggtccacgtacgtaacgtaacggttatttaacggaacttaaacttaccggtttcgggaccgttacggttactaacaaacgttaacgtaacggtcccgttaccgggacccggttaccgggttacccccggtaccgtttaccgtacttacgtaccgttaacgtccgtaaacggttccgtaccttacccggtaggtacccggacggtaccccgtaacggtccggtacctaaccgtacccggtaacggccgtttaacgggtacggtaacgggtccgggttacgggttacgggtttccgaacgttacgtaccgttactacccgttacgtcctaacgacggtaactacgtacccgtaacgtaccgtacccgttaaccgtaacgttaaggtaacgtttacgttacgtacgtttcgtaccctttaacgttacggttaacccgtacgtaacccggttacaaccgggtttanaaaccgttcggttccgtaaccgttcgttaccgggttacgggttagggaaccggtttacgggaacttaaacgggcgtaatacgtaacccgtaagtacgccgttagttaccgacttacgaccttggtaccttggttcc

SEQ ID NO: 240296 - DNA, 269 bp, Homo sapiens
  misc_feature: GYAE6OF01BA1QL.45.35.D02.1.454.CMB.1.raw
  modified_base (256)..(256): a, c, t, g, unknown or other
  misc_feature (256)..(256): n is a, c, g, or t
  modified_base (259)..(269): a, c, t, g, unknown or other
  misc_feature (259)..(269): n is a, c, g, or t
tcagacgcgatcgacacgaccggtgctcgatttagcacacgatagtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcgatccttcccgcctagtctgatccgatcgcgtcgtgaggcggctggcaaggcgctanagnnnnnnnnnnn

SEQ ID NO: 240297 - DNA, 672 bp, Homo sapiens
  misc_feature: GYAE6OF01DVKBJ.45.35.D02.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgccagggccagtcgagggtgttaacnggctacgtacgcctaggtaaccaaacaaaaaccgtcggaccaggcctccgaggctcatcactctatcgacgcatacgaacgacgggaccacgtaggcaacctcccgacgtccgtaggttcgaggtcggacgtagggttcgggtcgtacggggaacacggtaccttcacgttcctacctactaactcgacgcgtacgtccgtacggtaccgtgggtacgtagttttacacctttactttaaccttacgtcgttacgacgtcgtacggcggtcgggaccgaccggacgtccgtcgttaccgttcgggtttaccgggacgggtaaccggggtaacgtaagggacgggtaacgtaacggtaaaccggtaaacggtaacggttcgggacggtccgacgtacccgaccttaaggtttcctcgttccgtttaccg

SEQ ID NO: 240298 - DNA, 705 bp, Homo sapiens
  misc_feature: GYAE6OF01C2TIU.45.35.D02.1.454.CMB.1.raw
  modified_base (112)..(112): a, c, t, g, unknown or other
  misc_feature (112)..(112): n is a, c, g, or t
  modified_base (184)..(184): a, c, t, g, unknown or other
  misc_feature (184)..(184): n is a, c, g, or t
  modified_base (613)..(613): a, c, t, g, unknown or other
  misc_feature (613)..(613): n is a, c, g, or t
  modified_base (669)..(669): a, c, t, g, unknown or other
  misc_feature (669)..(669): n is a, c, g, or t
  modified_base (679)..(679): a, c, t, g, unknown or other
  misc_feature (679)..(679): n is a, c, g, or t
  modified_base (695)..(695): a, c, t, g, unknown or other
  misc_feature (695)..(695): n is a, c, g, or t
tcagacgcgatcgacacgaccggtgctcgatttagcacacgatagttgggtttgggggaggaactgctcagttaggacccagagggaaccatggaagcccagctcagcttcncttctcctgctactctggcctcccagacgacctccggagaaattcgtcttgacacagtctccaagccattcngtctcgtctcgtaccgaggggacgaccacgaccctacccgtcttaccgatcggcgacgggacctagtccgaagtagttattaaggaactagttacgttcggacctaggttactacaagtaaccaaacggtcctacgggtcccgtaacggggtcccccggtaccttccctacgtaacttccgtaagtacgtaacgttcggtacccttacgacggtaccgacgggtaccctacgtacggaccaccgtaccccgaagtccgtaaggttacacggggttacgggtcgggttcgggtttaccggacgtaaccgacggttaacctacgtaacctaccggttaacaaacgttacgtaccgaacgaccgtacgacccctaacgtaacgaggttaacgtacgtttcgaacttacggttactaactacgtactaccaanaccgtacaacgagcgtacgcctactacgtcgtacggaggtacgacggaagtcgaanacgtacgaancgtgtcagcactacgntcggtctacg

SEQ ID NO: 240299 - DNA, 655 bp, Homo sapiens
  misc_feature: GYAE6OF01EQBCQ.45.35.D02.1.454.CMB.1.raw
  modified_base (141)..(141): a, c, t, g, unknown or other
  misc_feature (141)..(141): n is a, c, g, or t
  modified_base (172)..(172): a, c, t, g, unknown or other
  misc_feature (172)..(172): n is a, c, g, or t
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (524)..(524): a, c, t, g, unknown or other
  misc_feature (524)..(524): n is a, c, g, or t
  modified_base (535)..(535): a, c, t, g, unknown or other
  misc_feature (535)..(535): n is a, c, g, or t
tcagacgcgatcgacacgaccggtgctcgatttagcacacgatagttgggtttggggaggaactgctcagttaggacccagagggaaccatggaacgccccagctcagcttctcttcctcctgctactctggctcccaganacctcggagaattgtcttgacacagtctcanccattctgtctctctctcgagggganacagccaccctntcagtgcacgggccagtcagagtattagaactatactggcctggtatcgaatacaagcctaggccacgggtccccgtctcctactactctagtgtattcgtccttaccgagcgaacggccagtcggactacgtccagccctaggttcagggtggtcgggttggttacggactaacgagtaccttgaccctattaccaacttaactccgaacggtcccacggttacccctaaccgtaaaccccgttagtaaaccgtttattttacgggacttaaacggtttccttaacgtttaacctacggtaacttaacccggntaacccggtanaacggttcgtcgggtaccctcgttacgtaaccggttcgggacgggaacgggtacgtagggttagaacgtacgtaacaaacggtctggtgtaaccgtgaccctactacgttcctagttacc

SEQ ID NO: 240300 - DNA, 899 bp, Homo sapiens
  misc_feature: GYAE6OF01C903Z.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagatacccaaccggaaaattgtgttgacacagtctccaggcaccctgtctctgtcctccgaggggagacacgccctaccctctcctgcgagggccagtaggagtgtactaagtacgtacgttaggcgtacggtaccaaacgtaacgaaccgtcggacccgagggccctcccgaggccttccactacctacctagtagactacgacctactaccgaaccggtaccggtcccgtacggtccgccccgaaggtaacctcgggttccggtaggacggtacgggttcgggtacggtacggggtaactacgggcgtttacgtacccgttacctacccggtaacccggtacacgggacccgtaccggtaccggttacgggacgtacccgtttaaggtacggtttacgttttaacggttttccggtaaaacgttttttcggtttttactccgttacgggtttaccgaaaggtttcccggtacccggttttccctaccccggaccctacccgggtttccgacccggttttcccggtttaaccggggggggttcccccgggggggaaaacccgggggggtattaacgggggggggtttcgtaaaaggtccggtttaagggggaaaccccgttccgggttaaaacggggttccgggaaaacgggtttcccgtacccgggaacttttaaacccgtttccggggttcccttttaaacccggttccgttttaacccgcccggttacccccccggtttccggtttccctttaagggg

SEQ ID NO: 240301 - DNA, 648 bp, Homo sapiens
  misc_feature: GYAE6OF01AOG83.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagaccctccggagaaattgtcttgacacagtctccagccattctgtctctctctccagggganaccagccaccctctcatgcagggccagtcagagtattagaacatactggcctggtatcaatacaagcctggccacgggtcccccgctcctcatcctaagtgatgccttccaggcagcgccacgtcggcactccccgaggtccctaggtccaggttcgggcgggttagggtttcgccacgtacggtacctttcgacttcgtaccaactactaccgaacgccgtacgacccctaccgaaaccttacggaaacgtttacgttttacggaccgttaagtttaccttaagtttacccgtgttaacccgaaacgtcgtacgtaacgtaggtacgttcggtccgtcttaccgttaccgtttcgggaccgggtaacgggtaacccgagggtacggacgtaacgttaacgaaacggacgttacggcggtacgtacggactaccgtgttacgttacg

SEQ ID NO: 240302 - DNA, 798 bp, Homo sapiens
  misc_feature: GYAE6OF01C1MPW.45.35.D02.1.454.CMB.1.raw
  modified_base (768)..(768): a, c, t, g, unknown or other
  misc_feature (768)..(768): n is a, c, g, or t
tcagacgcgatcgacacgaccggtgctcgatttagcacacgatagttgggttgggggaggaactgctcagttaggacccagagggaaccatggaagccccagctcagcttctcttcctcctgctactctggctccagagaccctccggagtaaattgtcttgacacagtctccagcctattctgtctctctctccgaggggacacacgcccaccctcctcatcggcgacgggccaggtacaaggtacgttataacggaactaagtaccttggtccttaggttactaacaaataccgaaccgtccggtacgggacccggtacccggggttccccccggtcctcccgtacctacgttccgtaagtcggaaccgttcgtaccccgttaaccgaccggtaccgggaccgggtaccccgtacgggtaccggaccctaccccggtaccccgtaacggtcccgttaacgggtttacgggaccggggtttcgggggggttacggggttttggggggtttacccggaacgtaacggtacccgtacccgttttccgaaccctttccgtaaacctaaccctaacggtaccgtaccggacccgtaacccctaccccgttaacccggtaaactttacgggtaaacgtttacgtttacggtaccttaccgttattaaccgttacgtaccgtaactacgtagtacgtacgtagtcgtcgtctcgtcgtacggttcggacgggacgaggaggtacaagtaccgtagaaacggtctacgggtacncgtacgaactccgttacgtcgttcttaccg

SEQ ID NO: 240303 - DNA, 718 bp, Homo sapiens
  misc_feature: GYAE6OF01B5IWX.45.35.D02.1.454.CMB.1.raw
  modified_base (151)..(151): a, c, t, g, unknown or other
  misc_feature (151)..(151): n is a, c, g, or t
  modified_base (203)..(203): a, c, t, g, unknown or other
  misc_feature (203)..(203): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccgganaaattgtcttgacacagtctccagccattctgtctctctcctccgagggganacagcccaccctctcatgcgacgggccagtcagagtattagaactatacgttcggcctaggtatcgtaaatacaagccgtcggccgacgggtccccgctccgtcatctatggatcgtccttcagtcgacggccacgtggacctactcccgagtccgtaaggttcacggtggggtccggtttggggtttcgactacgtaaccgggtactttccaacgttaccgttactaacctaacgtaccgaacggtacctacccggtaccccttaaccccgtaaaccgttaacgtaacgtttaaccgttttgaacccgtttaagtttaccgtttaacgtttacgttaactaccgtaactaacggtaccgtaacgtacgttaacggttcggtccgtacctttacggtacgtttaccgggaccggttaacggggaccgttaaaggggtacggaacggtaactaaccggtaaaccggtacggttacgggtacggtctacgggactaaccggtcttccgtcgttaacc

SEQ ID NO: 240304 - DNA, 673 bp, Homo sapiens
  misc_feature: GYAE6OF01BMKD4.45.35.D02.1.454.CMB.1.raw
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
  modified_base (565)..(565): a, c, t, g, unknown or other
  misc_feature (565)..(565): n is a, c, g, or t
tcagacgcgatcgacacgaccggtgctcgatttagcacacgatagttgggtttgggggaggaactgctcagttaggacccagagggaaccatggaacgccccagactcagcttctcttcctcctgctactctggctcccagataccaccggaaaaattgtgttgacacagtctccaggcaccctgtctctgtctccgagggganacngccaccctctcctgcgacggccaggtacggaggtcgtccaagtaacgtacttaggcgttacggtaaccaacgacggtaaaccctggaccgagggccctacccgaggccttccacacttccagtcgactgacactaccaacgtcgggtccctggccgtaccacgtacgtagggttccgtggctacgggtggtcgngggacctagtcgtacncgtcacgtaccgtagtacgacncgtccgtaggtaccgtccgtaggacttgtacgtttcgactttacgtttctgtacgtcgcgtcgtaccgtccgtcccgacaccgtccgactaccggttaccgggttccggggaccgggggtaaccgngggggttacgacgtacggtacgacggtacgacgttgggaccgtcgtgacccgtctacgttccgttacgttacccttacgtacccgttcccgttacccgtcgttaaccg

SEQ ID NO: 240305 - DNA, 712 bp, Homo sapiens
  misc_feature: GYAE6OF01AOVB2.45.35.D02.1.454.CMB.1.raw
tcagacgcgatcgacacgaccggtgctcgatttagcacacgatagttgggtttgggggagggaactgctcagttaggacccagagggaaccatggaagcccagctcagctctcttcctcctgctactctggctccagcgacctccggagaaattgtcttcgacacagtctcagcctattctgtctctctctccgagggagacgacgtccacctctacatcgcgacggcctagcaagtagttaacttaacgaaacgtaacttacgttccggtacgttacgttaacgtactaaacttaacgacgtaccgtcgggtaccgtaccggggtcccccggtctcccgtctaactctacgtagtactcgtccgttacgtcggacgacggacctacgtacggcctacgcccacggtaccgtacggttcggtacggtcgggttcgggttcggggttacgcctaaccggtagtacccgttacgtacctaccgtaaccgaactaactccgaacgtaccaccggtacccctaccgaccttaaagtaccggttacgtttagactacggtttaactacgttaccgttacgtactaaacgtcgtaaccgtcgttaagtactcggttaccgccttacggtacgttcggaaccggtaggtaaccggaggtagtaccgaacgtagtaaacgtcggtagtcggcgtaccacgtaacctcgttagttcgtacc

SEQ ID NO: 240306 - DNA, 721 bp, Homo sapiens
  misc_feature: GYAE6OF01D7APA.45.35.D02.1.454.CMB.1.raw
  modified_base (266)..(266): a, c, t, g, unknown or other
  misc_feature (266)..(266): n is a, c, g, or t
tcagacgcgatcgacacgaccggtgctcgatttagcacacgatagttgggtttgggggaggaactgctcagttaggacccagagggaaccatggaacgccccagctcagcttctcttcctcctgctactctggcctccgagacgacctaccggaagaattgtcttagacacagtcctccgagtcctattctcgtctctctcctaccggaggggacacaccgccctacctctacagtcgacgacggctagtacgagtactacgtaanaactagttacgtcggaccgttagtaactacaactacgaacgccgtaccggccggtaccgggtcccccgtctcccgtacgtacttcgtacgtagttcgtaccgtccgttaccgacggtaccgggaccgtacccgtacggtacgaccctacccgtaccgaccggtaccggttacggtcggtacggggttcgggttacgggggtttcgggtacccgaacgtaacgtatttacccgtacgtaccgtacctactaacgtactaccgacgtccaccgttacctaaccgacttaagtacgttcttaacgcttactttactagttacctacgtacacggtacgtactacggtagttcgtcgtacgttacgcggttacggtacggggacgtacggagtacggtacgtaaggacctaaggtacgtggtcgataccgtaccaacgttacctcgttcctcgttaccg

SEQ ID NO: 240307 - DNA, 1003 bp, Homo sapiens
  misc_feature: GYAE6OF01B0BHZ.45.35.D02.1.454.CMB.1.raw
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagcctattctgtctctctctcgaggganacncgcccacctctacagtcgccggtacgggacctacgtaccgaaggtaacgttaacgttaaacgaaaccttaacgttaaccggtttcggaccgttagggtaaacttaaccgaaaacgtttaaccgaaccggttacccgttaccggggaaccccggtacccgggggttccccccggtacctttaccccgtaccgtaaccgtttaccgtacgttacggttaacgttccgtaccccgtttacccggaaccggtccgggtaaacccgggtcccctaaccgggtaccggtacccctaacccgttccccggaaccgggttaccccggttaagggtttacccggaagggggtttccggggggttaccgggggtttttacgggggttttaacccgggaccggttaaacccggttaacggttttaaccccgtttaaccgttaaccccggttaccccgttaaaccgtaaacccgttaaaccggttcccggtaaacccggttaaccccttaaccggggtaaccccccttttaaccccggggtaaacccgtttaaggttaaaccggttttacgttttaaccggaaccgtttaccggttttaaaccgtttaacgtttaaccggttaccgttaaacccgtaaacggaccggtttacgtaaccggtaggttaccggtttaccggtaccttaaccggtttaccgtacgggtacggtaccgggtaaccggtaacgggtacggtagtaacgtaacgtaaccgtaaaggtcgttcggtacggaccgtacggtacctaacgtttactccgttacgttacccg

SEQ ID NO: 240308 - DNA, 554 bp, Homo sapiens
  misc_feature: GYAE6OF01BBLB2.45.35.D02.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtattagaacatacttggcctggtatcaatacagcctggccagggtccccggctcctcatctatgatgcttccagcagggccactggcatcccagccaggttcagtggcggttgggtttgcacagcttcactcncacaatcancacgcctaccaacctagaacgtattttcgctacgtactattactcgtacaacagtacgtaacgagtacgttcggccgtcttctacgtttcgggaccggtaacgggaccgtagggtagggacgtacgtaccgaaaccggtacgttaggtacggtccgtacgaccaccacttcgtgttaccg

SEQ ID NO: 240309 - DNA, 751 bp, Homo sapiens
  misc_feature: GYAE6OF01DJN82.45.35.D02.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (310)..(310): a, c, t, g, unknown or other
  misc_feature (310)..(310): n is a, c, g, or t
tcagacgcgatcgacacgaccggtgctcgatttagcacacgatagttgggtttgggggaggaactgctcagttaggacccagagggaaccatggaagccccagctcagcttctcttctctgctactctggctccagacgacctccggaagtaattgtcttgacacagtctccagcctattctgtctctcgtctccgaggganacacgtcccacctctcagtcgacgaggccagtcagtagtatanaactatacttggccttaggtactacaatacgaacgtccgtacggccgtacggtccccgctccgtntacttctatgtactcgcttacagtcgacggcctagtcggacctacgtcccagtccgtaaggtcagggttcgggcggtttagggtccgacgtacgtacgttaccttccgtacctcgtaccaacgtaactccgaacgtccaaccgtaccctaaccgtaacgtaacgttaacgttacgttttacgacgttaacttaccttaacgtttacgtacgttaaacctaaggtaccgtaaaccggttacgtaacgggttaccgtttacccgggtacccgtaccgttttacccggttaccggggtttacccggggaaccgggtaaaccggggtaaccggtaaaggggttaccgaaacggttaaccgtaaacccggtaaacggttaccgggttacgggtacgtacccgtaacggtccctaaaccggtttcttaccccggttagtttcccccg

SEQ ID NO: 240310 - DNA, 872 bp, Homo sapiens
  misc_feature: GYAE6OF01DA1KF.45.35.D02.1.454.CMB.1.raw
  modified_base (202)..(202): a, c, t, g, unknown or other
  misc_feature (202)..(202): n is a, c, g, or t
  modified_base (441)..(441): a, c, t, g, unknown or other
  misc_feature (441)..(441): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctccagataccaccggaaaaattgtgttgacacagtctccaggcaccctgtctctgtctccgagggganaccacgccaccctctccctgcgagggccgaggtaggtagtgtacgtaagtaagttacgttacggctacggtaccaacgaacgtaaaccgtggacctacgggtacctaccccgaacggtcccttacctacctaactaccaacggtactacgttaccggaaccaacgttaccccgaaacggtaccgggtaaccccgtcgggtacccggtacccgaacgtaacccggtacggtttcccgggngggtaccggtacggttccggggttcggtacggggaacgtaacggttacggttacctaccgttccgtaccttaacccggccgaacggccgtacgccggttacgggtcccgtaccgttaggtaaccgtttaggtttagtttaccgggttcttttaacggttttaactttcgttcggttaacgtacggtaccgtaccgggttaccgttccccggaacccggtaccgttcccggtccgttaaccgttcccggggggttttcccggggaaccgggggggttacccgtaagggggtacggtaacggttacgggtaacgtaaccgggtaaaccgggttaaccgggttgggtaacccggtcggtacgaacccgttacggacccgttacgttcccgtttaacgttacccgtaccgttccccgttaacccgcccgttaacg

SEQ ID NO: 240311 - DNA, 617 bp, Homo sapiens
  misc_feature: GYAE6OF01DIMEU.45.35.D02.1.454.CMB.1.raw
  modified_base (201)..(201): a, c, t, g, unknown or other
  misc_feature (201)..(201): n is a, c, g, or t
  modified_base (356)..(356): a, c, t, g, unknown or other
  misc_feature (356)..(356): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccgagggganacagccaccctctcatcgcagggccagtcagtagtattagaacatacttggcctggtatcaatacaagcctggccacgggtccccggctcctcacgtctatgtatcgcttccagccagggccacgtcggcacgtcccagccaggttcaggtcggnggtgggtttgctacgagtaccttcacgtctacgacaatcgagcacacctaccaaccttagtaacgtattttagactagttacttacttacttacgtactaacgacgaccgttacgtaagtacgttagggtccccgttacgttcccgttaacgtttaccggggaccgggtaaccgggtaccggaaagggtagggaacggtacgtaaccgaaacggtaacgtacggtacgggtactcggacaacctacttccgtgtttacccg

SEQ ID NO: 240312 - DNA, 680 bp, Homo sapiens
  misc_feature: GYAE6OF01ADLLZ.45.35.D02.1.454.CMB.1.raw
  modified_base (202)..(202): a, c, t, g, unknown or other
  misc_feature (202)..(202): n is a, c, g, or t
  modified_base (435)..(435): a, c, t, g, unknown or other
  misc_feature (435)..(435): n is a, c, g, or t
  modified_base (669)..(669): a, c, t, g, unknown or other
  misc_feature (669)..(669): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtgttgacacagtctccaggcaccctgtctctgtctccgagggganacacgccaccctctcctgcacgggccagtcgagggttacttaacagcttacttacggcctaggtaaccaaaactaaaaaccgtgggaccaaggcctcccgaggctacatcagtctatcgacgacagtcgaaacgcgggcacgtggacactcccgaggcctagggttcacggtggacgtagggttggggtaccgtcggggtaacacgtaccgttacaccgtcctaccgaacctntaccgacgcgaaccggcccgtacgggtaccctagggtaaccggttattttaccggacctttaacgttttaacctaccgttaggtccaacgggtcgtacggtccgggttacggaccgtacggacggtccgtacgttacgtcgttacggggacgggaccggaacgtaagggtcgagtaagtaccaaacggtacgtggtcgtcgtcgaaccgtctaacgtcttaccggtcttaccgngtttacccccg

SEQ ID NO: 240313 - DNA, 796 bp, Homo sapiens
  misc_feature: GYAE6OF01D5X0U.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcgacgggccagtcagagtattaagaacatacgtgcctaggtatacaatacagccgtggccacgggtccccgctcctcatctatgatggccttcagcgaggccagtcggacactccagcctaggtcagggttcgggtcgggttgggtttcgcgacgtacgtaccttacgactcctacaactaactccgacggaccctaaccgtaccctaaacccgtaaccgttacggtaaaacgtttcgtttttacggaaccgtttacggtttaaccttttaaacgtttaacccggtttacgttaaacccgtaaaccggttacggttaacccggttaaacctaaggggtttaaacccggttcggggtacccccgtttaaccggtttacccggttaacccggggttttaccgggggaccggggtaaaaccggggggtaaaccggtaaacgggggtagggaaccggttaaaaccggttaaaccggtaaaaacccgggttaaaccggttaccggggttaacgggtaacccggtttaccggaaaccccgttaacccgttaacgttttccccgttaggtttttaaccccccg

SEQ ID NO: 240314 - DNA, 695 bp, Homo sapiens
  misc_feature: GYAE6OF01C1LLE.45.35.D02.1.454.CMB.1.raw
  modified_base (150)..(150): a, c, t, g, unknown or other
  misc_feature (150)..(150): n is a, c, g, or t
  modified_base (169)..(169): a, c, t, g, unknown or other
  misc_feature (169)..(169): n is a, c, g, or t
  modified_base (201)..(201): a, c, t, g, unknown or other
  misc_feature (201)..(201): n is a, c, g, or t
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (426)..(426): a, c, t, g, unknown or other
  misc_feature (426)..(426): n is a, c, g, or t
tcagacgcgatcgacacgaccggtgctcgatttagcacacgatagttggggtttggggaggaactgctcagttaggacccagagggaaccatggaagccccagctcagcttctcttcctcctgctactctggctccagagacctccgganaattgtcttgacacattcnccagcctattctgtctctctctacgagggganacacgcctacctctcatgcgagggcctagtcagagtattagaanatacgttggctaggtanacaatacgaacgccgtaggccgacggtccccggctcctctatacctaatggactcgtccttaccggaagccggaacgggtaccctaagcgggaccaacgttccccgaaggtaccgtacggtttacgagggtcggggtccggtttagggtttcggacacggtaanacctttccgacttactacaacatacacgacacgtccctaaccgtaactagtaacgttacgtttcgacgttaacgtactttaacttacgtagtaccgaaactccgggtaacgtaacgtaagttacggttaccgaccgttacgtacgttaccgggtttacgggacggtaaacggggtacgaaacggggttaggaagtaaacccgtaaacggttaaacggaccgttagggacgtaaccgtcgaacgtaacctacggttccttgtttaacccg

SEQ ID NO: 240315 - DNA, 750 bp, Homo sapiens
  misc_feature: GYAE6OF01DKFVW.45.35.D02.1.454.CMB.1.raw
tcagacgcgatcgacacgaccggtgctcgatttagcacacgatagttgggtttggggaggaactgctcagttaggacccagagggaaccatggaagccccagctcagcttctcttcctcctgctactctggctccagacgacctcggagtaattgtcttgactacacgtctcagcctagttctcgtctctcctcgtccgagggacacagccctacctctctagtcgcgacggccagtcgagtagtataagaactagtacgtgccgttagtactacgaacgtacgaacgtccgtcggaccgtacgggtccccgctacccgtcgtatctaagtgacgtcgtactccgaggcacgggcctagtcgacctacgtaccgtacgtaccgtaggttccgaagggtcgggtcgggttacggttacggaccgaacgtcgtaccgttccaccgttacctactaaacggtacttacggaaccgtacccgtaccggtaacccctaccgtaaacgtttacggtaacgtttacgtttaccgtacgtaacgtttaccttacgttaacccgttacgttaacccgtaaaggttaccgtaacggtaaacgttcggttaccgtaccggggttaccttaccggttacgtttaacccgggttccggggtaaacggtccgggttaaaaccgtagggggtaccgaaggtaaccgtaacccggaaagtttacgggcggacgttacgacctaacgacttacgtcttacggttacc

SEQ ID NO: 240316 - DNA, 771 bp, Homo sapiens
  misc_feature: GYAE6OF01A7UIM.45.35.D02.1.454.CMB.1.raw
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctcctctccgaggggacacacgcccaccctctcatcgacgagggccagtcagtagtattaacgaactatacgttggccttaggtaactacgtaaataaccgaacggtcccgtacgggacccgtaaccgggggttccccccggtcctttccccgtacctaacgttaccgtaacgttacgggtaacttccggtcccgtttacccgaacggtacccgggaaccggggtacccctaacggttacggacccgtaaccgtacccccgaaccggtaccgtaacgggttttaccgacggggttcggggtaccgggggtttggggttttacccggaaccgtaaccgtaacgggttaccttacccgaacgttaccgtaccaacgtaactaccgacgacccgtaccgtacccctaccgaaaccgttacggaatttacgtttcgaccttagttacttaacgttactcgtaaccaacgtacgtacgtaacagtacgtcggacctcttacctcggtcggacggtacggacgacggtaggactaacgtaacgtaaacggtcgtggtacgtacgtacgcctaacgactttcccgtgttaccg

SEQ ID NO: 240317 - DNA, 798 bp, Homo sapiens
  misc_feature: GYAE6OF01BB5KV.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctcggcctcccagacgaccgtccggaagtaaattgtcttgacactacgtcctccacgtcctattcttcgtcctccttcctccgtccggaggggacacacgccctaccctctcacgtcgccgtacgggacctagtacgagtaagttaactaacgaactattacgttcggccgtagtactacaatacgacgccgtcggaccgtaccgggtccccgtccttacctacgtacttcgtaacgttcgacgttccgtaccttaccggacggaccgggacggaccgtacgtacgtccctacccgtcccgaacgtccggttaggtacggtacggggttcgggggttacgggttcgggttaccggacgtaaccgtcgttacccttaccgtacctaccgtaactacgtaacctacgaccgtaacccgtaccccgacccttaaccccgtaaacgtagggttaacctttaagttttcggaacctttaacggtttactttaacgttcccgtaagtaactaacccggtaggttaacccgtacggtaacgttaaccgggttcccgtaccgtttccgtacggtttacccgggtagggaccgggtaacggtaccggtaggtaacggagtaaccggtaacgtaacggtcgtggacgtaccgtccacgaaccttcgtccgttcgttcccg

SEQ ID NO: 240318 - DNA, 661 bp, Homo sapiens
  misc_feature: GYAE6OF01EH4VZ.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagcccaccctctcatcgcgacgggccagtcaagagtattaagaacatacgttgcctaggtatacaatacaacgccgtggccgacgggtccccgctcctctactctagtgtactcgtccttccagcgacggccacgtcggcctactcccacgtccgtacggttcgagggtcggggtcggggttgggtttcggaccgtacgacgtaccttcgtacgtctacaactactcgacgccacgtccctaccaacgtagtaacgttacgtttacgacgttaacgtttactacgtttaccgtacgtacgtaacgtaccgtaccgtaacgacgttacggtccggtacccgtccgttacgtaccggtttccggggaacgggaacgggtaaccgaaagggtcggaacgtaacgtaaccggaaacggtcgtagggtcgtacgtacgacccactaacgttccgtagttcccg

SEQ ID NO: 240319 - DNA, 900 bp, Homo sapiens
  misc_feature: GYAE6OF01B2QNY.45.35.D02.1.454.CMB.1.raw
tcagacgcgatcgacacgaccggtgctcgatttagcacacgatagttgggtttggggaggaactgctcagttaggacccagagggaaccatggaagcccagctcagcttctcttcctcctgctactctggctccagactaccaaccggaaaattgtgtagacacagtctcgacggcacctgtctctcgtcctcggagggacgacgacgcctaccctctccgtcgcgacggaccgaggtacggtaggtacgtacgtacggttaaagtacgttacggtacgtacggttaaccaacgtaaacggtaaaccggtcggaccgtacggtaccctaccggacggtcctacctaccgtacgtacccgtaagtcgtacgtcgaccacgttacccgaacggtaccggtcccgtacggtaccggtaccgaacggtaccggttacgggttaccggtcggacggtacgggttcggggtaccgggtaggaacgtacgggttaacgttccgtaccgtccgtttacgacccggtacgaaccggcggtaaccggcggttacgggaccgtacgtacggttacgttacgttacggtttacgttacggtttaacgttttcggttaccgttacggtaccgtacggtacggtaccggtttacccgtcccggtaccgtccggttaccgtccggttacccgggttaccggggttacccgggggtcggggggtaaccggggtacggggttaacgggtaacgggttacgggtaaaccgggtaacgggtaaaccgggtacggttaccggggtaccgtacgggtttaccggaccgtttaccgggtacccgtttaacggtttccccggtttaaccgtttacccggttaaacccgttttccccgggtaaaccccttcggtttaacccggg

SEQ ID NO: 240320 - DNA, 844 bp, Homo sapiens
  misc_feature: GYAE6OF01D5Y6W.45.35.D02.1.454.CMB.1.raw
  modified_base (205)..(205): a, c, t, g, unknown or other
  misc_feature (205)..(205): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggactccagacgacctccggaagtaaattgtcttgacacagtctccagcctattctcgtctctctctacgaggganacacgccctacctctacacgtcgcgtacggactacgtacaaggtagttaactaagaactacgttaaccggtttcggtaccgttacggttaactaaccaaacgttaacgtaaaccggtccggtacggtacccggtaacccggggtcccccggtaccttcccgtactacgttccgtaagtacgtacgttcgtaccgtttccgaggtaccgacgggtacctacggtcgtacctaccgtacccgacggtaccgtacggtccggtagggtcgggttcgggttcggtacgaccgtaacgtacgtaccgtcctacggtacccttaagactaacgtacggtaacgacccttaaccggaaccccttaaccgttaaaccgtacggttaaacggtttacgtttaccgtacgttaaccggtttaactttacgtttacgtaaccgtaaacgtaaccgttaacgggtacgttaaaccgtaacgttacggtcccggttacccgttacgttaccggttaaccgggttccggggaaccgggtaaacgggtaccgggtaacggtaccggtaaagtaaccggtaaacccgttaagggaccgttacgggtaccgtacgttacccgtaactacccgttacgttacgtttccgttaacccg

SEQ ID NO: 240321 - DNA, 812 bp, Homo sapiens
  misc_feature: GYAE6OF01BI9IK.45.35.D02.1.454.CMB.1.raw
  modified_base (208)..(208): a, c, t, g, unknown or other
  misc_feature (208)..(208): n is a, c, g, or t
  modified_base (792)..(792): a, c, t, g, unknown or other
  misc_feature (792)..(792): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctcccagacgacctccggagaaattgtcttgacacagtctccagcctattctgtctctctctccgagggacgacncgcccaccctctcagtcgacgacgggtaccagtacgaagtaacgttataacgaactacgtttacgtggaccgttagttaactacaacgtaacgaacgtcccgtacgggacccgtaccggggtcccccgaccttaccctacgacttacgtaagtcgtaacttcgtaccgttaccgagaccggacgggtcctacggtccgacctaccgtacccgacggtacccgtaggttcctaagggggtccggggttcgggttacgggtttccggaacctaccggtaaccggttacccttccggaccttaccacctaacgtaaccgcgacgtaccctaaccgggtccccctaaaccgtaacgtaacgtaacggttttacttccggaaaccttagttaaccgttaacctttacgtaccggtaacttaacgtacggtacgtttaccggaagttaccccggttcggaccctttccgtacggttaacccgggtacggggaacgggaaccgggttaaccggagggttaacggtaacggtaaccgttaaaccccgggtaaggtacggttacggtacggtaacccgacgtacccgttaacncgtttccgtacctttacccg

SEQ ID NO: 240322 - DNA, 619 bp, Homo sapiens
  misc_feature: GYAE6OF01AL7IY.45.35.D02.1.454.CMB.1.raw
  modified_base (201)..(201): a, c, t, g, unknown or other
  misc_feature (201)..(201): n is a, c, g, or t
  modified_base (246)..(246): a, c, t, g, unknown or other
  misc_feature (246)..(246): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactcgtggctcccagacgacctccggagaattgtcttgacacagtctccagccattctgtctctctctccaggganacagccacctctcatgcacgggccagtcagtacgtattagaactntacgttggccttggtatcaattacgaagcctggacctacgggtccccgctccgtacactctatcgacttgcttccaggtccgacgggtccacgtggacctacttcccagtcccaggtttccaggttcgggacggttggggtttcgcgtaacacggtacctttcgaacttcgactacaattccgagctacgcctaccaaccgttcgaacgtattttcgctacgttcttacttacgtcgtacaacgtacgtacgtaacagtacgtcggtactccgtctaccgttcggacggtacggaccgtaagggtggaacgtacgtacgaaaccggtacgtacggtcgacgttacgaccttaaccgtacttccgtcgttaccg

SEQ ID NO: 240323 - DNA, 654 bp, Homo sapiens
  misc_feature: GYAE6OF01BG3YI.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgaggganacacgccaccctctcatgcacggccagtcagtagtatagaactatacttggccttggtatacaatacagccgtggccgacgggtcccgcctcctctatctatgatcgtcttaccagcgtacgggacctacgtcggcacctccgacgtccgtaggttcgacggtcgggtcgggttgggttcggacacgtagtaccttcgacctctacaactactcgacgcacgtccctacccgaacgtacgtaagttacgtttcgacttaacgttcttaaactttacgtacgtaaccgtaacgtaacgtaccggtaacaacggttacgtccgggtccgtaccttaccgttaccggttaccgggacgggaacggggtaaccgtaaggggtagtaaacggtacgtaaacggaaacggttaccgtgggtacgacccgtcgacccgtaacttacgtcgttcgttaaccg

SEQ ID NO: 240324 - DNA, 836 bp, Homo sapiens
  misc_feature: GYAE6OF01BVDT5.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctccagataccaaccggaaaaattgtgttgacacagtctccaggccacctgtctctgtcctccgaggggacacacgcccaccctctccgtcgcgacgggaccaggtacggagtacgtacgtaagttaagttacgttaggtacgtacggtaacccaacgtaacgaaaccgttcggaccgacggccctacccgaggtcccttccgtacgactccgatcgatcgactactaccgtaaccggtacgggttccccgaggtcccgtaacccgaggtaccgtaccgggttccgtacggtcggtacggtcggggttcgtacggggacctaaggtcgttacctacgttccgtacccggtaacgtacgaacgtccgaccggtaccggtgggtaacctcccggttaggtaacgtttcgttttacgtttacggtacttttaaacggttttccttacggttaccgtacgtaacgtccggtaccggttcccgtaccccggcccgtacccggtcccggttaccgttccgggttaacccgggggtttcccgggggaacccggggggttaggtaacggggttcgggtaacgtacgggtaacgggtaacgggttacccgtaaggtttcggggtacgtacccggttagacccgtaaaccttcggtttcccgttacggttcccttaccgttacccgttttcccccgtccccgtaagtttacccg

SEQ ID NO: 240325 - DNA, 726 bp, Homo sapiens
  misc_feature: GYAE6OF01DTLW7.45.35.D02.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (712)..(712): a, c, t, g, unknown or other
  misc_feature (712)..(712): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctcccagagacctcggagtaaattgtcttgacacagtctccagcctattctgtctctctctcgagggacacncgcccacctcncatcgccgacggcctagtacgaagtacgttaagtaacgaaactacgttacgttcggtccgtttaggtaactacctaaacgttaacgaaccggtcccgtacgggacccgtacccggggtcccccgccgttacccctacgtacgttacgtagtacgttacgtcgtccgttaccgacggtacggacggaccctacggtacggacctaccgtacccgacggtaccggtacggttcggtaacggggttcgggtcggggttaagggtttccggaacgtaacgtacggtcccttacgaccttcaaactacgaatccgtacgaaccgtcccgtaacctaacccgtaagttaaggtacttacgtttcgacgtttaacgttacttaacgtttaactcgtaaaccgacgttaaccgtcgtaacgtagttccgtacgggtccctacgttacgttaccggtgggaacggtaccggaaggtacgtaggactacgtaagactgtgagtcanccatcgttgtctcg

SEQ ID NO: 240326 - DNA, 809 bp, Homo sapiens
  misc_feature: GYAE6OF01AYAZJ.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctccagacgacctccggagaaattgtcttgacacagtctccagccattctgtctctctctccgagggagacacgcccacctctacatcgcgacgggccagtcagtacgtataacgaactagttacgttcggtccgttggtaatactaaacgttaaccgaaacgtcccgtacggaccggtaccggggtccccccggtcctccccttactacgttaccttacgtcgtaacgttcggtacccttacccggacggaccggtacggggaccccgtacggtcgggacctaaccgttccccgaaccggtacccggtaacgggtttaccggaacggggttacgggggttccggggtttacggggggtttaccgggccgtaaccggttaacgttacccgtttacccgtaacccgttacctaaccgtaacctaaacgtcgaaccgtaccgaccgtacccctaacccgtaaaccttaggtaacgtttaacgtttcgaacttacgttaactttaacgttacgttacgtacaactaccggttacgtacgtaagggtccgttccggccgtttacgtacgttaccggggtttcgggaaccggggtagggacccgtaggggtaggaaccgttaacgtaaccggaacggtacgtcgggtacgccgtacgacctaccgtagttccgttcttaccg

SEQ ID NO: 240327 - DNA, 881 bp, Homo sapiens
  misc_feature: GYAE6OF01BME0X.45.35.D02.1.454.CMB.1.raw
tcagacgcgatcgacacgaccggtgctcgatttagcacacgatagttgggtttgggggaggaactgctcagttaggacccagagggaaccatggaacgccccagctcagcttctcttcctcctgcctactcgtcggcctcccgaagacgtaccctacggaagtaactttggtccttaggacctacgacgttcctccgacgcccttatttcctggttcctaccgttcctcgtaccggaagggacctacgccgaccctacctcgtacacgtcggacgacgggtcctagtacgaagtaagttactaagacgtacgttacgtcggaccttaggtaactactaacgttaccgaccgttaccggcggtaccgtacgggttcctccggtaccttcctaacgtaccgtattaacggttcgtacggttacctcccggttaccggacggtacggtaccccggtactaccgggtaccggtcctaacccgggtcccgtaaacggggtccggttaaaccggtttaggggccgggggtttccgggttaaccgggggtttggtaacccggtaccctaacgggtacgttacccgttaccgtaacctttccgaaactaaccgttactacgaccgttacccacgtaccctaacgtaacgtacgtaactttaggtacctacgtacgtttactacgtttaccgtaacgaacccgtacgtacggtaacctacggttacggtacccgtcccggttactaaccccggtttaggtccgggtaccgggtacgggtaaaccggtacgggtaacgggtaaacgaacctttacccggggaaacttaccggtacgggttcgttacccggaccgtttaaccgaccgttaaccgtttgttcccccgttaagg

SEQ ID NO: 240328 - DNA, 780 bp, Homo sapiens
  misc_feature: GYAE6OF01AMOS7.45.35.D02.1.454.CMB.1.raw
  modified_base (740)..(740): a, c, t, g, unknown or other
  misc_feature (740)..(740): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagataccaaccggaaaattgtgttgacacagtctccaggccaccctgtctctgtcctaccgaggggacgacacgccctaccctctcctgcgacggcaggtaggtagtcgtacgtaagtaacgtacgttacggcgtacggtaaccaaacgaacggtaaccgtcggaccgaccggtacccgtaccgacggtccctaccgtacctacgtaccagtacgtacgtacgacctaactaacccggtaaccggtaccgggtaccccgtcggtaccccgtaccgtaacggtaccggtacgggttccggcgtacggtacggtcgggtcgtacgggacgtacggtacgtaccgtacgtcccgtacgtaccgtacgacgtacgacggtccggtacgggtacctccgttaggtacgtttacggttacgtttaccggtacttttaacggtttccgttcgtacgtaccgtaccgttaccgggtaccgttcccccgtaaccggtaccctcccggtccgttaccgttccgggtacccgggggtaccggggggtacgggtaccgtaggggtacacggtacgtacgggaacgtacggtccgtagggtccgcgtaccacggttcncggttaccttcgtacttacccacgtttcccgtcgtcgtcg

SEQ ID NO: 240329 - DNA, 593 bp, Homo sapiens
  misc_feature: GYAE6OF01A3MG7.45.35.D02.1.454.CMB.1.raw
  modified_base (201)..(201): a, c, t, g, unknown or other
  misc_feature (201)..(201): n is a, c, g, or t
  modified_base (363)..(363): a, c, t, g, unknown or other
  misc_feature (363)..(363): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaactatacttggcctggtatcaatacaagcctggccgacgggtccccgctcctcatctatgatcgcttccagcgagggccagtggccatcccagccgaggttcaggtggcggttggttgcaacgngtacttcgactctacgaacatcacgcacgtcctaccaacgtagaagttctttagactagttacttattacgtagtacaacgagtacgtaacgtagtacgttcggcccgtacttaccgtacgttccgggacgggtaacgggtacgtaacgggtaggtaacgtaacgtaacgaaaccggtacgtacggtacggccgtacggtacctaaccgtacgttccgttcggttacccg

SEQ ID NO: 240330 - DNA, 773 bp, Homo sapiens
  misc_feature: GYAE6OF01AZMIV.45.35.D02.1.454.CMB.1.raw
  modified_base (355)..(355): a, c, t, g, unknown or other
  misc_feature (355)..(355): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggaagaaattgtcttgacacagtctccagccattctgtctctctctccgaggggacacacgcccaccctctcatgcgagggccagtcagtagtattaagaactatacgttggcctggtatacaatacacgtccgtcggacccgacgggtcccccggctcctctactctatgtatcgtcttccgacggcgacgggcctacgtcggaccncgtacccgaggtccgtacggttcgtacgggtcggggtcgggttcggggttacgacgtacgtaacggttcctaccgtactccgtaactaaccgtaacgtacaacggtaccctaccggtaccccctaacccgtaaacccgttacgggtaaacgttttatttaccggactttaacggttactttaacgtttaccttacggtaacctaacgtaaccggtaccgtaacgttaacgggttacgttaccgggtacccttacggtttaccgttaccgggttaccgggaaccggggttaaaccgggaacgggtaaacgggtaccgggtaaacgtaaaccggttaaacccggtaaaaccggtcggttaacgggtaccggttacccgtaacggaaccctaaccggttacgtttcttcccggtttacccg

SEQ ID NO: 240331 - DNA, 682 bp, Homo sapiens
  misc_feature: GYAE6OF01C6VZ2.45.35.D02.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
tcagacgcgatcgacacgaccggtgctcgatttagcacacgatagttggggtttggggaggaactgctcagttaggacccagagggaaccatggaagccccagctcagcttctcttcctcctgctactctggctccagagacctcggaagaaattgtcttgacacagtctccagccattctgtctctctctccgagggganacacgcccaccctntcatgccagggtccagtacagtagttaattaaggaacctatacgttacgggccttaggtactacaataacgaacgccgtggccacggggtccccgtacctctactatctaatcgatcgtccttacgacgtcgaacgggcctacgtacggcctaacgtaccccgagtacccgtaggttaccgagggttggggtcggttggggtttacggacgtaacgaaggttacctttacgaccttactaccgaactacgtacaacgtaccaccgtacctaaccctaacgtacggtaaagtacgtttagaccttacgttacttacgtacttacgacgtaacacgtacgttaagtacgttaacgtcggtaccgacttacccgttacggtccgggtacggaacgggtaaccgagggtagacgtaacaaaggttaaaccgagcggtagacgtcgtaaccgacctaactcgttacgttacc

SEQ ID NO: 240332 - DNA, 820 bp, Homo sapiens
  misc_feature: GYAE6OF01DOHB7.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctccagacgaccgtccggagtaattgtcttgacacagtctccagcctattctgtactctctctcgagggacacacgcccacctctacatcgcgacggaccagtacgagtaacgtataagaaactacgttacgttcggaccgtacgtaactaactaacgtaacgaaccgtccggtaccggtacccggtacccgggtcccccgtccgtaccctacgttacgttacgttacgtacgtacgtccgtaccgtaccgtacggtaccggaccggtaccgtacgtaccgtaccgtacccgtacccgtaccggtaccggtacggttacggtacgggttcggggttacgggttcgggttacggtaccgtaacgtaccgtaccgttaccgtaccgttaccgtaaccgtaaccccgtaacgtaccgtaaccgtacccgtaacccgtacccgtaaccgtaaccgttaacgttaacgtttacgtttaccgtacgttaccgttaccgttaacgttacgtacgtaaccgtaacggtacgtacgttaacgtacggttaccggtacccgtaccgttaccgttaccggttaccgggtaccgggaacgggtaacggtaacgggtacgggtaacggtaacggtaaccgtaaacgtaacggtacgtacggtacgtaccgtacgtaccgtaccgttacttcgttccgtacg

SEQ ID NO: 240333 - DNA, 706 bp, Homo sapiens
  misc_feature: GYAE6OF01B370S.45.35.D02.1.454.CMB.1.raw
  modified_base (314)..(314): a, c, t, g, unknown or other
  misc_feature (314)..(314): n is a, c, g, or t
  modified_base (548)..(548): a, c, t, g, unknown or other
  misc_feature (548)..(548): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctcccgagacgacctcggaagaaattgtcttgacacagtctcagcctattctgtcctctctctaccggaggggacacgacgccaccctctcagtcgcgagggccagtcgaagtagttaataacgaactattacgtggcctagtactacaatacagcgtcggccgtacgggtccccgctccncgtaactctatcgtactcgtccttacgaggccgtaacgggccctagtccggtacacccgtaccgacggtaccggtaggttacgtacggggttggggtaccggggttttcggggtacgaccgaaggtacgttaaccgttacctacgttaccctaacaaaccgtaacgtacgacgtaaccgtaccgtaccccctaaacgtacctaaagggttaactacgtttagacttaaccgttntttaaccttacgtacgtaaaccgagttaaccgacgttaacaaggttctaccgggtaccctacttcggttaccggtacggacgggtaaacgtaaccggagggttacgaagtacgaaaccgtaagcgtcggtagccgtacacgtactatccggtattccg

SEQ ID NO: 240334 - DNA, 673 bp, Homo sapiens
  misc_feature: GYAE6OF01CC3AN.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagtccacctctcatgcaggccagtcagagtatagaacatacttggcctggtatcaatacgaagtccgtggccgaacgggtccccggctccgtcatcctatgactgccttccagtcgacgggcctacgtcggcacgtcccagacctaggttcaggtgggtcggttgggtttcgcgtaagacgtactcgactcgtacactaatactagacgacgtccctaccaaaccgttagtaacgtaacgttttacgacctaaggttacttaacttacgttacgtaaccgtaacgtacggtaccgttaaccgaacgttacgtttaaccgggcccgttaccgttaccgttacccggtttaccgggacccgggtaacggggtaacccgaaagggttacggaaacggtaacgtaaccggaaaacgtaaaccggtcggtacggtaccgtacggaccgtaacccgtagttccgtagtttaacccg

SEQ ID NO: 240335 - DNA, 976 bp, Homo sapiens
  misc_feature: GYAE6OF01DMQZ9.45.35.D02.1.454.CMB.1.raw
  modified_base (129)..(129): a, c, t, g, unknown or other
  misc_feature (129)..(129): n is a, c, g, or t
  modified_base (419)..(419): a, c, t, g, unknown or other
  misc_feature (419)..(419): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactcncggtcctcccagactacccgaaccggtaaaaattcgtgttacgaccacacggtctaccgaggccacccgtcgtctcgtcgttaccgtccggaaggggacgaccgaccgccctaccccttccgtaccgtcggaccgtacggggaccgaagggtaggtacgttacggtacgtaaaggttaaacgttaacgtttagggccgttaacgggttaaacccaaacgtaaaccggtaaaaccgttcgggacccgtaacggtccccgtaccgtacggtccctccgtacactccagttanacgtacacactaccgacggtaccggtacctcggtccgtaccgacgtaccgtgggttcccggtggacgttcgggtacggtcggtacggaacgttacgtcgtttacgaaccgtaccgtccccgtaacggtccgaaggtccccgtaaacgggtcccctaaggggtacccggttacccgtacgggttaaaggttttcgttacggtttttacggtaccgtttttaaaccgggttttaccttttaacccgggtcgtttaaccgtaccgggtttaccgttaaaccccgggtttcccgggttacccccgtaaaccccgggttcccggttacccccgttaccggttaccccgggtttaccggggtttaccccggggggggtaacccggggtaaccggggttaacggggttaccgggtaacggtaccgggtaaccgggttaaaccgggtacgggtaaaccggtacgggttacgggtccgtaccgtacccgttaaacttccggtttaaccgttccggtttaaccttcccgtaacccgttttcccccggtaaccgttcccggtacccgg

SEQ ID NO: 240336 - DNA, 779 bp, Homo sapiens
  misc_feature: GYAE6OF01ACFRK.45.35.D02.1.454.CMB.1.raw
tcagacgcgatcgacacgaccggtgctcgatttagcacacgatagttgggtttgggggaggaactgctcagttaggacccagagggaaccatcggaagccccgagctcagcttctcttcctcctgctactctggctccgagacgacctcggataaacttgtcttgacacagtctcagccattctgtctctctctccgaggggacacgacgccctaccgtctacactcggccgacggggccagtcgaaggtaacgttaattaacgaactagttacgttcggaccttagggttaacactaaacgttaccgaacgtcccggttacggccgtaccggggtcccccgtactccgtactaacttacgttacgtacgtacgttacgtccgttacggacgtaccggacggcctacggcggtaccgtaccgttcccgacggttaccgtacgggttacgtacgggggtcggggttcgggttacgggtttacggacctaacggtacgtaccttacgtaccgtactacgtaacgtaacgtccgacgtacgtacccgtacccttaacgtaacgtaaggttaacttcgttacgaccgttacttacgttaactcgtaaccgtacgtaacgtcgtaacgtacgtaacggtacggttacgtacccgttacgttaccggttaccgggtacgggaaccgggtaacggtaccggtaaacgggtacggtaacgttaccgaaacgtaacggtacggtccgtacggttactacggtaccaccgtttagttccgttacgtccg

SEQ ID NO: 240337 - DNA, 911 bp, Homo sapiens
  misc_feature: GYAE6OF01DDWJT.45.35.D02.1.454.CMB.1.raw
  modified_base (501)..(501): a, c, t, g, unknown or other
  misc_feature (501)..(501): n is a, c, g, or t
tcagacgcgatcgacacgaccggtgctcgatttagcacacgatagttgggttggggaggaactgctcagttaggacccagagggaaccatggaagccccagctcagcttctcttcctcctgcctactctggctccagacgacctcggaagtaattgtcttgacacagtctccagcctattctgtctctcctcgtaccgaggggacacacgccctacccgtctcatcgacgacggcctagtcgaagtacgtaacttaacggaactacgttacgttccggacgttaggttaataccgaaacgtaaacgtaacgcccggtcggaccggtaccgggttcccccgtactcccgtacttaccgttcgtaacgttcgacgttcgtaccttacgaacggtccggtaccgggcctacgtcggacaccgtcccgagtccggtacgttcgtacgggtcggtacgggttcggtcgacgtacgaacgtccttacgcttaccactaacgctaacncgtacgtaccgtaccgtaccgtaaccggttagtaacgtttacgttaccgtacgtttacggttaaacctttacgtaaccgtttaacgtaaccggtaaacgtttaccgggttaaacgttaaccggttaacccgggttaacggtttacccccgggttacccgttaacccggtttaaccgggttttaaaccccgggggttccgggtaaaacccggggggtaaacccggttaccgggggtaaaaccggggggttaccgtaaaacccgggttaacccgttaaaacccggggttaaaaacccggttggggttaacccgggggttaaaaccccggtccccggttaaaaaccggttaaacccccggtaacccgggttttaaccggttcccccggttttaaaggttttaaccccccccgg

SEQ ID NO: 240338 - DNA, 887 bp, Homo sapiens
  misc_feature: GYAE6OF01AQHCS.45.35.D02.1.454.CMB.1.raw
  modified_base (220)..(220): a, c, t, g, unknown or other
  misc_feature (220)..(220): n is a, c, g, or t
tcagacgcgatcgacacgaccggtgctcgatttagcacacgatagttgggtttgggggaggaactgctcagttaggacccagagggaaccatggaacgccccagctcagcttctcttcctcctgctactctggctcccagagaccgtccggagaaattgtcttgacacgagtcctccagcctattctgtctctctctcgagggacgacacgcccacctcncatgacgacggcagtcaagtagtagttaacgaactagttaccgttcggtaccgttaggttaactactaaaacgttaaccaaccggtacccgtaccggggtacccgtaaccggggtttccccccggaccttccccttaccgtaacgttacctaacgtacggaacgttcggtacccgttccgaacgggacggtaaccggaccgtacgtaccggacctaccgtacccggtacgtaccgtttaacgggttaccgtacggggttacggggttcggggtttcggggtttacggtaaccgtaacgtaaccggtttaaccgttttccgaaaccctttacccgtactaaaccgtaaaccgtctaacggtacccgtacccgtaccccgtaaacccgtaaacgttacggtaaacgttttccgttttacggaacgttaccgtttaaccgttaacgtttactaaccggtactaaaccggacgttaaccggttaaggaaacggttaccggttacccgggtacctaccgtttaaccggttaaccggggttaccgggaaccggggtaaaccgggggtaactaacggggtaaacggaaccgttaaaccggtaaaccgtaaacgggtacgttccgggtaacgtagtaacccggtaacgtaacccttgttccgttacggtttaccg

SEQ ID NO: 240339 - DNA, 885 bp, Homo sapiens
  misc_feature: GYAE6OF01D8BES.45.35.D02.1.454.CMB.1.raw
  modified_base (221)..(221): a, c, t, g, unknown or other
  misc_feature (221)..(221): n is a, c, g, or t
  modified_base (413)..(413): a, c, t, g, unknown or other
  misc_feature (413)..(413): n is a, c, g, or t
tcagacgcgatcgacacgaccggtgctcgatttagcacacgatagttgggtttgggggaggaactgctcagttaggacccagacggaaccatggaagccccagcgcagcttctcttcctcctgcttactctcggcctacccaagaaaccagttggaagtaaattactgatacgacgctacgttcacgccctaccttggtcttgtcgtctacgaaggggaanacgccctacctctctagcgtacgggccagtcgagtacgtttagtaacgacctaaccgactttcggccttaacggtaaccaggacctaacggtaaacccgcggaccgaccggccttaacccgacgtcccttacttagtattttacgttccggttcttaaccggtaccggagggtcctcggttaacgttacccnccgtacggaccgtttacggtacgtacggtcgtaccggtacggggttccggtacggtaaggtaaccgtacggtaacttttcccaaccgtttccgaccgtaacctacgttacccggaacgttaccgggacctttccgggtaacgtaccggtaaaccggtttcgttaaacgttaccgggttttacggttttacggttaccgttttaagtttttaccggttttaccttaccgggttacgtaaccggtaactttacgggtactttaacgttaaccggtaagggtaccggttaccggtttaacgggttacgtttaacgggtttaccggtaaccggggtaaccgggtaaccgtaacggttcggtaaacgtaaaacggtaccgtaaacggttacggtaccggtaccggtacgttcgaaccttaccggtaacttacgtttacccggttaacttttcccggtaaccccgttcgttaccccgg

SEQ ID NO: 240340 - DNA, 652 bp, Homo sapiens
  misc_feature: GYAE6OF01AGW52.45.35.D02.1.454.CMB.1.raw
  modified_base (207)..(207): a, c, t, g, unknown or other
  misc_feature (207)..(207): n is a, c, g, or t
  modified_base (640)..(640): a, c, t, g, unknown or other
  misc_feature (640)..(640): n is a, c, g, or t
  modified_base (644)..(644): a, c, t, g, unknown or other
  misc_feature (644)..(644): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctcccagagacctccggagtaaattgtcttgacacagtctccacgccattctgtctctctctcgaggggacacncgcctaccctctacatcggccgagggcccagtacagtaacgtaattaacgaactacttacgttcggcctaggttactacgaaatacaagtcctcggaccgacgggtccccgctcctcactctagtgatcgcttccgagcgacggccacgtcggacctcgacccgcgaccgtaggttcgacgggttcggtcgggttgggtttacgacgtaacgtacgttaacctcgtaccttaccaccgtaactactacgaacgcctaccgggaccctttacccgaaacgttacggttaacgtttacgtttacgaaccgtttacgttaacttacgttactacggtactacgtacgacgttacagtacgtcgtccacgtacgtacgttcggagtaccggagtacggtagacgtacgacgtaacgtctcggactcgtacacgtacncttntccgttac

SEQ ID NO: 240341 - DNA, 949 bp, Homo sapiens
  misc_feature: GYAE6OF01CAN4P.45.35.D02.1.454.CMB.1.raw
  modified_base (206)..(206): a, c, t, g, unknown or other
  misc_feature (206)..(206): n is a, c, g, or t
tcagacgcgatcgacacgaccggtgctcgatttagcacacgatagttgggtttgggggaggaactgctcagttaggacccagagggaaccatggaagcccccagctcagcttctcttcctcctgctactctggcctcccagagaccctccggagaaattgtcttgacacagtctccagcctattctgtctctctctccgagggganacacgcccaccctctacatcgaccgacgggaccctagtaccgaaggtacgttaatttaacggaaacctaatttaccgttccggtaccgttaggttaacttaccgaaaattaacccgtaaacggtcccggttccgggacccggtacccgggggttccccccggtccttccccgttaccacgtttaccgttagtacgtacgttccggttcccttacccggacggaccggaccggggaccctaacggttcgggtaccctaccgttaccccgacggtacccggtacgggtttacggtaacgggttcggggttacgggggttttcgggtttaggaacccgtaccgtaacggtttcccgttaccgtacctttcccgtaaccctaacgttaaccgtaccaaccggtaccctacggtacccccctaaaccgtaacccggttaacgttaacgtttacgttttaccggacgtttaaccgtttaacttaccgtttaaccgttccgtaaacctaaccgtaacggtaccgtaaacgtaaggttaaccgttcccggggtaccccgttccgttttaaccgggtaccggggtttacccgggaaggggttaaccccggggaacgggttaaagggggttacggaaaacccggttaccggttaaaaccgggaaaccggttaacgggttaccgggttacgggtacccccttaacgggaaccccgttaaccgttcggtttaacccgtttccgttttacccccgg

SEQ ID NO: 240342 - DNA, 702 bp, Homo sapiens
  misc_feature: GYAE6OF01DEDPA.45.35.D02.1.454.CMB.1.raw
  modified_base (650)..(650): a, c, t, g, unknown or other
  misc_feature (650)..(650): n is a, c, g, or t
tcagacgcgatcgacacgaccggtgctcgatttagcacacgatagttgggtttgggggaggaactgctcagttaggaccagagggaaccatggaagccccagctcagcttctcttcctcctgcctactctggctcccagagacctccggagtaattgtcttgacacagtctcagccattctgtctctctctacgagggacgacacgcccaccctctcatcgcgagggccagtcaggagtaagttaagactatacgttggccttaggtatactaaacgtaacacgtaccgtacgggccctaccggggtcccccggtctccctactacttacctaagtgaacttgccgttccaggcgacgggcctagtcgaccacctcccgacgccgtagggttccgaggttcggggtcgggttagggtttgacccgtagtaacgtcgtttcaaccgtctacccgaattcgaccgtaacgcgtacgtcctaacccaagtcgtaacgttattcgacgtgttaccttaagttactactaacctaacgacggtcttaacgacgtaacgttcccggaaccgtcgttaccgttaccggtttacggggaaccgggttaacgggaccgtaaagggttccgaaaggtaccctaaacggaaaccggtttanacgggttacaccggttacggaaccttaccggtaacttccgtacgtttacccg

SEQ ID NO: 240343 - DNA, 840 bp, Homo sapiens
  misc_feature: GYAE6OF01CP1ZI.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagtaaattgcttgacacagtctccagccattctgtctctctcgtccgaggggnacacgccaccctctcagtgcgacgggcctacgtcgaagtacgtaacgttaacgaacgtataccgttcggtacccgtagggttaactacgaaaactaaccgaaacggtcccgttacggggtacccgtaaccggggggttcccccccgacgtttacccccgtacgtacgttaccgttaacgtacggtacttaccggtcccgtttacccggaggtaccggaaccgggtccctaacggttcgggacctaacgtacccccgaaggcccgttaaggttaccgacgggttacggggtccggggtttagggtttcggaccgaacgtacgtacccgttactaaccgttcctaacctaacgaacttccgaacgtaccgtaccggtacccctaacccgtaacgtacggttaacttaacggttttcgaaccgttaacggtttaacttaaccgtttaccgttaacggtaaccttaaccgtacggttaaccgtaacgaacgggtttaaccgttccgggaccttaccgtacgttaccgggttacgggacgggaacgggttaaccggaggggtaacggaagtaacccgtaaaggaaaccggtacgttacgggacgtacgtacgtacctaaccgtaccgttcgttcggtttaccc

SEQ ID NO: 240344 - DNA, 727 bp, Homo sapiens
  misc_feature: GYAE6OF01CJM5S.45.35.D02.1.454.CMB.1.raw
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctcggagaaattgtcttgacacagtctccagccattctgtctctctctcgagggganacncgcccaccctntcatgcgacgggcagtcagtagtattagaactatacgttggcctgtactactaatacaagccgtcggccgtacgggtccccgctccgtcactctatgtatcgtctaccgagccggacgggtccctacgtcggaccctacgtaccccgacgtacccggttaggttaccggtacgggttcgggggttacgggggttggggttttacggaccgtaaccgttaccgttaccgttttacgtaacccgttccttaaccaacgtaaccgttacacggaccgtaccgtaaccccttaccctaaacgttacgttaaacggtttctttacggactttaacttactttaaccgttttaacgaccgttaaactaaccgacggttaccgtaacgaagttcggtacggacccttcgttacccttacgggtaccgggacggtaaccgggacggtaagggtacggtaacggtactaaccggaaacggtcgttcggtacgccgtccgaacgtaccgttctgttcccgttac

SEQ ID NO: 240345 - DNA, 721 bp, Homo sapiens
  misc_feature: GYAE6OF01AQS4A.45.35.D02.1.454.CMB.1.raw
  modified_base (204)..(204): a, c, t, g, unknown or other
  misc_feature (204)..(204): n is a, c, g, or t
  modified_base (250)..(250): a, c, t, g, unknown or other
  misc_feature (250)..(250): n is a, c, g, or t
tcagacgcgatcgacacgaccggtgctcgatttagcacacgatagttgggtttgggggagggaactgctcagttaggacccagagggaaccatggaagccccagctcagcttctcttcctcctgctactctggctcccagagacctccggagaaattgtcttgacacagtctccagcctattctgtctctctctccgagggganacagcccaccctctacatgcacgggcagtcagacgtatacgaactntacgtggacctaggtactaccgaaattaccgaagtccctcgggaccgtaaccggggtcccccggacttccctaccgattacctacttcggtactaccggtccttccgaagaccgtacggggtcccctaagtcggaacttaccgcccgacggtaccgtacggttacgacgggtacgggtcggggtttggttacgggccaacgtacggtacgttttcaaccgtttacgtaccgtaacgtactacgtacgtaccgacgtacccgtacctaacccgtaacgtaacgtacgtttacgtaccgtacgttacgttacttacgttacgtacgtaacgtaacgtacgtaacgtaacgtacggtaccgtaccgtcgttacgttaccgttacggtacggtacggacgtaacggtacggtacgtacgtacgtaacgtacgtcgtaaaaacggtcgtacgtacgtacgtacgtcgtcgttaccg

SEQ ID NO: 240346 - DNA, 836 bp, Homo sapiens
  misc_feature: GYAE6OF01BSY3J.45.35.D02.1.454.CMB.1.raw
tcagacgcgatcgacacgaccggtgctcgatttagcacacgatagttgggtttggggaggaactgctcagttaggacccagagggaaccatggaagccccagctcagcttctcttcctcctgctactctggctcccagagaccgtccggagtaaacttgtcttgactacagtctccagtcctattctgtctctctctcgagggcacacgcccaccgtctcgtatcgacgcgggcctaggtcaagtacgttattaacgaactacgttacgttcggccgttaggtactaaccgtaaacttaaccgaacggtcccgtacggtacccgaaccggggtcccccgacttcccgtacgtactcgtagcgtactcgtacgttcgacggtcgtacgggcctacgtggtacctacgtcccgacgtaccgtaggttccgacgggttagggtcgggttacgggttacgaccgtaacgacccgttacgtccgtaaccgtacgtaccaacttacgtccgaacgtacccgtaccgtaccccgttaaacccgtaagttaaccggtaagttaaccttttacggaccgtttaaacgtttacccttaaacgtttaccgtacgttaaccgtaaaccggtacgttaacgtaacgtaaccgttaccgggttacccggtaccccgttcgtttaacccggttccgggttaaaccccgggtaggggtacccgggttaaaccggtaggggtaaccgttaacgtaacccggttaaaccggtaaaaccggttacggttccggtaacggggttacccaccgggtaaccttaacccggttctttaaccccggtggtttaacccccg

SEQ ID NO: 240347 - DNA, 795 bp, Homo sapiens
  misc_feature: GYAE6OF01DB53Y.45.35.D02.1.454.CMB.1.raw
  modified_base (128)..(128): a, c, t, g, unknown or other
  misc_feature (128)..(128): n is a, c, g, or t
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctacnctggctcccagagacctccggagaaattgtcttgacacagtctccagccatttctgtctctactctccgagggganacncgcccaccctctcatgcgacgggccagtcagagttattaagaactatacgttcggccttagggttactactaaataaccgaaacggtcccgttacgggacccgtaacccgggggttccccccggtcttccccgtactactaccgtaattaggaacgttcgtccttaccgacggtccgacggggtaccctaacggtcggtaccgaccgttaccccgaaggtacccgttacgggtttaccgtagggttccggggtcgggggtttacgggtttacggaccgtacggtaacgttaccgtttacctaccgtttccgtacaaccgtaacttaccgacgtacccgtaccgtaccccgtaacccgtaaaccggttacggtaaacgtttacgtttacgaccgttaacggttacctttaacgttaacgttacgtaaccgtaacgtacgtaaccgtaacgtacggttacggtaccggtccgtacgttaccgttacgggtttaccgggacgggtaacggtaaacgacgggttaagacgtaacgtaacgaaacggtacgtaggtacgtacgtacggacctacgtctacgttcgttaacccg

SEQ ID NO: 240348 - DNA, 774 bp, Homo sapiens
  misc_feature: GYAE6OF01ALFBF.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggganacacgccacctctcatgcgacggccagtcagagtattaacgaactacgttacgttcggccttggtaactacgaaataccgaaacgtcccgtacgggacccgaacgggggttcccccggccttccccttacgtacgttaccgtaagttcgtacgttcgtccgtttacccacggtccgacgggtcccacggtacgggaccacgtccccgacggtcccgtaaggtttccgtacgggttcggggtcggggtttacgggggtttccggaccgtaaccgtacggttaccgtttaccgtaccgttaccgtaacgtaaccgtaaacgtccgtaacggaccgtaacccgtccccgtaacccctaacccgttaacgggtaagtttacgttttaccggaccgttaacggttacttaacgtttacgtacgtaccaacgacgttaccgtacgtaacgtagttcccgggaccttacgtccgttaccggttccggacgggtaccgggaccgtaagggtacggaacgttaacaccggtaaacgtacgttacgggaccgtacgtccaccgataccgtgttcgttaacccg

SEQ ID NO: 240349 - DNA, 768 bp, Homo sapiens
  misc_feature: GYAE6OF01EIAZC.45.35.D02.1.454.CMB.1.raw
  modified_base (191)..(191): a, c, t, g, unknown or other
  misc_feature (191)..(191): n is a, c, g, or t
tcagacgcgatcgacacgaccggtgctcgatttagcacacgatagttgggttgggggaggaactgctcagttaggacccagagggaaccatggaagccccagctcagcttctcttcctcctgctactctggcctcccagagacctccggagaaacttgtcttgacacagtctcagccattctgtctctctntaccgaggggacactacgccaaccctctcgactcgaccgaacgggccagtcaggtacgttaacttaaggaacctattaaccgttcggacccgttagggtaactaccgtaaaataacctaaaggtcccgttcgggacccgtaaccgggggttaccccccggactttccctacctaacgttcgttaacgtacgggtaacttccggtacgtttacccgaacggtccgaacggggtaccctaccggtggtacctacgttacccacggccgtaaggttccgaagggttcgggtacgggtttaggggttcgacgtactacggttaacctccggtaacttaccgtctaaaccgtactaccgtacgtaccgacgttaccctacccgtaaaccgttacggtaaagttacgtttacgtaccgtaacgtttacttactttactacggtacctaacgtacgtaacgtaactacggtacgttcgggtactaccgttacgtacggtttcgggacggttaacggacggtaaggtacgaagtactaacggaaacgtacgtgtacggtcgtacgacgtactactcgttacgtcc

SEQ ID NO: 240350 - DNA, 707 bp, Homo sapiens
  misc_feature: GYAE6OF01D1MNA.45.35.D02.1.454.CMB.1.raw
  modified_base (203)..(203): a, c, t, g, unknown or other
  misc_feature (203)..(203): n is a, c, g, or t
  modified_base (649)..(649): a, c, t, g, unknown or other
  misc_feature (649)..(649): n is a, c, g, or t
  modified_base (677)..(677): a, c, t, g, unknown or other
  misc_feature (677)..(677): n is a, c, g, or t
  modified_base (685)..(685): a, c, t, g, unknown or other
  misc_feature (685)..(685): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctcggagaaattgtcttgacacagtctccagcctatttctgtctctctctccgagggganacacgcccaccctctcatgccgacgggtcctagtcgaagtagttaagttagaactattacgttcggccgttaggtaactaacgtaaactaacctaacggcccgttacggacccggtaccggggtccccccggtacttccctacctaatccgtttaagtggtaacttcggtacctttacccgacggcggtaccggggacctacggtacggcctaccgtcccgaacggtccggtaggttccgtaacgggttcggggtccgggtttgggtttaccggctaacgtacgtaccttcctaactccgtacaactagtcaacgcaccgtccctaacctacgtagtaacttacgttcgacttagttccttaattctacggactaacgagttactaaccgtagtcggttccgccttaccgtcgtacgggttcgggaacggaacggtaccgtagggntaacgtaacgtaacaacggtatacgggntaccgtanaccctagtcttcgtgttacccg

SEQ ID NO: 240351 - DNA, 740 bp, Homo sapiens
  misc_feature: GYAE6OF01B5TOE.45.35.D02.1.454.CMB.1.raw
tcagacgcgatcgacacgaccggtgctcgatttagcacacgatagttgggtttgggggaggaactgctcagttaggacccagagggaaccatggaacgccccagctcagcttctcttcctcctgctactctgcctccgagacgaccgtcggaagtaattgtcttagaccactagtcctccagctattctcgtctcctctcgtacggagggacaccgacgccctacctctcagtcgcgacggcagtacgaagtattaagtacgaactacgtacgtcgcgtagtactaactaagtacacgccgtcggaccgtcccgggtccccgtctacctcgacttcgtagcgtagtccgtcctacgacgtccgacggctacggtcgaccgacctacgcggtaccgtaggtcggtagggtcggggttaggtcggtcgaacgtacgtacgtaccttaccgacttacaccgtaagtactaccgacggtacctaccgggtacccaacgtaacgttacgttaacgtaacgtttcggtaacttaccgttaactttacgtaccgtaacggtaacctaaggtacccgtagtaacgtacgggttaccgtccgggtcccgttaacgttaccgggtttaccgggtacgggtaaaccgggtacgggtaaacgtcgggtaaacgtaacggtaacgtaaaccgtaccggtttaaggccggtacgccgtacggaaacccttagtacgttcccgttaaggttaccc

SEQ ID NO: 240352 - DNA, 835 bp, Homo sapiens
  misc_feature: GYAE6OF01EDWFW.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggcctcccagagacctccggagaattgtcttgacacagtctccagcctattctgtctctctcgtccgagggacacacgcccaccctctcagtcgacgacgggcctagtacagtaacgttataacgaactagttacgttcggaccgttaggttaactactaaacgtaccaacggtcccgttacgggacccgtaacccggggtccccctaccgttccctacgtacttacgtagtacgtacgttccgtaccgttaccgacgccggaaccggtaccctacggtacgggacctaacccgtcccgtaccggtaccgtaaggttccggtacggggttcgggggttaccgggtttacggggttttaccggaccgtaacggtaaccgttaccctttacccggaccttaaccgtaaccgtaactaacgtacccacggtacccgtaaccgtacccctaaaccccgttaacggtaaccgtaacgttttacgttacggaacccgtttaagtttaccgtttaacgttaccgtaaccgttaacaaccggtaacggttaacgttaacgtacggttacgttaccggccccgttacgttacccggttacgggtaccgggaacgggtaacggaaccggtggtaacggtaacgaaccgtaaacgaaccggttacgtcggttacccgacgtacgtaacgtaccgtacgtttccgtcgtttaacccg
